United States Patent 10,233,495 (METHODS AND COMPOSITIONS FOR SCREENING AND TREATING DEVELOPMENTAL DISORDERS) - sequence listing, part 180

SEQ ID NO: 1124 - DNA, 143596 bp, Homo sapiens
tgaaagaaaaactatttatttctttatacacatcttgctttaacaatcaccaaaaagactttcattttctgtcacccaccctgtccaccagttatgttggccttcaatatatggcgttagcaacatatataaatctatatcatatatttatacacacaaacacattctaccagcactgtgaagacacagactaggctttactaggcttggggcctctcccatgccacttaaaaatgagcacaggtttgctctatgcaagaatttcaacagagttggtctggccatcagtctgcaatttccccgagataagatagggtgacaaaatgggacagcaactttgaagtgaggtcagtccaatttggatatcatagaagaaaagaaataggatgtgctaggttaagcctgagatggtatctgggaagtcaccacattcatgatgtgaactcaaagaacacaggtgctacagtgcagaccaaggcccagcctgactcgacccaacagggtcaggtgtggatctgtgagtagtgctcactgagcccccgccagcagtgtccggcagggcaccgctgctcagtagtgtgcttttagaacctgccagaggagctccagcattgggaccacgtgcccctttcatcggaatcagggtcctatattcactgagttttccatctcaggacagctgatgaggcaagaaatgtgctcttgctagttcccaagctgctggggctgttgagaggcaggatcacaaaaccttctgtgcaaactacgcatctttttcttagtgctgggccaagtggaccttggctaatcgtattccatagccgtcagaaaggctttctgcctttctcccagctccaccaggatacatctctgactccctcttctggaccctcccgtggacttggaggaatgaggcccagatgctcctcagcagataggtagctgcacaaaagggggacaggcccacctttcctgctgttttaaggacttctggtggctgcgcttcttgcatggttcctggaaggcaagggtcacaaggctggagtacatggcagagcccttagggatttcacctgcagacaaacataaaacaaaccaaatcagtgtatattgccaggccctactgatggctacctgaagctggagtgagagctacgtggtgaccaaagccaggagcacggtgagagccagttaagaggatgagctaagagcatgcgctgcagtctggaggagcaacaggtgcccgaggttagggggagcctccccacctccctgtgtgctgagatccctgctccaattcactgcacactgggtggctggatcctaccactcccccttcaggggccaggtgactctccaaatcactttgtctcagcagaaagaggcctttgccatctccacccaagaaagaagtgcttagcatgaaacatgcacatatagaaacagcctgtttgtaggaagaagaggacattttgctgggaagccctctgttaagtttatgtccagttgccataatgagggtgtggaggggccaagtccacagggacctcagagctcaactaagtccagttccatctttgacagatgagggtgcagcagtctcacagagactaagggacaagccaaagccacacagcagttagtgataagccagggattagaaccgaggcctcgggtcctttccagtgatctatgggaggtggaggggaaagcttccacactggagaaagccagtggatactagagatttttgggttaccttttagtggatactagagactttttggattaccttttctgggacaggaataaggctttacagaggcaatcctgtaagtgctgctctaaagaggctcaggaaagagaagaattatcagagaaaaacaaaagggaattagtgaaaaaataaaaaaaagagcaagttaaactggcccaagtcattttcacactatggagatcaacattctctcaggttatggattagaaacatttctaggaatatgctgaattgcttatggcaaagctttgatgtccatgttaaaaggtttagtttctgatttttaaccatttcatatacctcaagtttttcttcaaagcacttcctagggaatgattaacacttagtgttttaagtaaatgtagataatgtctggtacatatataacattttttccctgaaggttcagttgttatttattaacaaattcgcttttagaccaatgagacccaacagatctcttttgtcatgttacttaaagatatagcaaaatcaaattgctgttcttaacccgggaatgtgcagtgaaatcagtttattaggttgcaaattgcttttactttttcatgaagagtagaacacataactggcctcaagatccctctactagaagctcattcagaggcagactcccgaatgtctaatgacttcaagagtcagctgaattgcatttctccagtctctgaacttggcctcaaagaagaaaaattggagtaaaaaggagagatgatgacaatgtgagagtgaaccaagatacaggggcaggagctgacggggtgggagggtgatggggacagaaactagcaggatgctcactgaggacctgtgatcttgcaagtggaccccaagtcttctcctggaaggccaaagcaggccaagggtcacctacaagatctgctaacggatggtgatgggtgggggacaggcttggtgcctctgactggtgcagtagtttccttacctctaagttagtccttgccttctttaaaacatcatgtgttctggttactgaaacaacaaaagagcaccacagagtagaaaccaccagcagaaattaaccctacttgcttagcatgagaattctaaagcatttatttctttctggctattcagcttggagtctccttctatccaccccctgtcctccactccctctgcagccacaattgctcctggtacaggaggtttggggatatcaaatcagtctcaactcccaacatccccaagcccccctgatcacttctcatctgaagcacaagtggggcatcgggaagactgcctgtttcttcccccattccctctcagggaacctacgctggctgacaatgaactgttccatgctctccttctgctggttggcgttcttcagatgctcagttgtgctctgaaggagtcgctcctgtttggatactttggttctcagttccagaagttccctttctgttgattctccctggataagaggaacagactcttactgaccaggcagaaggcctaaagcaccctgtgctttgtggctctttccaattcaaagaaggattctacagtcttctcaactctcttgaactggatttcctccttcacagcctcggatacctccagctgaggacagttcaggatgaggccattaggcaggaataatgagactctggaattccccatgcagactagcacaggcctacacacctgtagcttaagagaacctcgcctcaggctggtatcaaactcccaactctgaagaggaccttgctttagtcctgatatcagttctgtcactctcccttcacaggtaagattgagagttcagaagtgttatgctggggtgagagatctggactcagggaagtctgcaagtttgtaaatatttgtgccaacatgaagatggcaaaacaccctctccctggaattagcatagttggatccaaaaggtattggtgccattgacctggaagtagaatccctggggaggggatcctgaaacctgcctacatgagggtctgccaatcagagttagcctgagctctgagcagatcctgaggggtggctgactttccccaggcctggtccagcgatgccagcttaagttgtatgttgggattccaggcagtggctaaaaaggctcagtctcatggggcattctgtgatcatttaaccatgggacctgaggggtgggagatgggtgctgaagctttaactgaatttcagctcagtcaaacttcagagaagtaaataaactgaacatttatggatggccagggttatgatgtctccgccttcttcacaccccttcatcttctttgatttcttaaccaggggacagggggctggtggggaatgggatatattcagagctgtaatgaaagcagccaccatgggtcagagatgtccctccagggacactcctctaagttcctgtctatcccaactcactatgtggctcctgattttctggaaaagctgtgacattgaggagacagaacagtattggagggcaggagaactgggtttgaaccaagaaagggcactggcatcttaccactttgccaggcagcacagggatgtgggtgcttggcagggccgctctccagaacatggtgaggagggaagctgactcctctagggcatggtgcagggcactggtgctgctccgaagctcatgaatacctttgctgcctagcacctggggaaaggtaacaccacaggagcggagagattactttcttccccctgcatgggctcaagcttcctttgtgagtgaggcatagaacatgggcctgcttgaacctgtgaagccctcacacaaccatttgcagctctcagaactaaggtgctgctccctttaccaggaatgccttcctccacctgcagaacccacaaggctttcaaaactcaccccccttgctatgtcctctatgagcctgttaccttccttgcctgagataaatgaccacatttgtattggcgctctcacagcacagaggatgacttctcatactgtgcctgtagccccttactgtgcttatctacttgggtgtgtgtcttgccctctagtgtgggggctccgtggaggcagggctgtccctacgcatccatgggtctccagcagctcagacagcacagccacaggttcctggtctctctcactggcaaggtgctctcagaagctttgctgactgccttccctccctctatgcagtctgcacaaggaaatgacatggctgccaggcttctcaccccttccacatgtgggggccatacacctgcaaatccttcagtttctatccatcccattgagttgactctgcccacagatggtcatgtgcctgcatgactatggtagataataagctaccaaaggctgctaggcaatgccacatgtttctgtggggctgaggggaaatatccagtcagctacatctggaacagagcagaactcacagtgaaaataggagatagagaagaaagggcctggctgctatacatggaagaggaagtctcagctgttgagagatgcaaagcatgaaaaaaacaaaaatggtgggagaaggagttaacatcaaaggaagaaagggcacagggaaagagtgcacctaaagcttcaggtgtgattacctctgtgccttgggcttcaaggccagggaagctgcacgctgatctcacaagagacactatctttttgaccagcagcttgccctccgcaatctgctgtcttagggcactgtagtcatcaatgtggccaatgacatggcggccatgcttattggcaaaggagccatcagtagcatcaccctctagcttgggaggggtcttcattactggagaagtatccaaacccaagcctgaaaaagaaaatgacaacacaacagaatcttctgttattcataatgatatcctcagtttgctccaactaaaaaagaggtagggaacaagaaaaggacgaggccgggaacaagaaaggaagcctgggaatgtacaagggtggggcaaagtccatagagatcttctggcttctatatttttataatctttcttacattatctcttaatgataaatttgccaggagacaattttttccttattggcaaatgaaataggatgaatcataataaataataagtttctgagtagagaagacacagacaaggaagtcaagctggatacagacagcattttcaagaatagagagattatggtgcaatgaagcaaaaacagcagtaggaaaactacaggaggatgaacaatggcaagaaaggcagccacagaaggtgcagggagtagggctaaaggccttggggcatgcagagaaaactctctaaatacagataatatgtttagagacaacaaaaggttgtttgcattaatcactttccatcatcagtccctgggccctttagttgccatatttaccatttgctctgttgattatgggcgtttctgagccaggagtagaggaagcagagctggggaagaccagagctggggaattcataccaacatcccggactggaggggacacagctgaatctagggggtaaaggcaaccacagttttcaggagccctggaacacactgcacatgaagcacatgcacacctagctgtccccactgagacctaaggtggcaggactctcctcttacagaattatccataccccacaagccaaagcaaaatcaaaagcctatgagtcactgagttcagaatgtttccattcttcagaacaaaaagatattcctgtaattgaggggtgttccatgagaacgtaacttctagtttgaaaaattattaggtgtatttttataaaccgagtcttaagtataatttgtgtgtggtatctaatatgatgccctgtaactaaatgtaatatgtataaatatacatagtacatattaaaatctagaatcaaagaatcaaggaatgaatggattcatgggggactcaacattctagtcatcattctgatgaggtaatactgaaaaaaattgacttgtatgagaagaacggagacagaaggcttggtgggttaacattgtcttgctggagactaaaaagcaaccctatggtggaggaattggaaaatatcacaaagaaggtagaaaaggtcctgctcaggcaagtgtggcccagtgcctgctttccagctcaggcctccggggtgctagagaaagaggggcagggactgcatcagtggggctgagtcttggctgctgtatgggaagccagtgagagaagaaggcctggttagaaggaagagttggagacataactgaacaccacaaccatcagggcagcccagaggagggcaaggtgtccaactaatgtaagctgagcagtgcctggtggtcaggcggtttgcttggtggaccacatgtgtttttttattgaattgccaaaacagcataatcatgttattgtcaccttcatttgacaaataaggttactgtcagataaatgagaatctacaagaaccacagaaaaacaaagattaacatgacccagaaatagctggcaggagagtttgaaagctcagctttagagaaactgaacagaagtggttcctgatttgaataaaattgaaggtatggccatggaggtgagtggagatggtgtactaaacggtgtatcaaaaggagaaaaggacagaggaagtagaaattgaatgatttaagagactagggggacaccattgacatttcaatgaaaactgggagaagtgagattgatagaggatattgagaagggggacctggtcaaacacgcctatctgaaaaggcaggcaaggggtggggtagagaaagcgaatgatgaccacccgaaataaatcacccaccatccaggacttccccagagccctgtttccttaggggcaggaacattttaccatacactgagttccccacctgtgagggaaagggggactagagaatctgggaaggtcggcaatactgagacagggcacaatgagctggaaggaacacagactgaaaatcacaacatctggttctgatcctggctttgtctataacttctctaaacccccgcttgtctgttaatatctcaggacctaagttttcttatgtgaaatacagagatagcaaaacctgctttacttcagatgaaattatatatgtgaaaacacttggctaaaactaaagcaccaagcaaatccaagaaaaagatatgaacatatacagctgctaattattgagtaattcttagtgtgccaagcacttgtaaatgatttcatttaatgctcaaaatcatataaggtacatatgatcattatcctcatcttaaatataaggaaactaaagcttaaacctctgagactttagacaccttgcccaaatcaaacgacctctaagtggtaaactcagaatctggagcccagtctgacctaaatcccacgctttcactcaggttgctagactagagcatctctgatttcaacctgaccctaaggagcatggaccaggcagattacaccttctgccgcagaacttcctggtgatctcccgactggccaagggctttctaagtcccttttccttcctaccttggaggagcagctgcttgtttccagggtcagtgctggctgggaagttctggttaatggaggaggggctgaggctggctttgccagcaccgctctccagctgctgttgcagctgcagtcgcagacaattgttcccctgaatgctctgctccagctgccctctcagagctcgtacctctgccaccaggtggctcaggtcactgctcaaagggatttggtgacaggcatccaggctgtaagctgagagagaaggagtctggtaacattgacccaagtatttccaagcacttgtcagaaccctcctctgtgacattcttttctgccaaggaccccactatcatctgagtctcatgcaacccatctgtgatggagatgtcaccatttctgtgtgtggcctggggatggcactgagctggcacacatccagtctgaaacttccctgcggcttaagttacacacatgcacctatagagcatttgattggcagatgaagataagtccatatttcatctccatagtaaccttaatcctgtaggctaaagtataggatactccaaggtagaaggtcagcactgagctagagaagggtaggggatgaggaagaaagagatttcatagtcctcactctcaaaaatgaaagagaaggaggaggtcttttggtagcatgtgagaatgtgagttgggcaccttagacgagggattataactgagtttttcaatttctctctctctctttctctctctctctctctatatatgtgtgtgtgtgtgtacatatatatacacctacatatagtgtgtttatatatgttgtgtgtatatacatactatatataggtgtatatatgtgcacacatatacatgtacatatatatgtgcacacatatacatgtacatatatatgtgcacacatatacatgtccatatatatgtgcacacacatacatgtacatatatatgtgcacacacatacatgtacatatatatgtgcacacacatacatgtacatatatatgtgcacacacatacatgtacatatatatgtgcacacatatacatgtacatatatatgtgcacacatatacatgtacatatatatgtgcacacatatacatgtacatatatgacatgtacacacatatatatacatacacatatatataaatatatatatgtatatatatttacctccattcaccacatggctatttctttgtactggggatgaagagatctaagaaatattctacgaggctacaatcccttatctgaaaaccttaaggccaaatgtatttcgaaaggtaaaatttgttttagtttttagcaaggcaacagggtgcatatatcatatataacatgtacccagttgcatgtgagccacaatcctttatcaaacatataactatttccgcaatgagctatgtgaatattctaagtagataaataaagacttatgaatatcctcatgtcagatcatctagattttgtcactaaatgagtatttgaaaaatttaatttggaaatcttactggattttgaaattacagataagagattatggagctttagtggttgtagctttgaaatgagtcctaaaaggcagggagaaaagcatgaaaggaaaggtagctcaggatgaaccaattttagggactttggtaaataatctactcttgaattttgcccaaagttttatgatgttcctctctctctttctcaacccaacttctcactaaattttgcttattttttaagagatgttttaaaatctatctataccctttcatcttcccaatagcaccttatattagactgtcatctcttaatgtgccagaatatcactagacccatccaatacgtttcccagattctaatgtctcccaattccaggacatcccctaagacttagcatcctaaagttctgttttcatcatatgcttatcttctttgaaaaagaacagacttagtttcattatctactatacagaatgtcaacttttaccctgacctgtgagctttcaagatttggtgactctgctccaccatcctgacttctcactccaacctcaagcttctcctgtggtcaggctggtcccactgacccaacactcaccatgactgtgtacttaaattattctcccagcctggtgagccccctctatttcttcaggttccagttcaccttctctttagaaaatcaggaaactaaatcaggatttatgataattctaatctaacttccactgcccttcactctttgtttagccttctggagggacataaaatacatgagttctttttcacctgacacttcttcaaatatccgaagccagttctcatgtcctcaagatcttttgaaagcctacatttctttagtttctttgactagttggagatttctggtccacaccattgtgcgccctgtcttcattatgttccctagtgtgtcaacgcccttttcaaagatggtgccccttaatctaacaatattttagacatggtctccacaggcgaacatcacacttacactactgtagttccagtttgagctggcatttctagcaacctttgtcctacaccttacttgtgtgaacatgtttctaccaaaccccaaaccctcatgtccatgaatggctgcctgtcctatatttctaccctcatcctatatttctaccactgatatttttaatcaagctcaggattttgctttttatctttgctaaatttcacgacattgatgtcgtcctctgttccagcctgctgtgacttattcacattatgttttgaatacccttctccatttaaagaatgaagaaatatatcaaaattctcaaatattagattattatttcagcaggcagcaaagtcttcaataaatgtccttaatatttaaatccaggattgaaatttaggtcctattagtggtatttctataaggtttttttgtttttgtttttgtgtcttttaattttctcctgtgggcaggctggtccccactgactcaacactcaccatgactttgtacttaagctattcgcccagcctggtaagcccctgtatttcttcaaattccagttcaccttctctttagaaaatcaggaaactaaatcaggatttatgaaaattacatgagagggcaataagctgagcgccagatgtcactagggaaagggtcagggtgggagcggactgcctgctgcattgggctgaatgggttgtcagtatgtatcaccgacaatattaaaggccttttcaaatgatgatatcattaggacagttcttttgctttcaaaaatgttacaatctagacattgataggaatgtctagattttcttaaagtaattaggaatgatcaggccggatcttgctcgtgccaccaacctgtcccgttgggctttgtgtttgagagctcctactgggagccccaggctcgggtgggggtttctgcaacagaactctgtagcttcccatgatctccacaactcccaaaggaaagacctcactagcatcctatgcaagggcaaaaagctcatggggtgaggggagaagaacacatacctttcagccccttcttggaattgccataaagtgcctcgtagatttgtagctctgactggagggactcaaagagctgctgtttctcttcacactgttgctgcaggagaaccagcttgtgctgcagtctgaccagggagaggcaaggcccactgagatggcagagctactcagccacaccagagcaacaagctgagagccagatgtcaactcagagggtcataaagggttacagttagggttacatctgagccccagatgtcaactcagggggtcatgaagactatcacttttatttcgcagatatggaaatggaggctgagggaggtcaagtaactttgcttgaaaacacaccattacctacattagttcagagcagaacagacacaccagcacagtctccttactgttcctacagtgctctttgcattctgacaagcagttacagggcttatgctgggaccaagcatcacagccagtatagaagcttcctaggtgatggtgagactaatgtcctatatctaattggaagcatgggaacccttctttttcatgtctctgatatactgaagacttctataacagagttttactctctcaacttgggagtgacaaggcattcccagagaagtcctttcttctgctcaaagcgcccctccccccaccccactgacacacaaaaatcaggaatagcagagggaacatttaggtttccaaaagaggacatcaattgtcttgccaatatcccttcctcttgtaatgtaagaatgaatgtaagaatgaagaatgctaccttctctgtcaatgggtcccctcttacctggagtcgttttcctggagggaaagacgttcctccctgaaatgcaagacctcttgctgcttctccctcaagtcttccaaaagctgctgcctttccaccttctggtgctccagctccttttccagctcttgaaggtgggatcgagaggacagcagagcctccctcaggctttctgtttcctgggagtgctctggtgagaggaacacaggattgatttattatcatggggccagagctcagctggaagatgaccccaagcacatccaccctgacagacagagctaaggagcagggaaggaaggccctatgttggtgggaagagcatgctggctcaacatcccccagagcctggagcatggtgcctctctctctttgcaaaacccttcatgccacttatttaatctgtcctaccttgctcttagagaaattctgctttctaatgatcaccactttccaagtgctcacatatcgtctgttcaataatccattcttgaattttgacaaagatcaacgtcaagatttctttttggatctcattttcattattttgaaaactgagattttttgtttttgaacttgcagcacttctctgatcttcacaagttgtcaaagattattgaagggactctaaaaatacagctgcaggctcagtaagtcctctggggaaagagtcacctgagcctggcaaattgtactcgtttaaatctcttactgtcttctcacctgctgaggtctgttctattctctccaagcatgcaatggtagctcagtagttctgccctctttcttatctgttaacttttgttatcgtcccccagcagtgacctttcctctcaaatcttctcgctaatacagaaatcaattaattaaattaattaatttgggtggctaatttagaaatatctcttggtggctttttccttttccacaagcattccttcattctgggcttaatccttttggatactaccctcagtcttttcatggctgttcataaatatttgtgaataaaaatactttgttatcgataatacattgatctgatcaagtagactaacaccaaggtcagctgcctcccagccacacgagaaatgatgcccacctgtgagcgccccctggctagggctgggaaagtgctggggggcatttgctagtgccactcggcatggagtcatgggagtactgaccagagggaagccctgagtctatgagtgagagatgtggtgaggaggcagagggatggcacagcagggccaggagcgacacatgctgctgcagtaaagtctggagaaacttgagagggaagataggcattcgcactccctcctttattggttccaagtcagttgtgagtgaagggaggtagagcagataccagactggtatccaaattgatagcttgtgactctggatatatgcaggtgggcttgtacagaaatgatggatttcctagagctcttcgcttctggggactaggagtctgaggggcccatagttggaacatcttagaaagcagccttctctagactgagaatagctgtgagtttgggttggtggatctgagtagctctgttacctctaccttcttctgtttgcttctccagttggtgattagtgtggccagggaagaaagaaacttaagagtgaccacagtttgtgggttttgaccacgtacctctggaaacatgactcagttgagcctgaagtcttcgattgtcttccctgaggactctgttctcattgcagagctgaggtatggactccaggccctgactgtagaagttagaagtggatcctgtcccagaaagtagacatttgggtaacagaaactttcaaaagtttcccattcgttatctctcaaagatactgccccaacccagcagaaaaccccaaggactgaaggcctggccctgaatgaagcgtggggggctgggtacatgttttctgtgtgcctcttctcagtggattctttgcgtgcatcatcacatgccgtaactgcaatggtgcaggaggctcgatctccctaaacagctgctgctgtggtataggcaggacaacaacatatggaaagactggcctccacatgacagcagcttggaaggagagtgtaaggagaaaggccaccttggtaaagaggcgagggtagaggtgggaggacccttacagacctggttccaccacttatcaatcacacaacaaaggcacagacatcagcagtatataagcagattaagtatggggtgagaagtcaggtgactctgggcatcagacgtagttctgccttaaagagagttactctctaaactcagatatattcagaaagtagggatgacagtacttgcccacctcccttgctggactgttcataaggagcgagtgaagtaaagaatatctgtgaagctctgcctaaaagtccctaaatagagccagaaacaggaaggtctgggcctctcctaccccttccacgagcagtagaggtcagccggtgttccagttgctcccgtaggcggtcattgatgcagatggattcctccaggcgctggcgcaggttccggatttcaccaagatgctcttccagcaggtcagcccctgcggccaaaccaccaggacatgaagagaggtgggagatggagaatcctggttactgatgggggtggggctcggctaggggacctgcagcaagacctgtaaatatcactagccttctgccaactgtgtcctctcacacggacacccaaaagaatggtagttttgtttaaacagtcaatgtgctttcaaacacatgacagtcacttgctaaaaaatctccatgggcctcctcccacacaggggtcttgtgagagttccacgttttagaaaaataactgagggctctggacaaggcctgcctagcatctggaaaggtgtggccacctcctgggtgtgactatgaggatgataggtgagacctcactctacctttcttcttactgacacgtgagtgagcattctttagcaagggacaaagcccttcctcccacccttagaaagaaggcctaaagtaaaagtacgtgatcttacactcaccctatgcggttaatgactgacactgaatgcttccctgaaatcacttttaatatggaagatgaaagaatagcctggaaggatctagagatctgaaggcaaattagagaggggatgacaccccccttccccctgccaaacaaagcaaaaatatccagaaaagtcagacggatgcttacaccggacattaactgcaccattttgctttgggctcagtcttttcctgaaaattacgattgtcttactgttggaactgcgcggcatctcagcatttatgagcttagctatacctctccacttgctgtgactgaattttgtgcacaggatatatttgcagggtcagggagctgcacccttacaccctttcctgtgacaagtcctgactgatggaagaaagtcccatctatgcctggcattctggaagggtctaagagagtgggctgcaaagaggccaggctgcagagggatggaaggacatgagtgtgacagcacaagaggtgggtccctgactttcccatatccctacagagcactgaggccctgggcaggagaatgaagaaatgtacttggaaaggattgagccctgatacagctcttgcattttatatccactctgtgagccagggatggaggaggaatgaaatagtcctgcctgggtaggaaaagagtagactccaaatgagacttcttttcaaaggctgccatctctgctttgtgctttacctgtgggtttggagttaagctggtacacagaggagcctgaggataggtccccagatacactccctttctgaggcctcatcacatcccacttgccactgctgcccaggtacccaggctctaggattcttcccagttctatggtgccccttggaggagagtgaggctgggcagagttgaggtagtaggaagagtcggcttccaagtcgttgctcagcaatgtagctgtggaagcaggaggaacagtgctggcacctgggcagaaagaaacattagtaagaagcaaatggggtgtcagaagggaagaatttgcaaggaagtgtgtgattgctaagaatagagactaaaaggagacatgtggaatgtcagagatcccagttcactttggtatactaattagactaaggcttgtaacctagaggttgtaactcttaccctttgtatttcctagcaggagacacaagaggtagagaataaagtatcttaaagtcatcagtatatacaatggaaaagtccagtggccccactcctggatcctactataatccttcatgacagactccaaggaaagttctaaaagtaggattcactcccacagttagaagttgtgagtgcagtggaatgcaggattgagcttacctgtgaacacgaacatctgtttgtctacatgtacttgccttcccctgaaactaactagtcaatatgtccgttccacgttggagtttttcagaagagaaaggggacatgaaatcaagctggatatggtggccctagttcctccagactgaagaactctttgctgaggctggggaagggcctatgtaaggcaagtatttatttggatcccatccaacatgactcaaggagctgcaaaatgtcatcactcctgtctaaagaatcattgaatacaattccacagaggcaggtaggacctttcatttaataggctgatactttcatagatcctttgaaatcataggcctttcccttgagccccatcatctccacttctctgtaaaaagaagcctagcatgggggagatgaggaaagaggtgggcagagacacagtttaggagaaaattcagaagcctgctttctttcagggattatgaacatgggcagcagaatagacaggtagctcctcctaagcaacaggagtgaggtcactgtttcttccatccaagccaaactccttggaggggttagtgtaaatgccacttgccagtttttagccctacttgtagctggttctcaaatgtgggtacatattggaatcacctgagaaagtatggaaacatatactgattcctggattccagagattttgccttagtctatatgggatacatcttgaacaatggatgttttaaattcattttaggtaattctaataggcagaagtttgggaagtcttgtcatgagtctctcttctaatttgcaaaatactagatgttcattaggatcacttagttaaggaagaaggttaaaaatttaagcacctacattttagaaggaatgcaacaaatacatgatttcctacctctttcaaactgccttcaaccccatccgaacacaaggcaaagggagaaatcagtggttgcagatagtcagcttactttttaatcaaggccatgtgaggttttaagtctatcagtaacaatgatcagtattctcatgttccagtccattggccacacaatacacagtacatgctctaaaccatgcaaagataccatacagactcttgcacaagattttaacccagggacctgagaggccaccatgcaccactgtccacacggaaacttggctcaaagcaaacaatgagcatgtataagcaatggtcccttggagaggaccttgacttcaggtggagaaagaaagggctacaatcttcctcatctaggctgggaccatttgaactccggtcaatggcctcagacttgatgtaattccaatttaacccaaaacaacagaccctttttcatggacagtgctctccttccatccttccgtttgggcaaagacaaatggacaaatgtggaaagataaaggaaaaggaggcaagataaagaaatggaagctagaaaatactcttgccatttgtcatgggacacatttgttgcccattcattgttggtgccagaactgctaaaataacaagttttaggtcagaaacagcagcacttcctactggtctctaaagagagggaaaaaattgttgcaacgagtccccagagtttgatcagctgagctcagctccatactctaagcaggatggtgacaaagccatcctaagtagaaaagatataacagaaacataaaacctggagcagaagaccagattcaaccccatctctcccacttaccagtgaccttgaacaagtaacttcacttccctgagctttacagttccctgcattagacaaagtacccatttcctgggttgacaaaataaataggctaagctgggtgcagtggctcatacctgtaatccctgcactttcagaaaccaaggtgggccaatcacttgagctcaggagctctagaccagtcttggcaacatggcgaaaccctgtctctacaaaaaatacaaaaattagccaggtgtggtgacacacacctgtaatcccagctacttggggggctgaggtgggagagtcgcttgagcccaggaggtagagactgcagtgagccgagatcgtgccactgcacttcagtctgcgtgacaaagtaagaccctgtctcaaaaaaaaaaaaaaaaaaaaaaaaagaggaagaaggaaagaaatatgctggtccacatgacatttggggctgtagggagggggatgcaaattcttggctgttgtcttgcatcactagaaacttctggcatggtgaccctatcagtctctggctcacctaagcttctttacaggcacagaaagtgcctgacaaatgagtttaagttcattcaaactgctttttaactgttgtgcctaaggtgctatgaaagagcaaattcatgtgaaggttgtcatttttttctaagctatcagtgaccaccagcacactaaatttatgatgagcatccagcctacaaatacatcaaagcactttctaaaaggtgactgtccacagtctacgtaactacatgagatcaattatctttgggagtcagaggatgggattcacagtcagatgccatagctggtgctgtggttctaagctgcctacgtgtcacctgtcccagggcagggaccaaccctgtgcagtaggaaaaggggctcatcatttcctcttctgaatccctctatcattaccctttttgctccaacctaatgatatcaggaactgaacttgattaacagcatttcacagcagaaaaacataatagccacacaaaggagcccactgaatgtggccatctttttcttggccacttcatcctgcataggcaaagcataacatctctctcccacccccaaccaatgagcagtccaccagtctgtcagggattcagcatacttggtggtatccaacactgtctacagtgtgagagcaccaggtctagagcctcgtgaacatatctacctgttaactgatgagacatacacaccacagaaataacagtaaatacatttccaaaaaataagcaaacagagctttccctccctcttacatttgtaacgtgtacccgtgttgtttttttaaactctgccatccagcccgagccatgcagagcaacacagtgtggggctgccaatcgcaagcacacaaatgcagaagtgctcactttctcccaactgcttctgcagcatctgtagctcctgctgagcctcagccaaggagaccactggtgtctcacagcagccaaggaggagagggccagtggggctgaaaggcaggaagctggatggagctgagggcaatggtgcctgaggaaggctagccagcttgggtatggagtgaaaatgaaagcctaggaaaagaaagttaaggagaaaagagacacatcatcaagagaaaatgagagaaaagaatgggtaaaagattgagaaggtaaaagcattccctgaccagacatcaccctgcggagtggctatcatctagtgtggtacaggataagacagccaagggtgaccattgctaccagaggctggcctggctgaccttccctcttctcccctgccagggctatcctgcatatatcctctgtgttcatcttgaaagcaattggctaaagaaggtaaggtggcattattgagccccaccccagcaatcctggacatggacaagtcagagagcctgaatgctttcaagggcccctggggctctgctcccagcatgtatcagtccttggccctgggacaagactctttctctacctagaactcctctttgacagcatcaggtcccatcctgagtaggagagatgtgaacaaaggctgtggggaaattttcattactagtgcatgcagttcaggactctgatggaaacaaacttcagaattccaaatcaacgtgttcattgaccaaattaaaaatagatgccttggtagagtggcttagacaaaatggcttgcaaatccttctgggcatttaaatcacatagcaaaaacttctaatatatgtagattctttaggccttcttgattctgtctaggccttaatgtagacttacagaattataaattcttggaacatgaaatttacatttaaaaaaagtcttccctggtgatctttaggcagcccatctacagacaggtttttagaaaccctggcaaggttcaatgtttaaaattgtttcctcttccctaaaagcaattaaagggcaggtagccaatggagagggagcagaaaccaaggctgacccatagagaatgtctaatgtagaagacaatgattatatcctaaaacacatcccaatggtgctggcaccatttcagatcaatactgcaaatatactcaaattgccaggtaacacagcccaggcattctttgaggaggcattctgattttaaaatcctctgttctttacctactgctctgtttgaacccacaacatttaagcagatgtctataagtctggaagcacagcttttcctcatgattctggtccagctgctgcctactctggcctagaaactttgaaaccaggctcaggaagcattggaacacttcctcttccttaagattttagttgaattgctttcagggaaatgagggcagcagaagaaagcactgtgctttctgggagcacctctactcaagtcaaacctcacaacaaaccacactgaaggcagccagccagctatggtgggaggtaggaggcgaagacaaggtttgccttttcttgccatccctggtacagggctgtgaatgagcagtgtaccctccggcaactaagctgaacttgtaaatgaaatgcacccctttaactgcccccaagatatgcactatgtacatatcaaggactgccaatccattcatacatccattaatggtaacgtactatgaacagaaccttgtctgaggctgttctcaccatccttggctacaagtagcactacctcttgcagaggatctccatgcagatttaatgggtaacacatacagtggatcaatagatgtgaatttcttttcatcctatggctgttgtaatcctgggagaaacattttgcctctttgctcccaggataaaatgagagaaaaccaataaaaatgtttctttttaaatgattagccaactactggtcagaactggtatgcagatcaaaacctgatgtggattacttattttctaaaatattttcttaaatcagacacaactggaaaatgaggatggtttctcgattctgtctaggttttgatgcatttaggcccctaacagtccaaacctctgtcgttgaagaaaaatcaaacaggcagcagagaaagaggagatgaagcttctgccccattggctgttgcatacctgaatgggcctggttggcctccttgggggtattctggggagttggcaagctgatggggttgctgttggattcggccttagccccctgagatgcactggttgatgatggtttagaagacaacacagcagaatgactcgaatgatggatggaatctataaaatccatgaatgaaagaaaacgtatgatgttctacagagaactggaatcctggccttatgtttacccaggggtaccagggctagagtcttgctttcagggaaagaaccaagcacaagcactgttagcagtgttcattttcttgcttgcagacagctcctatagtgaggcaaaccaccttagggatgacagcggtgctctgagctctgaaacatgaaaatggcaactccaaaaatatcaggcaagactagcagcatctgtggacacccaaatatacttagggaacactgctcaggaataagtagcaagatcattgtaggagagatgaaggaggttttccatcttaaagaagatctatctgacagagtcaccaaggaagaagagtctgccgtgatcttctcactctccccacagtggctcactttgtgcccaacagcttgtacgtgcccatggaggccacggtgacagaggtaacttgtagagtcaggagcagagcaaagatcctgatccactggtgcctgtgcatggcacttggccccacagccatgttcagcctgatacacaccatggtggagctataagccctgtttcctgagttctccactcagcctagacaaagatggtaccacccagaaagtggaggctacctgagtgactgggagaagctttcttctcttcatagtgtgtgtactcgctgactatgtccatgtcagagcaggcttccagttcatcagacaggaaagaggtgctgctgggagagcggtgggagtcagacaaggcatggctgctggagggtgtgagggaccgagcatccagcttggcctgcaggacttcaatcactttctccttctcctgcagctccctgctgagcctggtggggagaagggggacaacgggtaaaaccaaggtcaccgaagccaacctgtcctgactatggctcataggaaaagccaagtaagccaaggggaccatgcctgcagataattatggaaataacccacctctgcttagggatggagtgtaggtggggtgtagatggagagagaatagctacctagtgctctggccacataatatgctgaggacaagcaaagacatagctagccctccttttaaggcactgctgcttaatgtatgatccctggaacagttgcagcctgcgaactgtttgttaccatctccaacaagacaagtataaaaattgaaagcaagcattgagaaacacagaacaaaccactgtcccaacatccaagagcatgataagtggaatcatgtaattaactgaattcagaccatatatgtttctatgatagattagaaataaaaacaaaacaaaacaaaaaaaaccactgtgtccttcactacagatactttcagaagcatttatgtagtctgagacacaagcatgacacaaagaaccccaactagtggctacaacggactctgagcccgtatttcattgatcattatatgaagcaactcactgagaactgggtcctgaggcactgcagcctcctggtgatctacaccatctaggcctctttcaccaggtcctgttatatgattccttttttcccccagggcaattgagtgactattaaattagctgtcaacccaactttggaaaaagctcatcctgcttattaaacacacagcaggaaagcaggacccttagtggggcagaagactcttgaaacctagttagttcacttttagctcagactgtttctaggttactaagcctggagaattaatgtgccaatatgattcaaccaaaagggaagaaagaatttagttaaaaacaacagtgaggtgttcaatgaatgcctgaattcaatacattcagcactttgctttattccccttgatttgtggagttgccgccacccttgaccctttgggcctcggtcccaatctctttcccagattctcctctgaattacctgagggccagtggctcaagtccagcttgatctttctcacttttatgatcctctgtaaaccaaatttagaaagagacgataagaaattaggctggtcccacttcccgcattacaaatgcaggagcctatctggagacagagtagtgagcatttcatgtgtgcatccagaacagttattctgggatacctcagcttgtgtctctagagaagtgaccccactgtccctgacctgccggtcaccatgatgacttcctctgccctaaatcagggtaaaacatttataatgtcttttgttccattaatcatgaggcccttgcccagctgccctgcgggacactccagcctccatgtcctgctgcagactagctccccaatgcatatgccccaccacagctttcatgcagaacctgcactggtctctgaggagatgacaagaagccctgccccacctctgcatctgccaccaggtggtgggctgggtggctcccaagtctgatcctactttactcccttggatagtcgctggaaattctgagtagaagaccccaataataaccaatgtagcccttgaactactgcagccagtgcctaaaccatgtataaaagagcatggcgctttatccatatgtggagtacctgcatgcacattaccatgccataaatggagacaccacaaggataaggcatttagcgagttggtggcagcatccaggccagagcttgagtcttgtagttcttggttcagggctcttcctcctataacaaagcccttccatctcatgtcccctactccctcttagcatcagagagatgctgcccctgccccacaggtcacattccattagtggtgaagtttctatagttgtaaccatggcatctccagccctgtgttttcctctccatgctccccactgagcagtcttgatcctgtattagccccaggaaatgaaatagaaacaggaccttaggataaaaagttgcagtggagatgtggtggccaccaggggctggaactgtgggggtgactgagagtattccaaagccctgtggccaacttactggtgctgagtttgctggtgagcctctctgtcagctggcttccctgggcgagttgctcccggaagctctgtcccaggtagtagtcaatgtcattgctccttaggagatcctcaaaagattttactgtatcttttgcatgccgggtgataagataacaaatacctctcccttctcgtattttttgccgtaggtaagacagttcccgggcctgatcctgaatcagggaatcatatttcctaatgcaggacagaagaggaaagagtaagtatggaaagagtggaagctaacttatggagttatgggggcttctgtagagatttctatgagaacatctctaaggaactcccccaagctgaattctggcacataagccataggaggtatttaagagtaaattctaccctgataaagtattgcattaaaaaacttagtacgggccgggcgtggtagctcacgcctgtaatcccagcactttgggaggccaaggcaggcagatcacaaggtcaggagtttgagaccagcctcgccaatatggtgaaaccctgcctctactaaaaatacaaaaaaaatgagctgagcatagtggcacatgcctgtaatcccagctactcgggaggctgaggcaggagaattgcttgaacctaggaggtggaggttgtagttagccaagacggcaccactgcactccagcctggatgacagagtgactccgtatcaaaaaaaaatttagtatgtcactgttcttcaactgttatacatgtgttaattatatgtccctagataaatcataaggtctgtgagaataaacatagttctgcattttacatcccttacagcaccagtatcacatagattcacagcagttactcaatgaataattagcatcatttcatcctaagtctagatagaacctttcatgccttctgttttaaccaccacctgatgcctgaatttcttctatgttacgatactgtggctgactacattttgcaatgatggccatcatttaaacgctcataccatcaactgatgggacccaaaacaagagaccctaagtgagaaccacccagctgagcccagtcaaaccatagaaccatgaagcataataaagtgttgtttgaagtcactaagttttagagtggttattacttagcaatagataaccaggacacaccaagatgaatgtctgtgttttcaacactaagtatcaataacacttataactatggcaaatagcattgagagcttaacatatgctaggcactattctaagcacttgtattaattcttttttttttttttccgagacagactcttgctctgtcacccaggctggagtgcagtggtgccatctcggctcactgcaacctccacctgccaggttcaagcgattctcctgcctcagcctcccgaatagctgggattacaggtgtgcaccaccatgcccagctaatctttgtatttttagtagagatggggtttcaccgtgttgggtaggctggtctcgaacacctgacctcaggtgttctacctgccttggcctcccaaagtgctgggattacaggcatgagccaccacgcctggtcagcagttgtattaattcatttaaacctaatatccaccctttgagatgggttctcttatcatcctcatttaataggtaaggacaaaggctcagaaaggttaagaaggttgcatgggtagtaagcaccagaggtaggtagtctgattccagtattactactatactataccatctttactaatatatccctaagaggaaatccctgagacccggtatctcccagatactggaacatcatcctatgccctcctggttgcctacctgtcttttctgcagacctgtatctaccatttaaatcagtgtccctgtgaatacccagacatgttctttcttccaactgcctgagctaccctacgccaagcatgaacttacacattttcaatcaagaaagtacccaaacagtgccatccttacccaggccacgaggctgatctcagctcctcagccagcttctcttctagtccattttttgggagctgggcctccagctgggatactctctggatgagactctccaggtcctttttggcctgaagccctggagagtagaaagccccagtgccatcagacagccacccctcatcctcatcagggacactatgaggtgaagacccctccaaggtgccaacagctctcagcttccagggtctttccagactagacgaataatcacttgtaactgagagggaccggacccggctcttgaggttttgaatgaccttgttggcattctgcagctgggccttcagatctttgatgtcctttcgtaggaccaagatgttttctgactttccatatacccggaactcttcctgcttccctagctggttctccaagggcttcctctcagaggaactagccagtgttgagccccggcgtccctgctcagagcacagcccctccatcaggaccatttccttgaggctgttgtgctcctcacactctgaaaaaagacaaagatgtcttcctaaataaaagttggatgtgctgttgtggccactgcctttgagaggaggcaggtttggtcatgaggacaataattactagggaaaaagttgaagtagtactttattcaaccctgacactgtactaggcattcaaatacaatatttcttatcttccttatacctacaagttaggtttcatcactttctattttactgactgggaaaccaaaacttaaagagaggtggtaaactagcttgttctagatcactcaaactagcacatggcagagccagaattcaaatcctccaatgtcctgtgttcattccacacacactggtgtttcttaagacattaacatggccttatctatttaggatggccacaagaatgtaggacaagctattactgcatgctgaaagtttaatgctctttaaattttactataatttaaaagtttattgggttacaactgtatgaaaaataggcataggaaaataaggcttcaaaaaaatatatcagcatgttaacatcagtgtattagggcagtggtagtcagaatgagaactaatccatggcattttaccagatgccaggcactgttctaaagcattttataagaatttactcatttaattgaccttagtacctgatggggtaggtagttcctttattactattttaacacatgaagaaactgggacataggaaagttttcaaactgggatttgaaccaaccagtctggccccaggatcttgtctcttaactgccacactacactgcctcaagaatgagagagattgtgtttttcttctcttctggttttcaatgtggtgggtggccctatagttgtagtctttttataatgcaaaacaaaattatttttaatttatggcttgcatgtttctaaaaccttatctggtctctaagtaggccttagtatttctataataatcagttggatagaattttatattattattgttattagcagtatgccaaaaactaattgtagaaattcaaacttatactcagcctcattttgggtaagatttctcctattaacctcctgtcctcctcttccccaatacttgtcaggtgtggaattggccaacagcatccaaatgtgacagctgactccagggaggggtgagccccacaccctgtgctcttaccaggactggtggtttcctcccgttcagcctcattctcgcttcggccacaagtctcatagcccaggtcctggaggtccacctggatctgcttgctgtcctgcttcaccaaggattcacctgcttgggaagagaagcaggtgttacagaatgtctgaatttcccacatatgccctcagcctcaatggcacataccctaaccttttgaggcacggaaggcagatccacagtgggagagaagcttctctgaactggtgggagaagagatcaccagctccaggaagcagaatttctttccaaaggaggagcctgcatttgccattatctccccttcagataacccaggctttagttgggaccagatatctgtaagtcagggattgtacactatcatctctagcagccccattgaagctggcaagtgctttatccgcaggggttcaataaatgttgaatggagctgaactaatttagagtcccaagaccctagacctgtactgtccaataaggtagttagcagccacatatggccactttatactacatcaactaaaattaaataaaaccaaatgtccaagttgcactagccacacttcgtgtgctcaataaccacgttatgtcggtatagaacatacagaacttataagacatataggctagttttctttactagtaagtcatagttacttactaagcataactctgtatttctccagctcgttagcctgagcaaagacagtggcttctgatagcagcagcttctcctggagatcttgatagcgttgtttgcattgtgacagctgggagcgcaggtgctgggtggaccctggtaggctaaacgctgactgaggcccagggtcacgaggctgggactggttatccaactgtgaaaggggccaatacagggatcaggacagtctgaggtcacccccatgcagtgacgaccaccgccccttctgaaccctgtggactttactcaagtctgtcacagcacttctcatgccatttggcagtgacttgctttccagatggagctcctggagcgctgggataatgttttcttcatatctgtatccacagcacacagcacagcaccaatcaagtctacagaggagctctcaggaaatgttttctcagtggtcaaaaagagaccactcatctcccctcacattctgtcccattgattctctcagaatccctgtattctccatttcactgaatcttcagcatggctccttccctaaagaggatcccagtaacccatctgaagcccaggaacagacacctgtgatgagctgtgacaaaaaaatggcagtgataagggatgtcattacataccacttgtctgggctgcctcataacctgatgcatccctatgttacagcagttaccacatcctgttaaaattacctgtttgtgtgccatctttcccgacaatattaagtatctcaggggcagccattggttttattgccccatgccaatgcctagtgtgttatctgaaaaattaagtactcaagaaatatttatgttataaaagcctttctaaaggctgaatgtaggcagaatattactattattgtttgtggtacaaagagacccttctcttggtacctcctgattcatatgggagaatgttttaaggtaaacactgtcatctcaagcccttctccaattgtttttcactcaatctaagcccacacttacttggtgggcatccactgtgaaggtagccccaaggtcaaggctctggggtctggggaaaggcctcacagtcacattcccctcctcttggtgttggtgcttcccaggggaaccaaccagttctgtgtttattctttcaatggtgctggtcagatgcacaaggagctctggagtaagtttactattcccttccttgctactcagcacaagttgttctttgaggaggttgatgatattgtgggcattcttcagttttccctggagctttctgaactcagcctgaaggctactctcactcagaccctctttggttaccacagtctcaaccatcacctcgcccttctccttgtcttcctcgatctcccatccatcagacattgcttctcccatctgctctttcagctccgcattctcaaggcaaaggctcagcatggtgttcctgcaggaaacacacttaattgagggctaggtctggtcctcacaacagttcctaatactacctcttaccaacatctcagcccgcaattaactcagacttaccccagagcatgaagcaacctgagacctaccacagccccctaattttatatacaagaaagccaaggctcaggaaaagtaagagacttgcccaaacttccacagcttcttggtggcagcaccatcactagaaaccttggactcaagacatgcaggctagttttctttacttgtgccccatagcctcatatgttctaatttttagtagcctctggaataaaccagagtacttacactgttaaaaaataagaccttttctgtaacaaatttattgttataaattttacagttctattatttatcatcagtcagtttcaaaccattgggacttaggaacacagaataaataaataacactaatcagaactattaatataatcaaaatgtacttagataattgtttgctttatgtctggctcacgtgatagagataaccttcttgagagcaggactgtgtctgtcctattcatcccatatccccagtgcctacacaagtgcctgccacataaatcattcatatttgttgaagaaataaaattgaccaaaacagctaatttgcaccaagacattccagataaattctttccacaacaacaaactcatactagggttgagtggaagcaaacatggctgtaacaagtctattcacttaacttttttgagcctcagtttccttttatataaaataaggatgataacacttacctagtagagttagcagatgcttaaatgaaattgcatatacggtatggctagctcagggtctaacagggaagtcattcaatccctgctgtactagctgcagacctaagaaataccaacagcagaatcccataaggtgcttgtttaaaaagctgtagagctaaggcctatgaatccacattttacttaagttccacaggtgattttttaatttttatttatttattttttttttttgagacagagtctcactctgtcacccaggctggagtgcagtggtgagatcttggctcactgcaacctccacccctgggttcaagcaattctgctgcctcagcctcccgagtagctgggactacaggcacgtgccaccacgcccagctaacttttgtatttttagcagcgaaggggtttcaccatgttgggcaggctggtctcgaactcctgacctcaggtgatccgcctaccttggcctcccaaagtgttgagattacaggcatgagccaccatgcccagtccacaggtgattcttaagcatgctaaactgagaacccctgagctagaggatgcacaggaaatgggtaattcacaacttgaaggatcagcagtgggctatgcacctagattgaatttctcagaatccaggagtcttggaacctacagcagagcttatctggtgtgtttctgggaggaaaataggacataggatacagacaatctgtgagatagtttctcaataaagaaaaaggggataggtattttaccaaaactgggatgtggaaaggggataaagagggcgcatgtgtatatggaaaagaatatttaatattatgttctaacttcatattaaaaaaaactgatatttttaaatacaaacaaataaaagaaaaactcaacaaaaccttcttgaaaggaagaacaatgcattagattctaccttctacagtataagtgattctgtaggttgggtggagggttgaacaaatcagagtttcaggttagtaattctgaggacaaaggaaaataatccacagggatagctatagatggtttgattgtaggttcaacaatagaatcaaaagagatgtactgttcttacccatgacaactcaattaagtttacacatacaaaaatttaagtaaaataatatgctttaagtagaacttaaggaaaaagttattatgataattcagagcaaaagaatcagcacttagaacaatcacaagaattttttaaaaattgtttgacaaagtatgtagtatagaagcaaggtttagacgttagaaattgggagccacagatattatgcaaccttgagcaagtcacttgaaactttctaggcctgagtttcctcagctatgaaacaacgacatgaggctagatgcctgggcccttttcaaagtgctaacattattcagggaaatttaagtggtatgtaacatgcagggaaacaacagggcatgatttagaagtcatacagctgtactttaaacaggcagtgatgattatagtcctgggagtgaatgaataaatggatcagccctacagtatcagcatgttctccaaggagcttttgacaaaaagccatcaaagacagagtggccaatctaaccaatcaatgagctacctgctatttttgtaaaattactaaagcagcagagatgattaaaattgatactctatgattgaaggacttatgagtgagagctgagaggagagggaggggcctctacacaaaccctccagccgggtgcggtggctcactcctgtaatcccagcactttgggaggctgaggcggggggatcacgagttcaggagattgagaccatcctggctaacatggtgaaaccccgtctctactaaaaatacaaaaagaaaaaattagacgggcgtggtggcgggctcccatagtcccagctactcggcaggctgaggcaggagaatggcatgaacccgagaggtggagcttgcagtcagtgagccaagatcttgccactgcactccagcctgggcgacagagcgagattctatctcaacgaaaaaaaaaaaaaaaaattcctcctccttcgtgaactgttctggttctgtatacagcagtgagacatattaggtagcagggattccttatacgttttggtcaattaaaaacagcaatactggtcatgtaacaaggaggtttccaccatgactgtcatatgtatgactggcagatgcacaataatagtgggcactgttatactgaattaagaccaggattatttgaataacagaaagtgattaccattagccaatattacttacttttatctaaagaatttgtagaaatattaatgcatggagcctgggataggcaccccttggctgtggtgcctcatgacctgcaagctccccttccctgggaagaatgtcctacctgatgtgggacactgaggagaatcctgcttcctcaatttgagcctttagctccttcagttcctcctcagctttcctcttctcttctaagtgctggtggaactcagccctcaggtggagcatttcttcctgaagacacctgttactgtcccctcccatcggagaaggaggggaaaaagatgggttctgggtctccacagttgccagacttttctccaaagccaccttgacaagctaaaagaaaatcatggtttgaagaagttaggccattaaagaggacccaagagaaacatgagattgcaaaggcagttttaaatgagaacaaaaacaaacaaaaaaagcagatctaaaataaactccctaaccagaacctccttagtcaggcataagggccctggggactggtttgggtgggaaggacacacaaaatgagcaggaggaatttccccatggagaagaggagaatccagagatggtgagggagaaaagcacataagaaattaaaacaaatgcaaacaaacgaggttgaaacaggactggagggtgtgaatacggtgattctttctcttcctgaggagacagagccctgcgagttttctcacaattcaggaagcttcatcagctctgcaacacttgagtcctggatggcgggagatgatggcttaagatatcagggcgcaaagcctaaggccctgcctgtaactccaactccctcaaggacagctgagagggaggactcagggcactggggaaacagtcggcagacacagttacagaattagaataaggtggagcgacagggaagacaacaccaactatttcattggcagcagaaggatcacactccgcagctactgggagatggaggtgaagccatcctgccaagcagccaacctcactttttggttattatctttgtgctgatgctgccagacaaactctctctacaaatctcagcatgtggaagaaacagaggcaggaacaactgcccagcacctttctatttcttgaggacactcttgaagttattcatcaatgttttaattaaagcagatcttatggcctttgctcaaatgggaatttgttaacttttagactttgttattgttcattttgggcttatctttggtcttttcccacgctcttaaaagtgtagaaatcaaaatctgagtatgataatctacttagcatatgactaattactttagtacaaggagttcctgcctgtctgtccaatattaatcttaatatgtcccaatgtcacattggcttctttttcttctcagtggcagcatttggagcttttacttaactttgggtcaattttggcctctgaattttccacccctcccccacagctgttgctgagtcatgttgttttcttttatctctacaaatattgtgacttgtaattgtcacttataaattcattctggctatactgaatcattccccaattatccaagtcatccaaatatttgatgtgcatttccacaaatcatgtagtggcccccactacaagtgattggggataacttgtagaattaattatatgctttatatctccattcaggtcaccaatacattgaagagagcagggcccagaacagcttatatggatcaacgactgacagagctgctggggttggtgcgaagccactgacttttgctattccccgtaacaaagtatgttcaaatgtaggtcacaggtttgtggtagggtcgattcacagtatgcatgtgcaatggtgttcagtagcatagcagttgaggttgtgaagacatgcgcacccaggtcaaagaagaaagatccttagacaaagccactcaagtcccaggcacccaatcttacttggactttgtgagcctgagatttgggaggctcctgggaatgtctgtctctaagactctgctggcaggcttaatcaggctggtggccatctccatatgtgcccccagcatttgtgacaaaataaaggaagggggaccaaataaaaccacttctgaaagcttacaatcccatcccttatttaaactatgtgatgttgtcattctatataaactctttccgagtaacttaactaaaacacactttgccattagtcttgagtgtgggcacagcattattcttttctaggccttaagggttccttctgcttaaaaataatgtctaactttaatgaagtttacccattattaaagtgccttctggatatatgttatcttgttctattggtttcaatacacctattttctttaaaaagaaaaaattatggaccatgaatgttaacaccagaaaaaccttaaggtacatctgatctaatttcccactttaaagtgagaaaatcaaacattgcctagggatctcatttttccccaggctaatttgggttttcatatttccatctcaaagtggactttctttggctaactttaaggtttttttttttttacatatatacaacttttattttttatttctttttttattttttatttttttattttattattattatactttaagttttagggtacatgtgcataatgtgcagcacagcatggcacatgtatacatatgtaactttaagttttaaatgtaaatgcctgaaaagtaactcaggatctagccttttcattagttttgatcatgtatgaaagcaagtatttctttcccccaaatgaaaccccagggcttccagtatttgtagtgatagtgtgaatccattaggtctatttttaattatatctgtcttattggtttttttttccacatttcctaactcacttgtgatattgcttcatataattcaactttttgtgtgctgggttcccatctgccccacaaaggcctctgtgcaaatctgatatcctgtttgaatgacattgttttgcttttaccctattgcttcgtatctgtcccaatgttaagtcagttctcaacattaaggcattaaaaattagcttttctcaaatgctcagcatcactaatcattagggaaatgcaaattacaaccataatgaatatcatctcacacctgttggagtggcatttatcaaaaaggtgaatgatatgttagagataatgcagaggaaacggaacacagacattgtgaataggtatgtaaattagtacagctggtgtggaaaacagtatggagtttcctcaaaaacctaaaaatagaatctaccctatgatccagtaatcccatttctgggtatatatccaagggaactgaaatgaatatgttaaaggtatatctgcactctcatgttcattacagcattattcataatttatgttaagatgtagagccaacctaggtccatcagtagataaatgggtaaagaaaatgtggcagataatacacaatggaatactatttaaccttaaaatgttgggggagagctcctgtcatttgtgacaacatgaatgaatctgaaggtcattatgcttagtgaaataagccaggcacacataccacataggctcacctatatgtggaatctaatgaagttgaactcatagaagcaaagagtagaatggtggttactagaggctggtggagtggggagggagagtagggggaattgttgatcaaaagtattgacaaaaagaataggtcttaagatatattgcatagcagggtgactatagccaataaaatgtatatttcaaaataagagtaaattttcaatgtttcaccatcaaaaatggtaggtaggtaagtttatgaatatgtaattagcttggtttaatcattccatattgtttgtgtgtatatatatatatataatcatataccccataaatgtatacaattacgatttgtcaatcaaaaataactatttttttaaaatagcttttttcaagtttatcacactttgtctactaacgtctgttcttcatatttgaatcttgattttttttctttaagaggtaggggtctcattatgttgcccaggctggccctgaactcctgggctcaagagattctcttgcctcagcctcctgagtagctgcaactatagatgcacactacctgggcctgaatctttattcttgattaactttttctccattacaaaacttcacataaaaaatgcaatggttgattactctagtttctttcacagcaatttcataggtatttattatagatcttacatctgcttgagaatagaattttgtgggagataatctagggaaaattactatcatggccagacttgaggcttcctgaggtggctgagtccaaaacataaggagcaagcaacttgtattggccaaaaggtgattctcaccttggaagaaagacaaggtgggatgtgtctgttaggaaaagcatatgaatgcttggagtaggaagggaacttggtgtcaggcaaaaatttaccttccaaggacataacaaggagaagctcaaaatctacctttaagggaccattttcctggaaacaagcaaacaaattttgagaatctggacacaaaacagttatggcaaagtaagctttatttaattggtagcaggagagtcacaacttcaaactccagaaaagatgaagtaaatttgcaatgatttcatacaccaagattcctcctacccaaagctgaagatatattttcaaggaaaggtgatggaaagaaaaatggtgctcgcccaagagattcttccatccagcaggcatatactttgtctatcatgagtcaagccctgatccaaaggcttgttaacttataattacactaagcatctctcctatgccaagtaatgtggcaagtattgtgagggaaatacaaatgccctaatgtaaaaagttcattccagtgtaggctgaccttctcaaaatggggtctggtcagattctccatgctaggctacaggaaagaaggctgaagaagcaaatttacaaatcagtttgcctacaattgagaattagagcaaatgacttgcaataccaggagtacttcagaccatatcaatcagaaactttcttcatatctgtgtctcctgttcatttattctgaagttaatcctgtcccacagtcattataaccatcagtgaccagccaacctcccaatctagctgtcttagagtagacatttgttcatcctgcaggtccctctctctcacccaagatcctcaatgaaatcagagagtgaggacagagggatctgtctggagggacagagatgtatataattaaagtcacaaccatcggtaaggaggactcaggagaagctgttcaagcaaaaggaaaagtggagctcatgcaagcactcaagggagaagggaaggtcgggtacagctatagcaacaagaaggtgatcctattataagaaggtgatcctactactacaaagaaactgttgagaatatgacgtatcccagacaactactcatgtccccaagtgccaaatcccaaaagatttgaggatgcttatttgggctcttcttattggttgattcgatgtctcttctttgtcttatgcagaagacatacaggcagacccagaaagcctcatttcttgtttaattttcctaatagccccaagaaagctattactggaaagtccagctgcttgtgcaggatatctaccaatgattcactttctccttaagaatcataggcacagtccatttaggagatgagattgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagcctcaagttctgaggtttgacaggggattgctgttgaagtaccatctgctgatcactgagtcaccatgacctcagtggtttgtcaggttgcataaggttctctttgtataatgagatttcactgagaaagattcttgctttggaagcattccaatcttcttggagtttcttcccaagcaggtcctccgccctgccacctccccgagcagcccttcgatgactccctgtcttctgtggtgcgtttcagttacaaaaagcccaaggggaatgtgtccatcgtcttgcaagtaaaaatgcttctgaagctatagctacagagaataaataggggcaaaggtgggtaggagggggaaggaagcagaagaaagagatacaatacaaaccaaagggtggattggagagaaaaatggagtgaagatatgggttggaaaggcagctgggaagttcaaggagaacaggaagatgactgagaagtagtttatgtaaaaagatatcttctcactaagtccgcaagggctgcaggagactatcagacctcagaagggctgtgtgctgtccaccctggaagtcccagaccctgacactgacttacttgctggtgactatggtgtgcagcctcctcctcaatactgtcagtgaactcagtgcttgtatcttcggtgtcatcccctgcagctgcacctggaaacaagtccagaaaagaaaagtgattcccttcacagatggcttccagacagcaggttaaattatactctttttgcccgctgactctgatttcttcctttctccatatacatggggcagaaattctccctagccagcagggctggaaagaaaaatagaactttttgtatcacagacactttcttactcatactccagcctgagcctcacaacataagctgactttgcctgcacagacccatttctaaggagccgactgtcggatgcactggttaccccactcgaatgtcaagaaagcctgaattattccccactgcctggctacataaaaactttctcttccataatatgagtccaacatgcttaaccctttccccaccactgagtgcctggagattagagctgccctgaatctctcagaggtatctattgttgggatcagttgtgcatagggtgacaatctctctgaggaacttccctctgggggtcctgtgtcctagtaaggttcaggtctagtcaagattcaagacaccaaaggattcagttgttccctaatttcttcctctaacctcccttcctcctcacctctctcaaactcttattctatgcagacaccctttgcctgaagggtttcttgcactgctttatccccgtgggatttaacccatcctttcattctccagagatggacacagccactctagggcccaaacatctacaccttgctctaaggtacaagtagctgcagtttgtggtatgggcaaaggtctaaggcagcactgaccaagaggactttctgcaatgacagcaatgttctgtgccagtgttgcccagtacagtggacacagtcatatatggctattgagctttgaaatgtgggtagtatggctcacatttcaaagcattgaatcttaaattttatttaaatttacttatatttaaatgactgcatgtggctagtggctaccctattggacagcacaaatctagggtgtgtcttcctccttatattgattaaaattaagactgttcatacattttaagaccaagagctatgttttatatactgtatttttcaggaagtgtagaaatttattatggttaatttgtcaaagaaaatttactgtgacactcactgtgtcttatagaacctccccaacttaagaatcttgaaatcttgttctgatcctagcctcggcaaccaaccagttacaactccacttctgaccactgattaacctggacctctaagagattacgtggtgagtccaaggttacacaactagccctcactagagctgcgccagtaagtcaagactctggactcttagacagaagccactcacttttccttctggtgacaaatctgatctttatctttgcttcttcctccaagaccaaagaaccttctgttgagttcagacatccaggcatgaaaggctctgcttgaatcatgagcattcactacccaatacagataaggggcttaccttatctccgtaaggaattcgacggagacaaataaatgctcatctcatctcgacactgccacacaggggttttgtttcttccccttcattctctcttttttaagctagctcacagtcttcttccattatggcagctttaagggttgctcagccttttaccaatttgaattaaaatgctgaaactttttctcccatgtttgagggggcagttcacatctatatatttgcaatggcccaggctgatctcatggaagtgctaagaggtagtaagtatgctgtgataacagcttaggtttcctcatctacaccatgaactttatgttaactttggatcaaggaagggtcctgttcagtgaagcctctaccacctctaccacttagcatctttagaggtctgtggcagacagtgtacaagagttatttccaatacttactcattcaaaccaaccccagaaaccatctcactcaggatactagctgagtagaggtgtatggacacattccctaatctttggctgctttaaaaacttactgaaaaccaggatactaatttacctaggacacccacatcatgttatgcttactttggaaaatctttccctgtacaacagtagcgatcacaatcttttatgtttttccagcaaaggaaatgaattgtctcactcagtgacagaaaacagactgttcacattgtttctcttttgaacatggggctagagaaggatcctgtagttgaagaaagcacagctctatgaggtcaggatcctcatcccctaccattgttgctgggttgtggagtcaggctgggcccacatcccaggaccattcctgccaggttccagaagcgagaattggaaagggtgactatcactggtcttgaaggtttttatctgacactttctgccctccacttatctttggcagcctttctggtgccacgtctgcattcttggataatgctccatcttatttcacttaagagcaggatgctatggttctggcttcataaggaattcgacggagacaaataaatgctcatctcatctcgacactctgccacacaggggttttgtttcttccccttcattctctcttttttaagctagctcacagtcttcttccattatggcagctttaagggttgctcagccttttaccaatttgaattaaaatgctgaaactttttctcccatgtttgaggggtaaagctaaaaaatttatagaaaatatgggaataaaagagtaagttatctcatacaaggtccatacaagacattagacatcttttaccattttccatttttttaaataaatgagagaacttctcttgtgtgatacccttttctaaacttttactgcacaacgaaacactgtcttcagaactaacttggaatattttgaatttctaatttaaggtacctatgattttatattgatgactcgtctgcttattttttgataaaatataaaatagcctgccgcctttagattctctgggagctaagaatctgttcatttaacttgcttcttcgagattaagttttacatgttagactggcaattttataaaaaacttttatttgaggcttcaataaaagttctcaacttgtggttcttggaagtttctaggctctgaacaatacaaaatggaggtgataccaagatgtcccttatttagaaaagtattttctatcagctatctaattctacaaagtacacaaaaataaacctctaaaacataagaccataaaatccttgggtgaaaatgtaagcgttatgcaaatataaggtattcttatcactgaagcaaaaattcatacttttgtagaactttttaaattgagtatggcataataattaagaacaagaactatggagatagactgtcttgatttgaattgtgcttttattgttagttatgtcacttcaggcaagtcataacctttccataactaagtttcttcatttaataattagggttaagagtgttacccactccatactgttgtgaactttaaagggtttgctgattttgaagtgcttagaacagtgcttggtacacagtgtgtactcaataaataccatccttaaacaatattattattgttattgtaagtaaactgaagtagtccatgggcttataagttgaagactgagaaagttgaaggccacagaacctaaatagcatcagcagaaggaagttttatacttgatgttactatctgaatgatcttgattgattctacctgcacttcttcatttctgaatacttgtttccccagcaggaggcttgaaatgacactctttgctctctgcctcacaggacattgaaaaggtaaggagtgacaactctttggctgaactctttggaataggtgccttacaaaaaggactaatcatcattaaatgataactgtcttaaaactccaacatgcacaaataagccttagggggaacttcatgacctctttttttgttttattttgctttacagatgaggtctcattatgttgcccaggttggtcttgaactgctgggctcaagggatcttcccacctcagcctccaagtaactgtgactacaggtgcatgccaccacacctggctcatgacatgttctttagtaatgagtccaaactgggtggagtcaagaccatttccccccaattctactctgtagtcattatcttcctttaagccactaatatgggataaacagaaaaggagtgatgtttttccatatagttacttagaacatagcaagagatcatattttattaattttaaaaggtgatctgaagaactaaaactttaagcatgaataagttggcagtgccaagtgttctttccttcggtaccgggcccttgtgtctaatactctcagcccaatttcactctgactcccaggtacactgccatgcgttcattacaagaacgctcacattttcacgtcatgaaccaactattgctgactttaatgttatggtgctgtaatgttatggagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagttacttgaaaaggccaaatcataatctaaaatacttttgggggtatgaaatcccattaaaattctggaaagagtttctacttctccaaaagggtaattattcaatacaactacagtcttctatccttaggctaaccaaggcacatgtaaattaggactcccaggcagaccaggagatatgaccactgcacctattttgtgatgccataattctgtaatgtcaagaaattcttcctgctcatggtctcttttattcttcaaagaaaacgagaaataggtttttctaggaatgtttagagacagcactacccaccacagttggctcctgaaacctctgtcgtgctttctgctattctcctacagcaaagaaagcaaggagggtttttaaggtaaagtagcctatgtgacatttccggggaaagtataacactgtttctttagtctcacttcttcgagaggagaaaaattcgagtttcttcttccttcctttagttaaagactcattctacgagccttgctttgacttggaatttagtaaataatcaatagactgattctcccataaggaaaaaaaagatacaagctttctctactttttttataaatatcttaagaataaaaccaaatagtttctgttggcctttgataattttattggatcagtaacaactttttgtgtttcaactaagatagctaaaattctaacacttatatgtaaaaattacactccattttagcacaaatgttaacagaaattaacagcacagtgccatgaagaaatgaaaaatacacagctttggtagggaaatggtcctggaaataatgtaatgccaagtttctgatcatttaacatatcactcacctccttcttcatctgatgttatgaaccactttatttatttatttaagacagagtttcactcttgttgcccaggctggagtgcaatggcatgatctcggctcactgcaacctccacctcccaggttcaagcgtgaagttatgaatcactttaattcttcttaacaacccacaaaagtttaagtgaaaactagtaagacttcatggacacagatagaaactcataatttataaaacatgctggtataaatgcatgcctacaaaggttatagattgagaaagaggtcaatatcttggagctatgactttgattattgtaaaaagaagcactacatattcatgttatatactaaaagtaaacctacaaggaagccaatatggtttatgtacttaaaacccctattctccatattattttaaatacaacattttctgatgttgctgaactttctattttacccttccagttttagtaagaggaaaacagtatgataaagatttttacttctggaatttgactttaaacaaaaaaaagggagagtaacacaaaaataatcagtatatcactttataagtttaattattcttatttgaaaacgggtagaattagtattgtcaggaccacagttttgtgttcccttccatttcccattctttgttggagacaaattacaaagctattttttatttagaaaattgatcttggcccaggtgagaacagggagaagttgaagacttaccttctgttaatacttagattacttaaaagcaacaggcttgttatttgatcataataaaatgttttaacaaagctactggtgcaaagggtgagaaggtggcttaaatccacattctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactcagagaaaatactctgtgctggtatctcacaggatatacctggaaaagaaaactaatttcatttgttctatctctagtacaatttctacaaggtaaaatggaaaactcacttcaagtgtgtgggttactaatatttcttcctaacttcacaggaagtttgtcacctttccttgcaggatactgactgtaaacctgcagaatactacatgataccctacttgaaaaggccacttgagcttttcagggatgccaaatgtcaagattttgtgactgttttctataaaaagaccatgaaacgagaaaacaagtttatcctatcaatgggaactagagttttctaatactacctcaagaaaagcaaaggtattattgttctctctaaggcttacagtccaaaggaaagtgactttaggtagctcagtcaacctttatttctcaatgaaaaggacaattttcagtataatgtgatctgctactcctttccacaatcagaagactccagattcaactggaagatcaacatagagagaactgaaatcagtcttcttgaacagtttttgaagctatgaaccaaacatctcatgacccagacactgaattaggaggatgaatgagcataaaagtgataggtttttttatgtacatcggccacagagtttacttatgcataaactgtgtaaatagaatatactaaagaaccctcaaggaaactaattcttatgatgaggaactcatatcctctacaggttaagattttctggatccttaatagatctcttgctatatataatgtaatagaaacatcttttaaaaatataaataaggaaaaatgtatttcctctaagaagcaaaggtcctgaaaaaattactgctgtccacaactgaatgaagagaagagggtgtggagaaggttgggtgacagataagagtacacactatcaaaggaaaaggctgacctactaacttagtccaataatgtcttttcaaaaaagttataacttggctatctaaaaagagaacatcagatgaatgttgatttatactaggtactaataatcatcaaattttcaatactataaactttcaatagaaaagagtttagggacaatatctatctaaggacatttatttcactcattaaataagtcctcttggaggttcttttcaactctatacttctaaaacctacagacttcatctaccctgaactcttagaaccattactctgcattatttgctattattcaaaagggaagcatgagaaaaacaaaatctatcatatggatttttttctcaatttaagttctatgcttccaattaagcatggcctaagtaaaaatttacttcattatttttatttgaagactatttttactcaagcacaggttctataagcacacgatgctttatttaaaattactgtcattgaaaaatgactgtcaaaggtaaaataatccagtatgagaaagagtctgtgctcctgtagagaaaatggaatattatatcatgctaaatattattaaatgatgtgtccaaccacagcatgatctctgtgtggattataaaatttatcagactcatgctctctaatcagatgccaaattatcacacaaagttgttagaccagcaagctctctccagataacactgtttgcaagcctcattccagctatctagacccgaaaaagttagtaccatattctagtcacatttatgacattaagatcagacttttaatttatcctgctatcaatttactcttgctggaggttgacagaagtaggagtgattattaacataaactgtaatcactatgagccattagaaatgaagaatcacccagagctgaatcttactagcgattcagaaggcttccttggttggtctattagtaaaattaaggaaagatgttccctaaatgccttgttgtaatgacacgacaaactagtctttgatgggttgacatttctacggctccattaccttcctctttacttatggaaagttacaaaaaattttgtgcaagaaagggtctcttaaaattgggagactaagaaaagtggatggatcggcctacacttcctatctccttccttaaatgactcctttttcctcaaaagccattgaaactgaaatggcagatccattaagagtaaggcttatggctattaatcttttgcaaatgacttaatcagaagattccagagtgcttccccagtagagcattttctccctgtccactctagtttgactgatgctctatctgttatagacacagctaaagttacagaaacagatgaaatttagaatgtaatacaagccatgtcaacatgtgaaagaaataaagtgtcatgtaaaaaaaaaatggaaggaaaaaaaatcattgtgccccacttagtttagaaagggtattcagtcacatttactgtgctagaaagcctcaatccctgttcccaaattccatatttaaagtaactgaaacctcagcttctaacctaggaaacttccaaccagaggaaatgaaaacaaattcatgatgttgatctcacaaagctgcaaagcaatcttggttacttttcacacttgacattcaagacatcagaaatacaatctccagtgcccctctccttatacctgtcacgctgccacaagaaagcactgaggcaatgattaaaactataaacatacatctgtaacatttctttctaaactattctagcacttcaaagcctgaagcctattactgttatatggagaaatgtatacatactaaatagtgaaaaacataggaccctatctagtgccacaaatgaaagaagcaataccctcttctggctataatgagttatttggtgaaacactgaatgtaaagagggatactacatttgaaattatctttgtaaacagagaattctgactctggaagaccattctagaagtcatgttctgactaaatagcatgagcttggtttaaagaaacctaaaggaatcaataaagaacaaattttaagtagaatttaatctgtacctaatctaatttcacttgtgtacaacagtcaactctgagacagtattggagataaaagttgactatgatcactttcatagttcttgcctctgttctttaacttggccttcccaatacttgcagtctactattacaagactactctcctggttttgattaccttctgataaggattatatcacttttgcaaagtcattcttatagactctcaatctctttcccgctctctcatcttaaaacttgcatgcttttgatttaaaaaatgctctcactcaaagaggagttgactgaatggcaaaaataatacacacacatgcatttatgatatgatatggaacatatgaaatggattgtgaaagttggggaagaataaactttattggcccacagaagggatgagggaacgagaaggggctagggataagaatgaataaaagtggaaaaactaaaacagaatgatttaaaatgtgcaaatacactttgcaacctccaccattcaatttagggattgatatgtatgtacagtgagatccatgtaggctaaagtgagtttcactttgtagttgatgctacttgtaccagttctatcattagtaagtcaccgtttaattctgccaaaatcagacaaggatctttctggttagtgcaaacaaggttttccatcctgggctgcagtctgacccgccagtgctcagtaggcatgcttgtgatgaattcgcacactttccagttccccacctccaatggcggccagggtctccagcctgtttaagcgctccaagcttcttccaagaacttcttctagccgactgcgtaacacctgagccccttccagttccacctgcagagttcggtctctctcagagctgattaaacatgccacatggaaggaaagtggattagccatcaactgtagtgagtccacatttgtttccaaagaaccatcaataccactttgagccacacgactttgtaaagtaattgttctccaggacacaataaatgaatgtagtctttgtgtggcatttgtgttcactgctgatagattagtaaggactgttgctttttttaaaagcttgccccttatgctagattctgggccaatttcacataaaattatagctcctaagacttatctcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttaccaaacttgacggtgggatggtgtgctgaaaaggaatctggttcataaaaactaaagctccagaggttctttaaaaagtaacacaatcaactggtcctatcatacctttcctctgccttcattttcctggtagaaagaaaacatttttaaagcccaacaataaattacaagaaactgaatagcaaaaataataataataataaaaattgaaaaagaataaaaggggctagtagggaaggcaaaatgagaaaacaaaaatgaagagaatataaaatgatccagagaggtatcatatatgtgaccaaaaatcaagaggtagaagaaaaatatattcatcatgatagctattggtggtcccaggatgatattagccatcccaattaatatattttctttgatgatattaaatgaatatcagtgcccattatagccttactctttttctttttttttgagacggagtctcgctctgttgcccaggatggagtgcagtggtgtgaacccagctcactgcaacctctgcctcccaggttcaagtgtgtctcctgcctcagcttcccgagtagctgggactacaggcgcgcgctacctcacccagctaatttttgtatttttagtagagacagggcatagccttacgtttataatagaacagcctttaacaggacatggatcacagaaaagaaatgaacatacattgagtgcttactacatgcaaggcattgttttagacacaaaagctgtcttcttatttaatctctgcaatagctgtgtgaaacaggcactaatcccaacttaagattttgacactgaggctcagagcaatccataaaacaaatgacaaagtgggtagccccggtaattgtccctcttttttctcccctcttcagtatcataagcatctgcacttaatgaagaataaaaggcataaatacaatagtaaaagaaataaaaatttcaataaagaataaaagaaaaaacagcctctctcttacctctctggatgggcatggaacttcaccagactgctatagagctgtctctctgcttgtaaggcctcattgagccgactccgttcatctactagtccttctagcatcagcagcaactgagtaaagaagagagaggaagcaatacgcaaatggcacagtgagacatgaataagaaacaagaaaatgcattagcatgtactatgacttaaaaagcccactatcttagtacttaagcttttgatactattttatagttttcaaatcaatgtcatattatcttttttttatctttaaaacctgtaaggtggaattcaaacatgggagcaaaaagaagaaaaagcagagagaagctggaagcacaggaaagcagctaagaaaaaggagtaagagggaaacaggatggacaagagggaaatgtatataataggacttactagtattcttcattcattcaattaatatttactgagcacgttctacgggacagactctgttctaggttctaggggaaagcttactatctagtggaggaaaaagacattcattaatcatagatgtgtgtcattgtgagtgtaataagtgctataaagataatgagctatgacaatgtataatcaacagagttgtttaaggtacagttaaaagccagaatgcagtggggtgagtagttagtgagacagatgataatggagacagggagtacaggcaagtaagtcttttggaaaagtctggcattgaagaaaggttaaatggggctgtagctacagagaaatttggggcaaatgtaggggtttctttctcttttttttttttttttaactgggagagatctgaacatggttaaatgcagataaaagagaaagattcagttgagggaggtgacttaggtatgagtgtgagggataactattggtatgtgtccaaaagaactgctgctcttttcagaactacaaatgtcagaaaggggcatctatagctgctaccgaccaaagtaggaaattttagagcacagtttctctaggaaataccatcaactaaccctccacaaatagctgagattgacagctttaccatggtttatttcacagtagaaaaataaggtttgagccgggcgtggtggtgtgcacctgcagctccagctactcaggaggctgaggcaggaagattccttgagccccagagtttgaggctgcagtgagctgtgatcataccactgcactcctgcctgggtgacacagtgagaccttgtctcaatgtggtgactcatgcttgtatgtaattccagcactttgaggggccgaggaggatggatcacttgcagtcaggagttcaagactagcctgaccaacatggtgaaactccatctctactaaaaaaaaaaaaaagaatacaaaaaaatgtaaataaataaataaggtttatattccagtaacttacctgttgtcttcggtttcctgaaatttcttgaccctgggattctactgaagcaactttttcccgaagaagtaagacttcctgggtcaggcgttccatagctggtatgtcttcaggatcaaccagttgcatttgcaggtcctagaagtcaaaaaataagtatggatgtgaaaatagtaataaaaggattattcagcagagtagcacgggaacaaatgtcttgaaatattctgcctatactttcaagtgggatatggataatcactggccaagggattcgatgtgtgcaaatattgtctgaagaggccctacaggtattctgagctgtgaacatttccagtggtctttaaaaagttttgaaagacctttatgagatcttctttaatctgtatgttcctggtcagagactccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcctattactatcagccagtaatggaaaagaaaatgagaacatgaatagggctctacagcatcaaaccaataatccatgcagtatagtaacaaaggaagttttatgggaagatgtcatagttgttcttaatgatgtcttctactttagctggcactataaaacacatcaaatttgtttaacaagcttattatgatactgaaaaagaatggttaccattagcagaagcaagaagagatgaagtttttatgtaagtaaaacttcacctaacagatgaaaaaatgatagcattaggatatctccattttgcaacccttaatgaattaagggataaggcatcaaacagcaacagctgctaacatcacgagagatcaccaaacattacatgactcctgatggaagaacacgccaccacctgtgaagaaatactgccaaaagttggcactacatgccctaaactttcagtgttctcatcagaaaatgacaagtacttggttatgacaaacttcattaaaaatcataataggccaggcgtggtagctcacacctgtaatcccagcactttgggaggctgaggtgggcggatcatgaggtcaggagttcgagaccagcctgaccaacatggtgaaacccatctctactaaaaatacaaaaactagccgagcgtggtggtgtgtgtctgtaatcctagctactcaggaggctgaggcaagagaatcgcttgaacccaggaggcagaggttgcaatgagccaagatcgtgccactgcactccagcctggcaacagagcgagactccatctcaaaaaaaaaatcatgataacaaccatagctgctaacacttactatgccctgggctctctaataaatgctttgtatagatttaatccttttaacaaacctagtgatctggctcctgcctacttttcctactttaatatctgccattttactgctcactcatgactctgtaggcacattagactttttctgttccaggaacaccagactttctcttgactcggcctttacaactactccctttgcctgaaatatctttctcagggctgcctccttttcatccttaggtcccagcttacgtgtcatctgctcagagaagccttctttggccaccctatttaagatggtctccatccatgttgctttctatcatttccctcatatcacttactatactctataactataatgtttatttatttattgtctgtatctccccaatagaaattaactacacagagccacagaccttactgatttcattcactacctacctcatccccagcactagcccaagcttagagaaggtccccatatagctaatgaatgaatgagtgaatcctcacaacaatcctatgagataactactcttttatttatacataaggtgacttcttctactcttcaacttacagacaaggtgatttgagtctgagagaaattaagaaacttgttcaaaaatcacagggctggctagtaagtggtaaatccagaacgtgaactcagggaagctgactcagagccactaggctataatatctttcctgtagataccacatatccatacaatctttatggtaagacaagttattttaaataaaacctttaaaggaatttagcaatagctaaatatcacccaaaatacccattcataggcattacaatttcatgatcctgaaaacaggacagaaccaaaaagtaacattactctggatttgataaatgtgagaaaaacaggaagaggatgtggaaactaaaatatctgacatgaataatcagataacggctaaggtagaaccacaaaaaggaagggggactaggggatttttaaaactggtatttcttaaatgccacacattctcatatcctgaaaactaattgagtcataaaacatgagtctgtttgtaagcagaaatatgacaatgaaatcaaaagataaaatatgataattctgtcacaaatacaaacacaggttttatattatagatctagctatggcaaaaggtagaaaaaaactaagagctatttggactagctagctaaactgaatttaggaagccatgacattgagtgatcttctaaaagagatgccagcatagtaacaaacaagcttttagtttcagtctgtaactctgagctgtggtcctagtatttcttcaacatcatagttgaatatgcaactagctgtggaggaaaggcagggggaagggaatctctaaggctgaaaggcctcttccaaaaaaaattgaagagaactctatgctagagcgagttaaagcataaggtgggaaaaatgtgctctaggaaatgaatcttcttaggaagtatgtgaagtcacaaaaggcttgagtttgaatcatagctctggcatttattagttacatgactattctccactcccattttaaaagagaaatcagtgtttcagcttcttcgtctataataattgggccgacaccacttactttgtgtagagttgtgagcattagtgctaatttaaatacctagcacagtacattgcacatgaatacttgataaacactgattatactcaaatttctcgtttcatgtttctaaatctaatttcacggatctaatgtcataactctaagcagcaatcacacagcgcttccttttttcaccagtgctttacaattattattattattattattatcttggaggcggagttttgctcttgttgcccaggctggagtgtgatggcacgatctcagctcactgcaacctctgcctcccgggttcaagtgattctcctgcctgaggctcccgagtagctgggattacaggcgcccgccactacacctggctaatttttgtatttttagtaaagacagggtttcgtcatattggccaggctggtctcgaactcctgttcgagcggatcaagtgatccgcccacctcggcctcccaaagtgctgtgattacaggcatgagccactgcacccggcctttacaattattttattccagttagcaatggggagagagggttacgtttttccagcatttaataagttttaatggtcccaatctaaaaacaggagcatctttttgagataatgtatatataaaataacttatatttttctccaaaaagaaaaaagtcatacctggcatttggactcagatattatacatggagaattatatgcttttaaatataaactattttgaaagaaaaaaataatagggattttggaattaagacttaactaaaaaactcacctgactttctctttcttttttagccatgagttcaagttcctctttggcattactcagttctttttccagccctgcaactgtgtccaagtctcctaaaatgaaaatatagcactagttttaattgctattaacataatgtggtatctgctgcctcctttgagtaatttacagaggacacattccaataataagaaaaaagaaaacatacacacaagttgttctttatagcattatttataatagcaaaatactgcaatcatcctagatgctataaagaaaagattgaataaactatagtatattcacagatggcactatatactgatgtaaaaaaagaataaggatgatctttatgaatttatatggagtgattttgagattttaagaatatgttaagtaaaaacaagctatgtgcttaagaatacatctaaagtagtaggttttctattaggaaaaaggggaaataagaatgtacatatatacattacatatacgcagatgattcatttgcttatttttgcaaaaagatatacaggaagaataacccagaaatgaaactgattacctgcaggagatgagtggaaacaggagagaaggaacaggaaaatattggacatctgagtatatcattttatatactagagttttgaactgtgtaaatgtttaatttttaatgtgtaagtcagtttgacaatgaatgagagagaaaaggtctaaaattgaatactaatataaataaataaatctatatagcaaatagataacaaaaccatccagaagataataaaaaaattaatccaaataatttttgaactcactactactctaactgaacactgtcagtgcaaaatatcctaaggataaaaagaattacaaaaaaatcttaaacattacttaatacatttattgttgatggtgatatttatgtaacaattccaaaaatacttttgcatattatagtattctgcaactgtgtaaatattttgaaatatattgatgctataagtaaccagggctctcaaggagatacaaatatgaaatgagggaaaaaagaacctatattgttaaattggaattaaggaaatcagtatcaaatcttcacatatatacaaatacacacatacatacttaaaaatattcattgctagttctgttctcttaaaagggcctagaagcggctgggcgcagtggctcacatctgtaatctcagtactttgggaggccgaggagggcggatcacgaggtcaggagattgagaccatcctggctaacacggtgaaaccccgtctctactaaaaatacaaaaaaattagctgggtgtggtggctggcgcctgtagtcccagctactcgagaggtgagcagagagatcgtgccactgcactcccacctgggtgacagagcgagactccgtctcaaaaaaaaaaaaggtcctagaagcaaaaggcattcatgtagcaatgaacacatcttgtgtccagatcatagtttctgaatgccattacccaccaaaaggaaccagggagctctttaggataatggctgattctgggactgaggcaggtaaagcaaaaggtaatcatagaacatcttattgtgccagaaactatcaaactatgctaacattatatatatatataacattagtaggtgatgtcaagttacagtgagtggccccagacttgaaacgatacccaggaaaaggtgtcagctcatggccctgctgtgcaggattggaacaattacctcctgcatttctgaatccctgcaaagctatctgaaaaggagagtaaggatagaatttctctgggccgaattgtgaacccagagcaatcagctcaactcaacataaggtaaggacagttcttcagcctttcagaggaattccaaacttatttgttctattaaggtaggaagagaaaagagtcttggccaaacctataatacagagattactagaagaaaaaacaagagaaaaacaaagtcccttaatgaaatgaaatttgatacttacctaatgtggatctgggtatgctgacatcctctttggcagtcaatgaagtgctatcatctctggaaggtatctgcattgaaccctaaaaaattgcaaaagtcaggggacttaggaagatgcaggaactatgatcacaatgacagtactgagaatattctcagaatttggtattaaaattatcaaacttacacctcaaatgtaaaaaggaaatggaatcagcatgaattatgtaagtctatagttcttacttgatcagtctgttttccaagacagccagtgggggtaacttcagcttgttggttagagatgggtgcttgggacatcagggagtctctccctcctaaatattggcgcagggcctgtaattctgaatttctttccattaaggcttgcaccaacttctctgcagcagcctagtaagaggaaatcacaaataacattataaagatattctagtaaaacaaattttttgttctggtattatttcttcaaagtcaaccatttgtaaaaaacaaacaacaatgacaacaacaaaaaacagtgggtccttaggaaatagtttccttgctttcagtttacagggaaaaacagagttaagtgaatggaaagaaagtctcataggcagaatattgggaaaaaaaaactgaatttaacacatctgtaacagataagagaatctgaaataggttctgctacaactatcaggctaaggtgttaagattctggtttgaattagtataacaaatgtctttattctcggatagttgcttcttaggggtggattccttttcactcaaacatttgtgtggtttgctcccttcaggtctttgccaaatgtcaccttatcaggttggtctttcctgcgtatcctatccaaaacagcaatcttgctggccaaagtataagatgaatatgttttggggatccaatgatagcatggtgactttagttaataatactgtattatttacttgaaatttgctaagagagtagatcttaagtggtttcaccatacacgcataaaatgtgtagtgacggatgtgttaatttgtggcaatcacttcaaaatgtatatgtatatcaacacatcatgctgtacaccttgagtatatacaatatttgtcaattatactttaataaagctgggaaaaaaatttttttaaaacccagcaatctcttctctatctccaacacttcttactgtgcttaattttttttcgatgcacttaccattatctaatagatctctctctctgcttcccctacatggaatgtaagtttcctaaaggcaatttggtgctgaatctcaagcacccagtacggtgtctggcacataataggcacacactacatatttactgaatgaatcaattacgcacataaacatgtttatcagaccacatgattaggataatctcaacctcaaaatcacccaactcagcttgtttcatttcaaatcccagttttctaagacagatgatgacacactaagggaaagatctagaacatttttaactattaatgcacaggaagtctgcatttaaacagaaaatctggaaataataaattgatattaaaattactgagggtctaagatgatgaatcataacaccaactgtctctgaggaaaagtactattgttttagggcagaagctgagctcttgtcacaatttctaggggaaatatgaaaaaaccttccacttttcagtaagtaaaatttgggctctttggagatttgaatttaactattttagacgtatcagaatattattaaagtaccttaataaaaatatctgtgaaaactgtggggaaaaaacataataaataatatacaagatatatactgtgctctatctgccttggcactccttttctcgtagtatttaagagtttttagcagtgctcctccaatgcagtccccgaacctgcagcatcactatcacctggaaacttgttagaaatgcaaattcttaagtcccacctatacctcgtaatttctttctctggagttgagctccacaatctacatctttaaaaagctattcaggtgatttcttttgcacgtaaatttagagaagcagatctagaagaatacaaccattaatcttcttgagttgaaaaatctcctgtaatttccatcatctccattattctattaccagcagtgcataattttttttctgaggtataataaagaccaattgtcccaaatcacaaagaagttaaaaagaaaactcaaagatcctagcctcttgccaaagatttaaataatttagaataattttgttaggtctattttagaaacaatttctgaagcacacagcaggacctttctagaaagatgtgtatttacttcagtgggcctaacaattagaatagtggagtataatcctttcacaacataagaaaacataagaaaatattatggggtcaaataacataggcaaaaaagagtctatcttcctctaaaaactgactacggggattctgagctactggtatctgaaatgcagcacaagtcaactaagagtttttagccttgaggagaaaacacatagaaatgaggaaaaattaacactttactatgggcagggcatggtggctcacgcctgtaatcccagcactttgggaggctgagatgggtggatcacttgaggccaggaatcgtaagccagcctggccaacatggtgaaaccccatctctactaaaaatacaaaacttagcgggcatggtggtgcatgcctgtaatcccagctacttgggaggctgaagcagaagaattgcttgaacccaggaggcagaggttgcagtgagccaagattgcgccatcgcactccagctgggtgacagagggagatgccatctcaaaaaaaaaaaaaaaaaagaatttacttcttaaatattgtgaaattaatataccctgtactattatgagattgtttattctcaccatgacctctgaaaaatgcgatcttttttccctcttaactcagattttacaaaaactaagagtaaacatgttgagtgtaagttttcccataccttgactggaaatgcaaaatatcactcaagtcttaacaatttagaatcaaaatcgaaacactcacaacccctactcctttctctcaaaattatcagattattaaggaaaagaaaatgtatgtaatgaagttaatggatacatgtattgtttaggcacccttccaaatgcaaggttttcaagaaatgtgtcatactttgatgattaatgtaaaactgtggtctaaggccaggcgcagcagctcacacgtatagtcccagcactttgggaagccaaggcaggatgattgcttgagcccaggagtttgagaccagcctgtgcaacacagcgaaacccccatctctaaataagtaagtaaataaataaaactgtggtttaggtaataaatagaaggaaagaaactaacagagttgacggtaaaatatataaatatacacacatctatagtctgcaaatgcttcctatttgcagactataaatgcactacatgacacttgtctgatctgtgcattaatccttacttggctttcctgctccctggtgctcacagactgaagcaggccttgaatctccatttcatgttccagcacttgtttatttcgatcacttagaaggtcctgcagcatcctttcctttcgctgtagacgctggcacagctcctctgctatctcactctgccctggtccaagtttgcagagcagtgttgcactaagatcctaatgcagaaaggacactgtaagcttctggaggaaagaaatgcctctgctaaatatcaaagggcttataagaatctatcatagaagaaggaggtgtgagattcttgagaataagtatcatgttttactcatttttgttttaccagatctagcacaggcctgctacacagaagtctctaaatacatgtcccaggaatgaatacaaaccatacagaaaactatctctggtggccacttacatacatattgttttctgaaataagtctttttcctatttgttcagggcatgtaacaattaatgttagatgaggataaatggacactcagttcatttatttgttttctccccagtgtaacttaacagggggaagcataaaacgataagctgaaaggaatactaaacactatatttgctatcatagcgatggtttctatttctgtactaactgatggcacatggtggaggaatggagccatactgcctaggttgatactggatctgctacttattagctatgttagcttggacaagttacttagcttcagaagtctgtttcctcctctataaaaaggaataatagaaagtacctcatggacttgtgaggatccaatgagttaatatccattaggatcttaaaacagtacctgacccagcatgaagactataactaataaaggttagctatcatgttaaagatgcaatttttgggtctcattaattctcacataagttctttgagaaagttaattgccaacttaagtttctagacgtggggaaaaaaaaaatcccagtgaaagtcaatgacttgcccaggcacagaatgaaattaaagacttgggtcacagtcctcccaatctgaagagtcctaatccaaggctgagattacataatcactgaaccaactgccttaaagttaactgaagtcttgcctccacttctttgttcctatcatgaagagacgtctgtaactgctgaatgatactctcttgttccttctgccaacggctaaatttggtttccatttcttctttcagccactggaggttttgacaggtagtagataactgttccacttccaggcctttggccctcaggagactctccatactctacagccataaagagagcaataatcagtcaaaatgattaccccatactcctcaggataaacaagaaattagatccacttttaaataatctcccatcaatttttttttatttgcaagatgagaacattgatctaacaatgccatactaatctatttttttggtttttagaaacttttatctagtttgtggagagattaaatatagaatatatgataaaaggaagtattttggaggaagtgcactaagctataaaggatttctcgaaaaagtggcagatagatacataagctctaaaataaatatgcaaaaaagtccacagtaaatatagataaacaagtgttctaattatggcaattcatggacatgtagataatattaatgtagaagacacaatttaataattgcaccctggtaatgcttcagtaaaagtaagagagagagagaagagcgtgtgtgtatgtatacttatgtatgaacaagaattggaaataaatcagaactatgtaaacagaaatcaatatttactggctctcctcacaaagttcatattacaaaagaaaagtagaagcgctaaaatctctcacttgctaattgacaatgatggaactagtaactgctctttttggttttcttcccccttataaagcaaaatccctggttttcagaaaatgatggaagggggtcatgcttcaggctcaggatacaagtgggagaggaacaccaagtcagagataggttttgctcttacttgcatagtagcttcattggaggagaggacatcgcgcagtctctctaagtcatgatctcgctctctcacagcaagacgaagctggcgcagttctttttctttctcttctagagcagagaatttttcatctatagcccgctgcaaggaaaggaagactcctaaagctctgtaagatttactatcctgatcactcttattcaacaagatggcagaatagaaaaccaaatcccaaagcagcaaatttaagcaaacacaaatttctataatacctatgtagatagaataatccatagcatagtgggcgaaatgatgatacatacctccagagcaacagctttatcatgtattcgctggcgaagtttctcaagcaacatttcatttgcttcaagggttttgtctgagttatctcgatactgtaggagctcccgaaattcctgagaccaaaaatagtttcttttattcttttatccaatattaactaaattaccaagtaatttgctagttattcaggataaaaaaaaaacaagatgtgatcactctcctcaaaagtaacaagtttagcagagataacagacatataaactgtaaactattctgcaacatacaacagacacaacacatagaattaactgttctgcaacatacgctagccaccaggggaacacaggatgcactgcctaactctgcctgaaggtgtcagtaaagacctcacagaggaggtaatatttgcagtgagtcttaattaaaggactaggatttcctaagtgaagaagggagaggaggatacgttagagaaaaaaaaatatgcacactatgcatacaatgaaaaaattgtacattcagtgaaatgtagtggattcaatgtgactgaagcttagagtaggtggcagaacagatcagtctcttcttaatgctccatcttcccctcaaacttttattctatcatcaaaattactctgtggaagtttctgtacagtttgtcttcatctattaaactgagatcagtagccaaatcttttgtcttcccaacacccagaaaagtgtttgattcacagaggtgcttaataactattttctgaatattaagtctttataaaagacttcataaaagactgcttaagtcagggctatatgtactgtttcttatacttgttagtaagcatcttaattcacaaattatattttctatttattttaaatcctcctgattcccacctctctcaatgttttccatatggcagggactcagcacaggtggattaatatcttaaaattatataaacaaatttcagagttctatgagcccagttttcattgaaatcatgtaaactcacctgaagcaactgctccttgtgactcagactatggtttaggtgctggatgttttgttcctgggttcgaatctcattgtatttttcagcctcccaggcacgaagctgttggctcttattctgcaattcttcttgtagctgctgcaaggcttttcgcaattcctgaattaaacatattacctttttaaagagatctaaaattgtcacatggttattagatacagaggccttaaaattttcaaggtatataaactgaaagaggagcagagggtgccattattaaaattgctatagaagtattatacatgaattgaataggatatggaaaattgtaaaagttgtgaatggggtaggaagtaagcttgatattatagttcaatacttattttttggcttaaaaagaatacatctatagaaccattaagtgagaatctgtcctacggtaaacctggattatttacaataagctcaaggataaactattcctatcatccttttttctaaagatctcatagagaccatcactcttctttcttagtttgccatatttatttttctaataataaagtcagtaatctttaaatcatctgttactttagaaagctaccaaatacatattctcaactaaacaaatcttggggaaatgtttcctttagctaaataacaaaaagttaagaattatttctacctccatccctccaccactccccgaccctgcccagacatctgaaattttaatatttcttttttttgagatggagtctcactctgttgcccatgctgaagtgcagtggtacaatctcggctcactgcaacctccgccttccgggttcaagcatttctgtgcctcagcctcccaagtagctgggattaaaggctcctgccaccacgctgggctaatttttgtatttttagtagagacggggtttcaccatcttggccaggctggtcttgaactactgaccacatgatccacccacctcggcctcccaaagtgctgggattacaggcgtgagccactgtgcccagccaaaattttaatatttcaaaaggaaattcagggctaatatttgatctccaaaccactaaaccagggagatccttcaaaaattacttttaaacctgagtgttaaagagcttaagaagagaccacacacaaaaaaatcttttaaatcttaaacaaacacatacactctgacctaacaagataaaggaaccatttaagagttgtgtattttggcccagcgtggtggctcacgcctgtaatctcaccactttggaaggccaaggtgggcagatcaccagaggtcgggagtttgagaccaacctgaccaacatggagaaaccctgtctctactaaaaatacaaaattagccaggcgtggtggcgcatgcctgtaatcccagctaccaggaggctgaagcaggagaatcgcttgaacccgggaggtggaggttgcagtgagccgagattgtgtcgttgcactccagcctgggcaacaagagcaaaactctgtctcaaaaaaaaaaaaaatgaaagaaagaaagaaaagaaaagaaagagagagagagaaagaaggaaagaaagaggccgggcgcagtggctcacgcctgtaatctcagcactttgggaggctgaggcgggcggatcacgaggtcaggacatcgagaccatcctggctaacacgatgaaaccctgtctctactaaaaatgcaaaaaaaattagccgggcatggtggcggccagtgcctgtagtcccagctacttgggaggctgaggcaggagaatggcgtgaacccgagaggcggagcttgcagcgagccgagatcgcgccactgcactccagcctgggcgacagagcgagactctgtctcaaaaaaaaaaaaaaaaaaaaaaagaaggaaagaaagagagaggaaagaaagaaaagaaaagaaaagaaaagaatcgtatatttattattcaaaaataaaaaataaaaaacagggctgattattatgcatgtcattcctctgaccttagtggttcttccccacttttctgcctggttttacccatccttcaagaataacctcagatgtctcctccttcatgaagttttccttgattccttttccttgactcctttcctagatattcctgtaggaccccatatatacatccccttcagaatttaccacactgaaactcagcttatgtgactgtctctcttactgaactataagtaacttaaaagaaaggagcctgtgctattcatccttgtatttccagggtacaactcaatacggcagtcgccccttacccacaggggatacattctaagacgcccagtggatgcctgaaaccagatagcactgaagcctgtgtatactgttttttcctgtgcatagataactatgataaaggtttacatacaaattacacatactgacagattaacaataacaataaaatagaagaattataacaacatgctgtaacaaaagttacgtgagggaggccaaggtgggcagatcacgaggtcaggagatcgagaccatcctaacacgatgaaaacctgtctctaccaaaaatacaaaaacaacattagccaggcatggtggcgggcgcctgtagtcccagctactctggaggctgaagtgggagaatggcatgaatacaggaggcggaggttgcagtgagcggagatcgcgccactgcactccaaccttggcgacagagcgagactctgtctcaaaaaagaaaagttacgtgaatgtggtctctcttaaaatatcttaatgttttttgtctgtggttgaccccagataactgaaaccatggaaagtgaaactgtggataaagagggactactgtaactagcatatggtacaagggcagcaagtgttgaactgaaatacttagattatgcaactgactcaagggttcaacacaaactgtcctgctaaaaagttatgatcagggcaaagtcagcatttagggcaataaaatagttaatgatttacctggttatgtttccaagaagcctctttctgctgttcactctcgtgtgctgcagcctctacaaattgcacacattgtttggcatcagccagttggcgctctttctgtcgtaccaccctctggagcttctgtatttcaagttggctgcagaataaagcactctgaagatcaagcagagctacctgttgctgagctggagaagtaccctctgagctctgaaaagagagtagaaatcacaatcacaaggagggcaagcactgagctcccacaaagactaaaaataaaatcaagactgcaaccaaaatggcacatccccaactgaagtctctcctgtcctacgtgaccctcacatacgtgaagttgtccaagctggctttggtgcagcatttctcgaagctttgccattgtgtcattttgaccttcaattacctggtacaactcctcagtctgaaaatgagagagggaatatcaaatatgttagtaaactaattataaattccattatatcacctgtacacattttagtaacaggactattccaaaatatcaattgagattaagctacaacttctccaggctaagacatgctagtctgacaatatccattttgacaaaatataaaatacttgtctactttgaagggaccaattgtttccacacaggtccttgattggtaaatatgttacctcacgttccctgcttttcagagtttccttgaggttctgaattgtaccatcttgcttttgagacgactcctgagcacactttagttcatagctcatttcattaagtttctcttgaagaatctgaattcagcaaagaaaaacagttttttaggtcaatgatgtcttttagcctcaaatgaataaagcctttcctcaaatctaggatttaaagaatttcttaggggatattaccttgttatttttcctacatagagtaaccattaaagtggtaagtcaatcagcaacaaaaagtagcaggagaaatgaaatacttccttcaatactaaattgtctcaattttcacgcactgtgatctctctatgatggcagccatactaggaacttgtccacatggaccaagtaggcaagtggtttctaatatggatcccttatacaaggaccaaagagcttctgctatctagcataggagagggcactataagggcacccaggccacaagttcagcatcccaaattgtagcaattttcttctaagccagacattaaaattcatgggctagaaagtagtaacaagttaagctaaaataaaaaacacagacctcctatctcagtgccttttacagtggaagactgcatgcaagtgtttttttgagacagagtctctctctgttgcccaggcctgagtgcagtggcatggtcctggctcactgcaacatccacctcctgcgttcaagcgattgtcttgcctcagcctcccgagtaggtgggattacaggtgtctgccacaacgcctggctaatttttttttattttttagtagagacagggtttcaccatgttggccaggctggtctcgaactcctgacctcgtgatccgcctgccttggcctcccaaagcactggcattacaggcatgagccactgcgccggcctgcatgcaagttttaattacacacctgaaaagcaccagaaattatgatctgtacagaacaagctaaaatcttcataagaataaagagaagaactacacttttacatgaaatattccctagagcacaaggagtacacagtattcatctcccaagtcctacaaaggttgacagactcaggctagagccagtcacatcctcaggaaaaccttgtcatctcctagggcatagtactaatcataccttgttggtggcctctgtttgctggattttttcctggagttctgccaagtgggaatcagatacagactgctgagttatagtggtctcatgtgaattcagcttttgttgtttcagcaactcttcagtcatgggctaggaagaaacggcaaggaagaaacggcaaaacgagtaaggtgagttaaacatggccaacaaaattttttttttgtcttcaaaaatgtctgttgcatcttttgccagagatttagagaatcagatttgttgcataaattatcagtatgaattcctaaagacaggtctgttccttattaagaacactgattcacctccatttgtactatgctccccagcttccctctccacttttctgtaccaattcacacaaacactacatgtttattcagcgaaagcaagtaattcagagttcaatgagaaggggaggatttaataaaggaaatgcttacaatgaccaaatatttgctttattctatttttaatcaaggagttgaaaaggcatactcatcaaacttacacttcctgagagaagttacattccggctacctttcttacaacatgcttgtttcacattattggaaaaaattggcagattttgatatggactatatattaggtaacagtattttatcaatgtctaattttctaaatttgataattgtactgtaattatataagagatgtccttgtccttaagaaataatgcttaagtatttagggtaaaggagtatactatctacaactaattctcaaatggttcaagaatttttaaaaaatactgtgcaaatacagacagtgggagagtttataaagcaaatgtgacaaaatatttgcaactggtaaatctgggtaaagggtatatgggagttcttggtatttctcttataacatctctgtacgtttgaaattatttcaaaataaaaagagaaaaattaaaataaatttaaaatagatgtgcctaaaggcagatttatagcataagcacagataaataatccatagtgaaatgggaaagagatatattttataggaatatcaattcacttaaaagattcaggagaaaaaagtatgattttatatatgggacaatttatatatggaacaatgatttatatatgggacaataagataaacttattgaactattcttagtaatcattacaagctaaggatgttaaaataaaactacaaatttactgcggcaattaaatttgatcttcccgcctccatacctgcttccattccaattaggaatataaactcattaagagagaaaaggcaactgctattcattttttgtttccctcacactttcagacttgattaccactttcaaggcagtggagttacagcttaccttaaatcccttcctgccagcaactgactggaagcataaaaattgcagaagaaaaatctcttctattcctccagtgctatttatcaacttttctaacacctactaaatgctataataagcaaagcaccatgtgaggcactgtgaggaatacaatgctgacataacatatatctgttgcacactaactatgtgctaggcactgtcttgaagatagagtatcatgcaagacaaagtccctgtgctcttgaaacttatattttgcaggggttggagtggggagtacatgataaacaaacaaggaaatgcaaaaaatattatggacaagccctgtgcggcaaaacaggaaagcataatacagagtgggtggttaaattaccctaaattgtttgatcagagaaaggtctttatgaggcagcatttaaatagatatctgaaggaaaaagaatcagtcctgcaaagatcagcagaacaatccaggcagaaagaacagctaatggaatatgagcctggaaaagagaaaggcctctgtggctagaatagcactctccagtagaaatataatgtgagccatgtatgtaatttttaattttctagtagcttcaatgaacaaagtacaaaataaataggtaaacttaattttaacaaaatattttatttaacccaatatatccaaaatgttatcataaacatgtaaataatataaaaattattaatgagataacattattatctgagataatattacatgatttttcataagtctgaaattcaaggtatattttatactcacagcacatctcaatttggactagccacatttcaagggttcaacagctcctaagactagtggctagcttactggatagcacagggctagagcatagtgggcaaaggggacagggaaactcaatgaggtggagaggcaggcaggcaccaggtcacatccagcttcagacaacaaagttaatgaactggatttcattttaattgaaatgagaatagactgcagttttttaacaggtaatcatacagaagttttgaaaagatcatgctgtggtgaatgaattattggggagcaccaagagaagcagagagaccaggtaggaggctgctgcggtagtgcaggtgaaagacaatagtagcttggatcctggtggttagtaaagggagggggaaataaatggatagatatggatatgttttgaaagtatagctaacaggacttgctggtggactggatagagggagagggaaaaaagcagcaaggataatgacttctggaaaaattatttgagatatttgttgttgtgggtataacaggaagccttcacctgaggcaatatgaactatgtcacaccatgggcaaagtaaccacattaatagatgtttacaatgattctaactaataaataaattcatcatttacttaatgataaaaccatctctataaaatttggcttcttacttcttcagcgtaaaacaacagtaacacctacagtaagatactttgaaattcaaactacaacaggcagaattaaagaaaatagcttcaagtttaaaatggcaaggaaggtggtcatatttatttactttaaaccaaacaatcttacagtggtgaaggaaactttataaactaaccatctgatccaatcctattttacatacaaggaaatggaaacttagagaagtaattagtccaaggtttcatgggaaatcaggaaaaagatccaattaaactgaactggatttccactcaggttgggaatgtatctctcatttctataaacccattgcctaccataatgccgggaatactgcagagatcaaaagtttttgtttaatgaacaaataagaacaataaaaacaaacaaaaacgagcctttagtggctctcttagaaataagactgtatataacatatattcgaacagcaactttaaagccaaagaatgccacaggaaaatacataatgtatttgaatctcatatgaatcaatcttgacatgaataataataagaaacctctttttctataaataatgtactgacctaaaagttggaagatatttgtttcttctttatttgtaataatttactattttgcatctcagaaaaatgtccttgcaggtaacagtctgctgaaagagcacttagcaagtcccactaagccaacaacataatgaattcttgtgaagtatcaagtacataaaacagtcactcctacaatgatagtgtagcccatgaaataagtaatacctgatttggtagaatcagtgttactctctagacactcaggtactaaaatcatgtggaaatgataatataattttaaattaagtcacttttgactcagaattaggacaaaggctttccagtatcagaaaagagaaccgcttccaggcctagtgttgcacaatatgagacttttttttaggctaaggccagtttttagactttttgtgttaacagcagttttcttggcactttctagtcctcacagtagtgagttatagatctcaaactgctataattgtcaaccctattgttaataataggagacagacaagaaccattgactaccataaaattaaaggcctaatcttttaccagcatctaatgccaacatcttccaaagggcctgatccacttcacataactaaaataagagtgggataaatttaccatagtcacaaaggagcagaccttggcattgcaaggtttaaggcaaagatcttctgttctttgaatttagatagaaagggaaattgcacatgggccagagctcattgctgtttactaagggaccacatccctcccatcatagcttttctagttcagggccagacaataaagaagggaattaccagctagaagaaggcttcaaacctttctttagatatctgaacagccttaggtcctcatacataaattctgtagaagggaaataaattactttgtataatatcagaatatcagtaagcagaactacactgttgctatttttctttaataaataagaaaggaacaaagaaaaagacggaaagaaggaaagaaaaaaaagaggaaaagcaatcaggaggaatcctgatgtcaatatttaatagtgcataaaatatggtaagtggaggattaaacaaaggaatcaaaataaccttacagaacaatcttgctctttaagataaaaggttttctccatatttgtggcagaactgaactaaaggaaacatttttttctttcatggtttcgtgtttctacaaactaaaaaagagaactaccaaaaaaaattatattatttctattctttccatatttgttcagagaaatagacaaaaaccagtctgccattgtcccatctagcactggttttgtcataaggctcttaaggagcttaaaagtaaccagatttaaacaatagatacaccgcccattttatttacaaacatgttgggcccaattcatctattttccctgacatcctaaattattagagaaaatggcataataattaaatgccacatttcttgaagctgaatgacattttctcccacctcctaatttttgtttttctagaaacagtaaacaatgtaagtcaagtcacagcagaaaggtcatacactaccatcttaaagctctaatgtccaaatttagtgaagtaaagggacttgacctgaagatacagttaccatagtttatatgtgttcattcagatgacaatttttttcacataatctctaaagaatcctccgagcatccttaggttagagaaagagggctcctggtttaaaataagtacttacttaaattaatatacttcagacaatggggtttaatgtatagaattaaagtgtcttgcctgagaatggtcagaaatctttgtctctgcatgggctacgttagttaaacaaggaactttccatatctccaaattgagagactgcctgaagatgatctttaaaatccttctccactccaaaatccagtcaccaaaatatagtattttatttaaatacggagaaaaaaagatcttgttttggctgttattttctcagtctttatgtaacgttctacaatattggtcatatttggtggcgggctggggggacgagtttatttcccatccatcctggcccaactaattttagaccctaatatgaaaacaccatgtttaatttgtaacacctatgtctagtcacagaaatactgtaaagcccaaatttagctgcgaggctccactgaaagaaaaagcaaaagaaaagaagtacacagtgttaagcatacagtgcttaacattttatacaaaatgaaaatgcactgactttttacctttcatgacactttcatctatgctgtttctcatctatgctgcttctcataattttgtgtaaatttaaaaacttttctcctgttttctgcttaggttcttattgtgatagacagtatacataccatagaactactttccaaaaatttcaagtggccatcaacaatgtcacttatcaagctctaaatttctggaatgacgttgaccagtagcaggctttctaaaaaatgccttctagatcacatctacctttgtgacagtattgttaaataagttgtatcaagtggaacatgccagaatgtttcacaaagtttattgaagctagcatttactgttgctatagaaacaaactaccatagttgaatttaaaaggttggtacagaatcaattgggcagacacgaatagctcaaattaagcaattaagaattcaagactataatgaatgaaactctcctctgatccaataatgggttaatcctttcttaatatcaaatatcttccagtagaactcagtagagttctggctgtgaacagtttatgccttaatcttttgactgacaatactgtacttgaatacttgaattcctgtctcttttatgaatgagtcatcactaatcctcaaatgaactattaattctaattaatatggtccagatgttataatactttactggtggattaataggctttccccaaaccttttaccttatgctctaatcatttacaggcattttgcggatgaaggctttaatgctccaggaagaactaactagagaactaactgccttacagaaaaccattgggaggaaacgtctataaatctgaaaacaagaacaaattttaaaagttggaaaaaaaaaagaggtaagaggaaaagttctagtgccagaaatgagattaaatgtcttctttttataggaaaaaagtgaagtaggaatctttacctttttgttttaaaaggtatacaattttgataatgggaaagtcaacagattttacaaaaaggattgtgaaaatcaaattatctgagtgcaaatcacgtttactaaatgagacagagcaaaaggtgcagcaaaaatggggtcatgactaattttctcaagtccagaatatttctaacctccacctagaccgaaatcacgtgaagccagaggccagctagctataatcagaaaggcactatgtagccgttttgtatacctggacccggagcggcaaataatcttcacagagatcatcccacagctcctgcaggtctgaaagctccaagggataactcacaggtgtcttgtaaaggggtttcaaagacctgttaaggaaaccggaactaactccatctgtcatgctagggccaggcttggctccaggtaggctggatttcactggaatcggaagcctgctccctcgggggctctggatgggcttataatcaagacctttaatcatgctaagagctaattccagcttgtgattacacccatgctgcggagcctgatcatctgaacaacagtcacactttccaagttcctttgcacttctctcagtctcctcatctttctgttgtggagggctagcctggacgcttgcatccaaagattccacagaggaaccaggcgtctcttcctccatgctttctccatctgggggtacctttgtgcttgctaagtcgggtggcccaacctcagacaacgctggttcttcagtgcaaatgctggtcgaccacctgctagaagggccgcaggagatacttctggccacctttcgaggtaccttacaaatggcttcatagtcagaatcagcaacccgcaaagcggcacaaccacggcatctcctgggtcggtttccagggccttctgaaccatggcagctgtgtggctcctggatctgatcctcattctccacccagcactcaaaccctgaataggcgaagtcctcctggagcagtgcagagtatctcgcatcgggtaagacggacatgtcaaccgtcccattccccgccttgatctccgcgccagagtcatcgttattcttccgatacatactggcaatgcagaacttgaggcgatccttctccagtagcagcttttgcaagcgctcaatagaaagcgcttcaatccgggcaataactgtgtcgaatcgatagattcgatcaagcatgaaagcacacttgctgcaagcgaactcggctttgccatcgcgggggacatccttgcccaagacgtgcgaaagcagaacctggagattgagcttggacgccgtgtggaagatccagcgccgctggtttccacacagctctcgggcacagatcctgcaaatctccttcatcttccctcctagcgggtggcaagcttcccgaggcggcggcggcggcggctactgggtgaccactcaatggctcttcgccgcgctctgtctcccgcctcggtggtctccggtcagcatggcacagcccagtggggtccccactctgcaggggcgcgcccctgccccgcgcgccgactccgggtaccagagccgtcagccccgcccctcgggcagggggcgggcgtggaaacgcctaagaggatgctgagtgacagaggcgcaggccgcgctccgaccctgccatgtctctccccagctgtctctcccgccagccgccgcgtcctcaacgtcctccccttttagcagactgggctcccggagcagcagcggccggccgcgcagacgcaaagcctcggggatggaggatcagatttcaagatggcgccagcggcttcgcgtctgcggcctccacaaggctcttctgggagctgtagtccggtcagcgggcttccggctctgcgcatgcgaggtagccagcgcgaccctcgccccaaatccggttgcacacctggctcacggcgagtgcggagcagaaagcactactggcgcgggccacagccagccgctttcatctgctaagacctcacctgaaagtcgcaccagtgccctcaaggatcctcccgcctctgcaggatgtcgaggctcctcctcgcggggaggagaaagacgaatcccctccctgcattctcggacagtgccacgtcctccggctgccagcggggcagcgccgctaggtaccgctgcgcgccgcccccgcttcccgccagcagcctcacctttcccggccccgccccgcctgggttctaagggcctgaggctgcgaggcaggcgagggaaggcttggtaacggaggggcggggccgtgcaacccttacctcgactctgaacaggaatgtccagaaaagagtagaggagtgtttctcccttgatgtgggtgggggagggttagtacccgtgggtgacttgcccttctttagataaaaaagcacagagcagtcacctgagaaagagtccggcacatacaatgtgaatctggttaaccaagatcttgaagatagtagaagagaaatgggcttttttaaggatgcagccagccgcgagtagattaccaccattgaagtccctttccctcaggtagagggcagtcattattttaggacaggggacggtagacaaacactagcgcaaaagacagtgcttctttccgtaagagctggagtgtctgggaatgcagctcgcgccagaaaggactgggaacttcactgacttcggtgaaaaccatgtcttactcagcattgtacagtgataggtcctccacccttgggtccaaaacttagattgcacacaaagaggagggaagctggagccctgactaggtagaatgctggtacctccggccatttttaataaggaattatcttcctggcttgagaggcattcagacacgtaacaagaggaacaacctcagcaatcacttgcagtcccctagagcaggacatttcccagttctaatcatgctaaatttttactaacttgaccttgtaagctaaggccagcaacatctaagtttttctgaacctcatccccaggacagagtccatactcctaagcctgaagacatccaaatgccatctctgagagttcataataagcccccaaacttcttattgaagactaaatgagatgattttgaggaaatgctttaaccgtgtttcgctcattaaataatagctaatattattattttactatgaattggaatattttcagtaactttaaaacattatggggccctgcctacataagattgtattgttctcttaatcaccaaagcaaaatcttgtagctccattgtaagagaaaaggacagttcttagagctttgggcttagtaggtgatatgatttgaatatatggccccaccaaatctcatgttgaattgtaatccccagtgttggaggtggggcctggtgggaggtgtttggggcggtggggggggcagatccctcatgggtttgtgctacctttgcaatagagagtgagtttttctgagatctggtcatttaaaagtgtgtggtgcctccaccgctccatcttgctcctgctctggccatgtgacttgtttgctcccccttcaccttcctgaagcctccccagaagccaagcagataccagcaccatgcttcctataaagcctgcagaactgtgagccaattaaacctcttttctttatacattacctggtctcaagtatgtatagcaatgcaagaatggcctaatatcataggctatagaattttgcatatgtaatttcatctactatgtatattctgactcaaaaaccaagaatagaaaagcagttcaagtaaaaccacagctgcatttttgcctgcctctaggtatgtgagcttcaaagttggaagaaattaagcaacatgctttggaatctatggtgatctatagaaaggcaaagtttctggactcaccctgactgatggaaagacagactgcctgccaggacactaccctgctgtacccagtcttaagtataataaagatctcattttttactgtcaatgcaagccacattttcctattaggaaaatgtgaatgaaacaaagtgctcttcaagagcaaaccctgaattatattttgggttattctctgttcctcaaaaggattttgcatctaactgatagtctccaaattgtaatgacagtatatagatagcttggtgtagacatacaggtcaatacaaatggagaaaaggcaatttgccattgaagaatatgtttgctttaagtaaagatcaatatactaagaaagctatacatatctagacttccaaaaacagatgggaataaactactcagcaatcagaatattcgaagatggcactctgttcacttccagagaaaatagttcaaaactgtatctcaaagtggatataagctattgtactagaattagtccctgtgtgagcatttggcattataaaataagatgttcccaattaaaagatcactggtatgtagataataaaacgtgaaaataaaaatttaaaaataaaacaaaaattatgtgataatcaattttgcactccttggtccttaccattattatcttgtggtcaagagtttgcagttgaactggttacctatggtggggctacacaaggacatttactttttattctacatactgtgtatcatttgaattttggacaatgaatgtttattcaggtattaattttagattttatttaatttagaaaacattttatagttaaaataagggctgccaatttaacacactaatgtcagggtctaagtggtaaaacttgaacctaaaataagaatttttatactacctatgataaatatataatataagaagataacttatataaacaaaagttcaaaggggatccacaagttattagtaatggttatgtctagagagtggaattatggacatttattttcttttttccttattttctataattttttacattatgtattacatactttaaataactttaagtacttactgcttttgtacttaaatatataaaaagaaaaaaatataattgttactaagaaaaaggtagatgaaacacattttggtgtattcatacaatacaatacagtactagccagcgatcaaaaagaatgaactcagatacatgcaacgtggatacatcttgaaaacattttaagtgaaacaagccatatgcaaatgagtacatcctgtgtgattccatttatttgaagtctgacaacaggtctacagccgtactaccctgaatgcacctgatattgtctgaagtctaataacagactataggaaaaacagatctattgtgatataagtcaggaagtggttgaacggtgagagacagggtgagaagtgattgcaaaggggcacaaagaaattttctgaggtgatgaagctgttctgtatcttgttttggatgaagataacataggtgtatagaattgttgaagctcattgaactgggcacttagatctgtagattgtatacatagtatatttcaattaaaaagattaaaaggagtaaataaaactatgtgtttccctcaaaattttaatttgagggatttctttggtagaaagtcacccgcactttaagaacagttttgaaaattagggaaatgctataaaatatagcccagaagaaattctgtaaaagacccaattgcaaattaaaaacttaagcctatccatatgagtttttttttttttttgagacggagactcactgtgtcacccaggctggagtgcagtggcacaatctcggctcactgcaacctctgcctcccgggttccactgcgccccaccttaggataatattttatatgcatatgtacaccaaacacttatgattggaggaaggcatgttgttaaggtgagacttagggcttttgtaatgatgtagtataaaattattacttctaaaacgtagtgaaggcacataacgaaaagtttgagaataagcttcatattatgattaaacaaattattaattttatatatcaacagttcaccctgaacattgattaataaatacatttacaagcatttacttgctttatggcctaggttaagtcacttatatctggcttttaatttcctaatctacaatgaaatatgttgaatttaaacagcagttttcaaacttaagcatgcatcagaatcacctggagggcttgttaacataaattgttgggacctacccccttgagtttctgacacaataaggtctggggtggggctcaagaatttgcattcctgacaagttcccagatcatgttgatgctgctatctgggaatcacactttgaaaaccactgaatgagaactatcctaagctgtatcagacaacagatcagaacttctgcagatagacagaaaagcacaccaatgaagaactacttacaaaatctatgttgaatttagagaactgtatccgcatgtggaacaagatttctaaatattactgtggtatggggtgttttgcactatctctgttttgacctctaaattttgcagtcaccatagtcacttttgcaccccctgtgtggcaactgggttgtagtgtttctaagacctacttctgggctgagagggagtttccaaaagaattggagaggtggaaaatccccatgtcccaaaccagttgtattaggtttcactgccctagttatgacattggaaatagctattctaattactaaaaactatgcaccaaaagaaaaatgtgattctggcagagaaactaaggcagatgagaaaatgcaagaatgtcaaagtaaagccagttaggctttgtggtaacacacaggcagttgcgtgatttccctgtgctctttggaaacctttaagaagtcagaaacaatcatgctttccattaattaacaacacagcatcttgaaatgcttgttttaaagccaggagatttccggttcatctgcagattatagtagtatgcttctcagcaaaatccatctaatagtaaacattagagtctttcaagttattaaatacgcataggttgttaagtaaattttaaagtatttgttaaatcaatcaatgagcaagaatgcaaacatacctttttttctctcttcaatgagctttcagtttagttaaaagggagaaaaggtgcacgctacagttagaacaattgactggtaaactaaatggtactgaattaaatttagtgtgaatacagaaaaagtagaggttagtatgggctggtatagttgaagggacaagagtggcacttgagatgggtgttaggatgaagaaggccaaggaagggactcagcaaaataaaatagcttcattaaaagccacggaacttgggttaaacacagtgctagcctgtaggtaaagagagatgttggggatttttgaatgaccaggttcatccatccatacatctaatcctctatagttgttcattcaaagaacatgtatcaagagccaactgtaagccagacactatgctatggagtgccttgccaattagaatttggttaatgttttgacaaaggcaaaagaatttggacttaatgttatggatttaagcagacaatgacatgatgaaaacctttttttaggaagattacccaggcaacaggatggatggtacttcctttttttttttttttttgagacgaagtcttgctcttgtcccccaggctggagtgcaatggcacaatctcgactcactgcaacctctgcctcccaggttcaagagattctcctgcctcagcttcctgagtagctgggattataggcatgcgccaccacacccagctaattttgttatttatttatttatttttttcaatagagatgaggtttcaccgtgttggccaggctggccttgaactcctggcctcccaaagtgctgggattatatgcgtgagccaccgcgcctggccctctgcttccctcttttctaatctgatggttaagcccttagcattcccttgactctggaacttttgcagagcaaagagcagaggctgtttgaagccagctgcatttctagacttttatgaaattctaagcccactgcaaagattgagccagatgtcccattggggaagagaggagagagaaaagtttttgaagtcagcgaagaggagagagtgacatttcacacagatggaaagagactggaggtcaaagagtaacaagtacccacctccattccatatcagtgccctggagaagcagcaggacctcagagagggaagtaatggggtgacttggagaggctgcactttagcaggggattctggctccataaaaggttaaatatagcaagcttctagggttggcaaaaccatgcttactgaggcaggggtggtttagtggcagatcaacgatcagagtagtctccttggtgctttggtaccaggtaaaacctagggacctttaaatagctgagaaagtagggagaggaggaaatatcaaacgtatgaaattgaatttctcaccatcctgattcagacaggggctttaaattgatgactaccttagatttatgaactaagagtcatacactatgaacttttgttcattggtgctcagtcctagacccttttcacctctctattctcttctggtgtcatctcatcctttcccatctttataccagtggcttccaatttatgtttttattgtagaattctcatctgagtgccactctcaaatacctggttacctatttgatatctgcatgtggatgtgtcatagacatctcaaaattaccgtaggaaagactgatctcctgactgttgtcttccccttgtttaaagtgcctccctttcctcctaatactttatatgaggagtcagaaaactatggactgtggaccaaatccagcccccacctgtttgtgcaaatacagttttgttggaacacagccatgttcattcttatgtgttgtgtgtggctgtttttatgcaacaatggcagaaactttacagcctgcaaagcttatttactatctggccctatacagaaaaagtctaccaattcctgctctttgctttcttcaatgtatttatcacaatttgaagttatatatttgtttcattatctgcttatttatctgcctccttccatagaaggtaattctctagtgcctaccatgacagcaccattgcctagtcatggtaggcactcaattgttattgaatagaatgtatgaatgagaaaatgaactattatatattaaaattttattttggtcttttgccttagcacaaaactttcatccttccttaccctccaatgacttcatatctttgttttgttttgtttttttctgagacggagacttgctgtgttgcccaggatggagtgcagtggcactatcttggctcactacaacctccacctcccgggttcaagcaattctcctgcctcagcctccccagtagctgggattacaggcacgcgtcaccacacctggctaatttttgtattcttagtagagacagggtttcaccgtgttggccaggctggtctcaaactcttgacctcatgatcctcccacctcggcctcccaaagtgctgggattacaggtgtgagccaccatgcctggccctaatgacttcatatcttaagtaacaagagtgctaaaataatgagtcccctcaatttctttgccctctactctatcctcctttcagattaatctttctaaaacagagctcagatatcactctccctcaaagaaacctggagacccaatgacttgtccattaatcctaaacttctttacctgcttcttaaagttctctgaatctggctccactctatttttctgtccccctatattctattcctgctactacttctctaccctgaacttccccacctctatacttcatacacttggaatattcttttctatcactaccacctccacctatcaaaatcctatccacccttcaagtatttcctccaagctgcctttctgagtaccaccaaaagacatctttctcttcttccatcttccaaaatacttttttgtacctatagtaacttgtatgtcatttctccatactgcgttctccccattagctggtaagctacttaagaaaaggaaccacagctttctcatcttggtatctgctatggtttgaaagtttgtattcccctccaaattcatatgttgaaatcctaacccccaacataatggtattaggaggtgggggctttgggagagattagtgtccttataaaaagagacctcagagagttagctaatcccttctaccatgtgaagacacagcaggaaatccataaaccagaaagtgggccctcaccagacactgaaaatgccagtgccttgatcttggacttcccagcctccagaactgtgagaaatgaatttctattgtttataagccactcagtctatggtattctgttatagcagcctgagtggactaagactgcttctgaagtatttggaacagtatctttctagatctcaataatcattgaatgaatgaataaagaaatgcctttccttttcatatctacttggtaaaatcctactcattcctcagagaccaaaatctttgcttctgaccccagtccatgatgatttttcctttctgtactgccttgtatttttttcatcagtgactttctcctattgtaatctctagaaggtagagactaaatcctgcacatctttgtgttcttcttccttcacctaacagtaccttgtgcattacaagtgctcagtaaatatttttgattaagttgtaaagcagctgcctatttttccacttcctttgctgctcaaaaggattagagcaatgattgctttagctgctaaggcctgcttcagagacacattattaatgaaggttgtctgggagacagtaatgttgaacggggatttgtaaatgagtctccagcttcaacattcatcagcaaaagaaggggatactgaaaagctactctaaaaaaaaatctcatatgaagttgtccggagctgcctgagctactaatcactgcaaggttttcagtctctgccttgagcatttagagcacattcttgccttaacctccaagtcagatctctccatggtaacgcaggaatgtttgctattttaggaaatatgcctcactgcatgcagtactatttacattaagttccaaacaaggcataaatgcaacagcttgactgtgctaatttgtgtgagtgggaaggtctcacttacttaatgtgggcctctccctaattgtgttatcctgtctcattttataagccaaccacagtgagattacatgttaataaattttgctcatcttatactgaaggagaaatgcagagagagaaaaaaggcgacaaacaaaacaagaattcctccagacctccctttgcaagggcatcattttttctgccttcacaccctccaggtctggtttcatttaaaaccttcattgagatgaagcttctaacattctgtagaaggaaataatatcaataactgaaacaattgctagcttttccctgcaactttgtagatacctttactgaggaagagaaaaatgctttgtaaactttattagattttctgactccctagtgaaaaagatgtggacaagatgtcacagcctcacatcaaaaagctcctcaacactctgatcacacatactattgatctgaatggacatcaagaaggattggaaggagatatggaatgatgtcagtcaatggcatatctagttggtggtactttttttgctttacaagaagttaattatagacgttcataaatactgtgcaagtgcactcccactaaaatgaatgttgtagaatgttttggtagaatggaaaaggaaaacagctagaaagactgtaagatcaattaaataaaataatctttatcaaaagtgtctgtcttatttgagagaatgaagactctgaagtgaacttcctgtactcagatattacagtgagtatattatactcatactccagactttcatactgggatcacttgagagatagttatctgtgggatgtggagtaaattagcgttcttcacttggacaattcagacctagaagtgcaagatctgtgagctcttctttcttctagggcccaactgtttgtggtattctcagttgtgaagtataggtggaattaaaggaagtgaataggtctttagaacttaagctcctccatactccagctgaatcagtgagggattccagggatggcttcactggagatgaggagattctttagcctctgaagaacaggcccagagcttagaaattgaacttttaccttccacattgtaagggtctttcttctgtggtgacagttggcatggcagacaaggtttgagtagaatacagtggaactataactgttacagtgaaagtatactgttagcagagaaggataacacccacaacataggctccaagtgtcacaaatagcaaggttcaccatacattacctatgcagaggggagagacaaagtgctttgtaattggttttataatattcttttccccaaccaattcaaagaacagacttgacaaagcagttcatagctgtgtcagattatgatttgctctctgaggaggtgacatcaattatctcagatgctcttcaagcaatcctcagtttccacgacaactaggattacctttctaaatgcaaatcatatgcttttattccccttgctttttttttttctggtgcctacaacatgaagcccttagctcaacatttatggtactttccagctatatattttatcattctccaatacttatttttggtaacatcgattactcccaattccttagctgtgttccacatcactgtatatattgctccgtttcctattttctgcctggtgtatccagtctttaaggcccaacagaagggtgacctccaggtgagttcctccttggagttaattcctttcagctgtgggttcctttagcaccatgcgtgtatttctgtctcctcatttatcacactgtattttagttctttgtttacataccagtctttcactggactataaacctttggaaggctaggactccctatactagtggtactcactgagcaactgtctcatctcctagagagcattttgaaattttgtgggggtgtttcttgtttttgatgttgtcacgatgataagtgaggcaagggatgttacaggacaaagtattgtaccaaattccaaatgacttttggaatttgaatgttccattgggtgatgataaaactgtttacaatcatctgaacctagaactttatataggagcatgatgttaatttacactaaatttttccatgaattaaactactatgtaaattgagggaagacactaccagtccttgggcccaattttttttcccataagacgtagacccaaagggagaaacaaggaaatatgctatgggaggctttctattctccacacttgagaggaccaactatcagcggcctcctgtggcagagctttccaacttgggtattccagcacagtgtacctcagcatggtccaccactgtgcaaagatgctgatcccctcagctctcagggtggtgcatgggtcctgaggtggccataagcaattgcctcaaaccatgagcagccatgggcacttatttcagaataccatagatgtacactcatttcctatgaaaatgaattttctatgaaaaagggtaggaaacattgtcttatagaacaaacagcgcaatgtatcaggttttgaaatgtacaacgtattgggtaataacaacaataaatttttattaggcaatgtttaaaaagcatatcaatttagtacagtttatatgatttgatgcatttcttctgcccaatggtcatgcaatattatcccctggatgctgtacttattcttgttctaagcatccttttagagtagaatataaataatttagtctctttgaaattataatcttttggttctttaagtctgttctgaaaactggtaccaaaccaattccttaattagcattgaaaatactgaactaaatatattcatttcagtgcttaccaaagatgatgaaaataagtatatgtacaaaatattttagtatttatgtgcctgtaaatacaaaaggagcaataaaagtgatttcatttcagaaggtgaacattttgaaagaaataatattcatgtaaattctgaactaaaatagaatgaaataaaattctgaaataagataaaaatagaatgttagcattataggaaactatagagattatttgagctaatcttctcattttatgtatatggaagctgagaagtgacatatccatagtcatacagctaataaataatcaggatggaatcgcttctcggccttttggctaagatcaagtgtagtatctgttcttatcagcttaaataatcaggatggaaattcaattcttcttattctcagttgagctttttctaattaaatgtattacgaaatattttcaagagtcccttaagaaaatttccacatatttcaacatgtatcttgcaaaaagcctatgaacttcaatttgtattcatacttgtaaaattatgttcacacattatttcttgagtttgttaaccaatgctttccaaccaaaatggagctgcagtctaagaagtttgtaattgtggccaagatagtaattttttcctgccctcatagtggcctaagcacccaaattggccacctccaagtgagaagcttcatccatttacctctataccttacaaatattatcatttgccatgaaatggaaaggttgggaagcagtggtttaaactaattcttatcattgctcttttatcttgaccccaacctttccatatgtgaaccagtaaagtaaaccacccacattttgtcttatcagtagtctaagaccagtgcaagaatgtaaggataccaggtaattgcttttgttgtttgggtgcaggtatattctaaagttcttttagaaaatatctttttagtaaattaaaagttgaatgaaggagaggagttcccttcgaggtaacttcccagaaaatcaatgcaattattttttaccacagtgagttctcttttcaatattaaaactacattatggccaggtgtggtggctcacgcctgtaatcccagcactttgggaggccaaggcgggcagatcacctgaggtcaggagttcgagaccagcctggccaacatggtgaaaccccatctctactaaaaatacaaatattgctgggtgtggtggcatgcacctgtaatcccagctactcgggaggctgaggcagaggttgcagttagccgagatcatcccactgcacttcagcctgggcaacagagtgagactccaactcaaaaaaaaaaatttttttttggaggcaaatttctatcattatctgatacacttggacggaaatagtaatcaccatttcaactagtacccagcacattttcaaggacctggaaggttcatactccaatatatacaaacagagaatatgcctagctcatagatgatcaataactgtttatttgaacccatagtttgtgtacttcggcacagtattttacaacttaaccctcaaaaaaacccctaaaacattgtatgttctgtataattataaatcacttgatgtggctggcaaattctaaggtggtccctataattctcacccactggccatcacatctttgtgttatcctcaccccttgaggatgggtagaacctgtaacttctaaccaatatggcaaaggtcatgaaatgtcactgcatagttatgctatgttatatgaaaaaagtaaagaggtcatatagatgtaattagggctgctaatcagttgattttaagttaacgaaaagggatattatgctggtgggcctgccctaatgagccccttaaaagaaagtctagaagtgagaaaagtaacagactctttctgctgctggctatgaagaaggaagctgccataacttctacagctacacagcaataaatccttccaacagcctgaggagcttagaagccgatccttccctaggtatgcctccagatgagaaaagagcccagtctacatcttgatttcacacttatgagactccaaacagatctcagctaagccatatctggactcttgactcacagaaactgtgagataacaaaaataaggtgttttaaactgccaagtttgtagtaatctgttacacaacaatagataacaaatacacttagatattaaaaagcagggcttatgaaagcatgaagcaagtgcttctggatgtactgaccaaaccttacctgcacttccatgctagttggctcctccaacagatgtagcagttgttgtttctcccgagatagctgttctacaagcctctcctgggcagccaggctctgattcagttcttcaattctcctgaagcaaaggaaaagtaaggacagtaattatgatcatgatactattattaccttattttttcagcccattccaaagatagcatggtctagtatagcaggtttttatccttttggatcattgaaccttttgacacatttgtttagaaaaccatgtattttctgcccagcccccaaatatatacacaaacaactttttgcttacattttcaccacgttcatggacctcctgaagttaatccatggatctttagaccataggaatttaactcttggaataagggcctagaattttttggtggtggtggtagtggctgttccattcaataaacggttcttggataactattttgtgtactcaatgcactctaccaagtactggaaatatgaagttggaaaagaaacaatcgctgttttgcaaaaatttaaattccaccagcatgtgtttgctagtgatttggagagtaagaagacatacagctacagtcacgtaccatatactgtttctgtcaacattatgtcatcatactgcatgtatgatgatggtccaataagattatactggagctgaaaaattcctatcacctagtaaagtcctagctgcagtaacatcatagtgcaatgtatttctcacttgtttgtggtgttgctggtgtaaagcaaacctactgcactggcagttgtatacaaatataacatatgtatagtatgtaatacttgataataaatgttactggtttatgtatttactatactttcattgtcgttttagagtgtactctttctacttattaaacaaaataactgtaaagtagcctcaggcaggtccctcaggagctattccagaagaaggcattgttatcataggagatgacagctccatgtgtgttattgtccctgaagaccttccagcggacaagatgtaaaggtggaagacagtgaagctgatgatcctgacactgtgtaggcctaggcttgtgtgtatgtttgtgtcttagtttgtaacaaaaaagtttaaaaagtaaaaaaaaaaaattaaaaatttaaaaacagaataaaccttttctagaataaggatataaggaaaatatttttatatgactacaaaatgtgttttaggccttcacattcatccacttcactactcactcgctaaatcacccacagcatgttccagtgctgcaagttccatttatggtcagtgccctaaacaggtgtactgtttgttatcttttatacagtatttttactgtatcttttctatgtttagatacacaaatggttaccattgtgttacaattgcctacagtattcagtacagtaatatgtcatacaggtttgtagcccagaagccataggctataccatatagcctaggtgtgcagtagcctatcccatcaaggtttgtgtaagtatgctctgtgatggccacacaatgaagaatgaaattgcctaaagatacatttctcagaacatatccctgtagtttgtgatgcatgattgtatataagcaaataatagtaatagaatataataaatgctaccagaatagaggcaccatatagtacattgagtgctgccatagagctataggatgaaagataaagaaataattcatttgacttgaaggagtatagcgatgctcaggagaagaaattttaaagattgagtggtttcagagtaaacagacaacctacagaatgggggaaaatatttgaaaactatgcattggacaaaggtccaatatccagcatctataagaaatgtaaacaaatatacaaaagaaaagcaaccccattaaaaagtgggcaaaggacataaacagacacttcaaaagacgtacctgcagccaacaagcatatgataaaaagctcaataacactgatcactagagaaatgcaatcaaaaccacatgtgataccatctcacaccagtcagaatgactatggttaaaaagtcaaaaaataacagacgttagtgaggttgcagagaaaaggaaacacttatacactgttggtgggagtgttaaattagttcaaccactgtagaaagcagtatggtgattcctcaaagaacaaaaagcagaactaccattcgacccagcaatcccatttctgggtatactcagaggaatataaatcattctaccatgaagacatatgcatgcaaatgttcactgcacactatttacaatagcaaagacttgggtggttttccaggctcagaaggaggagattgaacaaaggaacaaaggcatgaagacccagtgtacaatttgggaagagtcactggaacaaaggcccagggaagaggcaatggctggagaagagactgaaaattcagaccctcagactagggttaagttgtaaaatactgtgctgaggtatacaaactatgggttcaaataaacttattgatcatctatgtgctaggcatattctctgtttgtatatattggaacatgaaccttccaggtccttgaaaatctgctgggtactaaatgaaatgtttccagttgtgattctttttttttttgagatggagtcttgctctgtcgccagactggagtgcagtggcgcaatcttggctcactgcaacctccacctccctggttcaagcgattctcctgcctcagcctcccgagtagctgggactacaggcatgcgccaccatgcccaaccaatttttgtatttttagttgagatggggtttcaccatgttggccaggatggtcttaatctcgtgatccgcccgcctcggcctcccaaagtgctaggattacaggtgtgagccatgattcccaggagaaataacttttaaaacttaaaaacattgggctgggtatggtggctcatgcctgtaatccctgtaatcccagcactttgggaggctgaggcaggcggatcacctgaggtcaggagtttgagatcagcctgaccaacatagtgaaaccctgtctctactaaaaatacaaaaattagctgggcgtggtggtgcacgcctgtaatcccagctactcgggaggctgaggcaggaaaatcggttgaacctgggaggcagaggttgcagtgagccgagatcttgccactgtactccaccctgggcaacagagcgagactccatctcaaaacaaaagcaaaaacagaaacaaaaaattaaaaacattatacaaatgtaaactgcaatgatgacgagaaggaggaatgtggactccatatgaaattccctcatggtatctgcactagaacatctctacttttcttaaacctcaaactttgctcatctctttgacccttagtctccacagaggatctgttctcctactctccaaaattgttcaaggtcatctgatgagtggcctcaatttattttcagatgtgcatgtgctttacttggggttttgttttggtttttagttcagtttttttttattggggttcaaatatgacactgtcttggggaacctagtagggaaaatctgaaagcaaatacagtaccatactgagaattgtacaatatgtatatatataaaagaaacaatacagaaacttcattctgctatcacaaagccttcaaagaaatgacgattgatgccttagtgaggttcactagaagggaaaaagttggcagatgtttcccacagaaggaaaagcatgagcaaaattctggagacttgccatagcttcttatgcttctggaggcagtatggcttcagggtttggatgtcagcaatccctgaaaccatgtttcacaagtctccagatgccaattttttcattaataaagtataataattcatatctcatggggctgttaaacaagaacataaagtactcagctgtatggtaagagctcaacaaagcttagccatcattattattactagcctggcatgaatgaagttaaggaatggtggtgggtgatgagtgtgggagaaatcagaggttacatcataaaaggctttgatggtcacattaggagtatggatcttatctcctaaaggtattgcaaagcttcttaaatggctctgccatggtgcgattaaatttatgtcttggaaagatcacattggtcatggtatgcacatgtggtttttgcctattcagttaaaagctccttaaagctttttataccaccacagtcttatgcacctaagaggctaaattatttgccaatttgttgttgttgaattatctatttcagaactactctgaattattaggttgagattgaatgagaggagcaggactggaagtggagaggacatttagaaagtttcctcggtaatccagacagtagatggtggtgacctcaataattgcccagttaccttcaggacaaagtccaagttccttataatggtatacaaagctggcacaatcagacccctattctcaaaacagcttacctctcacttgtcttctcacttgctccagttatgtacaattatttaaagttcttgaaatattcctttccctgtgtcttccctccatagtttctccttctgcatagaatatttcctttccctatccactttctacctatttattctacctcctattcatccttcaaagctcagctcagatttcgcttcctctaggaaaacttcaatggcattatcttagtctttttgggctgctataacaaaacaccataaactgggaggattataaacaacggaaatgtatttctcacagttttggaggctgggaagtcctagatcaagtcactgacaggttcaatgtctggtgaaggttcacactctggctcataacggtgcattcccactatatcctcacatggtagaatgggctaactagctctctggggtctcttttacaagcgtattaatcccatttatgagggctccatctccaatgtctatgatttaatcacctcctaatggctccacctcatactacttctggaggcagaagtattaaccttaagggttaagatttcaacatataaactggtgggggagggaggtggggatgggacacaaacattcagaccacagcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgt

SEQ ID NO: 1125 - DNA, 124426 bp, Homo sapiens
gcagacaacttgctcttttaatgtggaatggatgaccctccaatatttccccagagcaccccatgctcttctatcagggaacttattaaaatcatgtaacatgtttcttggtgacaagaattaggtcttttgtttctgtaacacatgccagatacttagcccggtatctggcatgtggcatgcccagtaaatgtttgctgaataagtgaatctatgtctcttgcttgccgctatttgcccactgaatccatgaagtgagttttcataatggataccactgaaaattcaaccctgaaaagaatgtcttcggttgtgggcccataaagtcttagaaatagtgaagctcctactgtcagtccttgaaagggaacaggacagctgctgtatgccttgagaatgggcaaaagacaagcgacaaaaagagcaccgaaggcacctacttgtccctctgggccagggcctcagtgtattggtcgggcttgacctggtctcctggtacatcttcccagtttttggtgactcccttcagtttctctgagagctccaggttacactccttctctgcttccaccagagctgccatccgcgcagcttcattctttgctagcctggattcctggaaaaagaacaaaaactgagaggctgcaaaatttctacctagattaggagccctaagacccaggaacattgatgaatttcagagggaaagtagagacggaaaaggtgaatgccagaaggcagagcagtaggaagaggagtgttaataaaagagaacccctacctatggactttgggaactcctcacctcctgcagaagctggatcttattctccaagagctcataaacatgctccgtctcctgctgtcgctcctcaaactggcgtcggagctcagcttcattctgactgttgagattctccacatcagccctaaaaccacagagcattagccaatcagagccagacatacagtttagcaagtggaaccattaaggttgttctttgataaatctccaaactgctttctgcagtgactgaactggtttatatttccaccaacagcgtgtaagcattcccatttctatgcagcctcaccggcatctgttgtttttagacgttttaatagtagccattctgactggtgtgagatggtatctcattgtggttttgatttatatttctctgatgattagtgatgtggagcaatttttcatatatttggtgggcatttgtatgtcttcttttgaaaagtgtttgatcatgccttttgctcatttttttaatggggttatttgtttttcattgttcaattgttaaattccttatggattctggatattagacccttttcagatgctagttgcaaatttttttagattctacaggttgtctgtttactctgttgatagtttcttttgctgtgcaaaactctttagtttaaataaatccgacttgtctctttttgtttttgttgcaattgcttttgaggacttagtcataaattcctgaggccaatgtccagaatggtgtttcttgggttttcttctaggattcttatagtttgaggtcttacatttacatctttactccatcttgagttaatttttatatgtgctgaaaggtaggggcccagtttcattcttttgcatatggctagccagttatctatcccaccaccatcgaataggggagtgctttccccactgcttatttttgttgattttgtcgaagatcagattgctgtaggtgtgtagctttatttttgggttctctatttgcttccattggtctatgtgtctttttttttttccagcaacatgctgttttggcaactgtagccttgtagtatagtttgaagttggatagtgtgatgcctctggctttgatcttggtcatttgatgaatgacattggtagtttgacaggaatagtgttgaatctgtagattaccttcggcaatatggccattttaatgatattgattcttccaatccatgagcatggaatgtttttccatttgtttgtgtcatctatgatttctttaagcagtgtttcatagttctccttgtagagatctttcacctccttggttagatgtattccaaggtatttttttttttttttagcagatattgtaaatgggattgcattcttgatttggctctcagcttgaatgttattggtgtgtagaaatgctactgattttttttttttgagacggagtctggctctgtcgcccaggctggagtgcagtggcatgatctcggctcactgcaagctccgcctcccgggttcacgccattctcctgcctcagcctcccaagtagctgggactacaggcgactgccaccacacccgcctaatttttttttttctatttttagaagagacggggttcaccgtgttagccaggatggtttcgatctcctgacctcgtgatccacccacctcggcctcccaaagtgctgggattacaggcgtgagccaccatgcctggtgaaatgctactgatttttgtacattaatttttgtattctgaaactttattgaagtctgaaaatatttttaataattttagtaatacttgtcatttaacactaagcttttaaaaaactgtaaattataaaagtaaccattttagcaatataaatgtatataaagaaaaatatcaagtcttctccctatcacggactgtgatctcactcttcctcagtatactataaatatcactcagcaacttttcccccttactttaatcaaggaattcccactaggacaataatatagagctaactcattcttcaataactgcataatagtccacagtgtagtaataccaaaatttattcaatcaatgccctattgatggataattgtttctagttttttgccattacaactaatgatgcaataaacatccttatacatttatcctttcacactaacgcttttatttataagaaacagattccttctcgggattgtttgatcaaaggaaatcctccttttttattataataggtagcatcccatactaaaaatgttgtcacaatttacactcactggtagtgtatgagagtgcccattttccccaaatgttatctcagctcttgatgttattataggctgactgatactttttgataaagcttatttgcatttgtctctactaaaagtggaaacattcactgtttcaatttagttgattgctgactgataggaagtttgcagtcttaggtctggtggatttaccaacttatgacaaggtccatctgacctagtaatagagaaagagcccaagggaaacacagcatatgaaaatctattgtttcagttcctgaatcagatacaggattcaaatgccacagataggttaaggaatttggttccaaatctattgctctcagattagtaagacagactctggaaaggaccagagcttaaaattacaacttaccatgttttatccagatgctgtttcttgtcctggagttctcgtttcaagctctccacttcaaccttcagctcaatgttctgaaaaacacacaggcattaatcgttattaactgccacagacactctttcctggatccaggttcctatttgagtcttgccttggtccacagcctctcacctcatctctgccctctttgtgacccttgacataattagggatttagttggatcagcaatctagtcaaggaagaataaactgtacagcttcagggtttcccctgagctacttatcaattttcccaacctatttatcattacccctggatcatgaacactgcttaagtctattcgttctctaaaccattgcaggacagagtatatattaaaataaatttttcctatctaatacaggttgttcctgaaaacgaaattgctggaataatacttttaatagaattatagtaatagaacaatacttttaaatgtctggggatttaattatttaaagaaatttggttgtaaacatttttaaaaacaatgcttttatcataaaattggaattttataaattaggtttgcttaaggtgagaggggactctgatggtaaagttatacagggaacaattaatttttattgaggtgaggatgcaacaagtaagatttggggaaacagaaataaggaaataaaaacatcccaagtgtgtctggtgcaggttaagtggcttagtgtgtggtaaggagtatagaaaatagtttgcaactagtttgtgaaaatcctgctaagacaactagataggccggccacggtggctcacacctataatcccagcactttgggaggccaaggcaggcagatcactcgaggtcaggctttagagaccagcctaaccaacatggtgaaacctcatctctgctaaaaatacaaaaattagctgggcgtggtgacatgcgcctgtaatcccagctacttgggaggctgaaacaggagaatcgcttgaacccaggaggtggaggttgcagtcagccaagatcatgctgctgcactccagcctgggtgacagagagagactctgtctcaaaataaaaaaaattaaaaaagtaaaaaactggataataatcagtagaaatcaaagacttatcagggagctttaagcaaagtattggcatgatcgggtccatgttgaagaaggaattatgaagaaggtgggtgggtcaggggcaactaaccagaatagggagggggactgtctaaggacaagaggtacagggagaaagactcaaaagacatttcagagacagaagccacaggccttgatgacttgtgagattcagattagactggagggaggaccaaagacaatgctgaaatttccagcatgtcagtgggaatgcattctattaactaaaataggggcaggtttgtaggggaacctaaggaggtttctgcaaaatgttaattgagggattactttatttcagcttaaacgttagcatgcaaagatggattagtcccttccctgatgaagtccataatacagtattaggcaagaagaatgttatttagtaaagaagtctttagatcagaggttgacagagagactgaaggtaaagtagctaaagtatgaaaagtagtattgtgggtactagaacagtagggaggattttactttactatcgccatataataaccaccaacacctagacttctagaagtccaaggcaacatacaatagcagcatattttctaccatacttgtgaaggcatttcataacccatgtttccatgcagggtggtcgaaacacaaatactaattgggaaaagtagaaacctagtttagatatttgagagttacttagaattaaagaattttagagctggaaggcagttggactcaaggcattttagatcatattactagtatgtttttagtgacatactgagaagaatgtttgttcccctcataagtaggtaccttttgaccaaggttagaacatagattcagatccagtgagatgaaaatatcctaatttcttcaaaagaaggaatgatagccctgtcttttcaggatatactttaaagttattattttatgaacactaaatagcattaccagatttagcaaataaaaatataagatatctacttcaatttaaatttcagataaacaacaaataatttgtttcattagaagtatatcctttgcaatatttgagacataacttaaacgctaaaacattgtttgttgtttatctgaaatttaaattgaattgagtaccctgtattttattctgcaatacaaataccaaaagattaacaaatggaaacacgcatatttcaattttgtatgaagaacaagtctaagatctctatatcagttccatggcctggcactgcaagaataattcatctgtaccaattgatgaatcagtaaaatagaagatttgctaaacagttgctatgtccccagctttgtggtcaatacttaaaggaattcaaatgtcttcataaaaaatagtccctaagctagaggcccttcatagaggtgaaggaatatgcattcaattatgtgggaaatgcaaagagggagcaacttcctaatctgtaataggcagataattgtattttcctcattcataaacctacctgagaggatcgtgaggcataaataaatcaatacatgtaaaggacttaggacagtgtttctaacacaggtataactataattttaattataataatattattatcaccatcatcatcaagaacaacagcattatcatttggaacagcagtttgctttccatgagaccataatgtttcaagtggattcagtgttcaggatatggtgctgagaaagaggactcctaagtttattattatttctgccaccaattgattcacttctgtgaccttgggtaaaattctgctaaggcttctccacctggaaaatgacaaagagtgggcaaaaagctatttaaatctcatatgaaagaaaatggaatctataattatgaagtgttattatcaatgatattcctatgcctggctaatttatataaatcagaaaagtctggatatgctaaaccacctcagataagccaaaactgcttgagcagattttttaaaaatctcatatctaaaaatacgtgaggtctcaaatgactggagctatatggatgtcctctgcctagttcttagtctcatgatgtgacatagggaatctctatcaggtataaactgatcaacagaaagttccctgaaaagtcccttactattaatactatttttgcatgaggaatctttgaatattcaaataaaaataaacaaacaacagggaaagtgagaggcactatgaaaccaacctaaagccagaaagaattaggttcgaatcctggctctatcactttcctgctaggtgaccttgggcaggttaactaatcactatgagcctcagttttcttataagtatagtgtggttgctttgctttttaatgaagataagtattcacgagggattctgtgaggattgaatgagacaatgtgcatgataagcatagaacaatgccttgcacacagctgtgcaacaaccttgattcactttcccttcatgtccaggctgactagtgccagtcagagaccccagccttaccaggaaaaatacttagatctaaaaggaagaaaaacagaggacataaattagtacgttctatctgttctaaatcctactgaagaaaatgaagtcaatgctttgaccaatttggccaaagattcacagatttgaagacctcagcatttctgtgttctagttctcttagtttaaagacaaggaaattgaaatccagaagggttacctccaaggtaaaagccgtaactgaaaccaacactccactcttgctttagccttttatcagagagaccagcttagcaaacactgcccagttttgtctgattttgtagaatgtggtaaattatagaattagagaatgtgctgcatttagtcttgaaagaatatatggaggcagtaagtatagtggtcaagagcataggctctgaaggcgagaagggggcttgacaagtcacctgccctctctaagagcctcattcacctcatctatcaaggagataacaatgataccaatctacaaaggatgttagggagactaaatgaaattatgcacaaaaatcacatcgcacagtgcctggcatgcagtcagtattcagaaaatgataactattattaactataaaaacaataacaatttaccctctctaactaggatagctgaaatccagaagggttttcaaggtaaaagcaataatcttacatcaaagtctaaccttcttgcaccttctttctgtagaaaaatcatcatatagcttatcacatttattcattctccattactaaatattcatgtgtaaattgttaaattcttttatagcatcagtagattccaaattaactgcatttgcttattttatcaccaagtcttcttggctctttgtcaagatatctaaggaaatttatgtactcaagaaaggggagatgggaagaaagcacttctctttcttcatgcctccaaaggagtgttcgcccatctaactcaagaaaaagtttcaatgatgaagctgaaattaaacttctattaggtatttcttccttctccccaggactggagtacatgaatagtctcatatctggtttccccaacctcagtccctctactacttaaatttttcctaaagcatagctctggttatttcattccgtctgttcaaaaagcatttaatatgtgatgcaggtccagctaaagaagaaaaaggaaagaaagaaaaaaccttttaacgatttttaactgtacagcgattaaattatacacaactggcctgataatagagtctattcaaaatttgacctcaatctacctctccagctttatcttccattattatctgctagcctaactggatttcccaaacatgccctatgcttcttggtgccacatcattgtgtgcccttcagcttcatggttaaatgctccgtcccctgtgaagccttactttatctctccaaattaaaagtaatttctcatgatgacattatgagctttcaaatattcttttcatactgcaacattggcatcccgtgtaaatgcttcatatttctacacctgtcttatttacccttttaaattgcaaactccctaaggacagaggaaatgatggtgtggcagaactacccaggtgcgctggttattaagatactgcctctcagcgttgtcatgctggggcaggaatttcaggataagtaaacctaggttcacatacctttctgccacttcctaactgggggaccttttttgtgtaaattacttcaacttttacaacctaatttcctcatttataaaatagggtttgcaaaaattacctcaaagtttgtagtgaggaataaatgaatttatgtaaagtacccagcacaatgtctgatacaaataaccgcagctcgggcgcggtggctcacgcctgtaatcccagaactttgggaggccgaggcgggcagatcacgaggtcgggagatcgagaccatcctgcctaacacggtgaaaccccgtctctactaaaaatacaaaaaattagccgggagcggtggcgggctcctgtagtcccagctactcggaggctgaggcaggagaatggcgtgaacccgggaggcggagcttgcagtgagccgagatcgcgccactgcactccagcctgggcgacagagtaagactccgtctcaaaaacaacaacaacaaaaacaaataaccggcagctgtgactaatctgaggtctcgcagtgtctctcacctctttgtgcagtaaaagctttgaaagagtgaaccaacaagagaacaaagaaggaatagatgacaagaggcggaagtggactaacaatgatacgtttgttgaatgagtgagaaggtaatagataatgctgtgagattatgtggaaaactttttatctgaagtctttaaaagacattctcacttttggctgggcgcgggggctcacacctgtaattccagcactttgggaggctgaggcgggcggatcacttgaggtcaggagttccagaccagcctggacaaactggtgaaacgctgtctctactaaaaatacaaaaattagccaggcgtggtggtgggtgcctgtaatcccagctactcgggaggctaaggcaggataatcgcttgaacccaggaggcagaggttgcagtgggccgagattgtgccactgtactccagccggggtgacagagcgaaactccatctcgaaaaaataaaaaatgtactccagctggggtgacagagagaaactccacctcaaaaaaataaaaaataagggccgggcacggtggctcatgcctgtaatcccagcactttgggaggccgaggcgggcggatcacgaggtcaggaaatgagaccatcctggctaacacggtgaaaccccgtctctactaaaaatacaaaaaattagccgggtgtggtggcgggcacctgtagtcccagctactccggaggctgaggcaggagaacggtgtgaacccaggagtcggagcttgcaatgcgctgagatcgcgccactgcactccagcccgggtgacagagcgagactccatctcaaataagtagataaataaagactttctcaggtttttgttttgtttttgtttttttgacagtcttgctctgtcgcccaggctggagtacagtggcgcaatctcggctcactgcaagctctgcctcctgggttcatgccattctcctgcctcagtctccgagtagctgggactacaggcgcctgccaccacgcccggataatttttttgtattttttgtagagacagggtttcaccgtgttaggcagaatggtctcgatctcctgacctcgtgatccgcccgcctcggcctcccaaagtgttgggattacaggcgtgagccaccgcgcctggctgactttttcagttttaagctaagaatattctctaataggtatattattgacccattgacaatagaagattgaatacactttaggattccagcctcctcttctactgctcatgctctccgtaagaagggctaaacatcctactcctgtgcactacattggagctcagaaatactgacttaaaatctccagatcttaacacggacttttaaagggaagattgagtatggacccagtattagatggtattatggaattatttttaagctttttgggtacaataatagtattgtggttatgtttaaaaacaaagccttctctgtgagagttatattctgatatcttcccaaataaaattatatgatgtcagagagttgctgtaaggggtggaagaggacaagatggagaacgaacagtgcagggagatcactgaaaagaacagcaaaatgttgggaaccgttaaagctgagtgatgggaacatggctccctggtaaatgggacacatacatcgggaggtactattttcgtagtctttgtttatatttgaaaattttcaaacttacataatgagaagtcaaaaggggcattttcatcccaaaaaggtaaatgtccatattcttttttattttttcattttcatttctggaattacctaaactcaggtcatagatagcaatgaaaattcggctccctgtggcagcttctttcagccaccagacttacatagactcagtggtgcagagtccgtttcccaatactgagggataaagaaaattaagcctgcctctaggcacgtctcaaacttgggagactcagaatacaacagagtatgggatacagggaggaaagaagagatgcagaaataaattaaaaacaagatttgtttaaagaggaactgcaacttctttaattgggcagattgaaccaataaaagcacagttctctcccttcacctgttatcctttagtctcttcaactttcacattgcttcactcactctcttcctctccctttcacctgctcaccttacccaacttgaactgtgccctctgatctgacacaggatgacaatgacatcagtcattacctagcagccattttttctgataactagagttctgagtgatgatagttcatggtgagataatttccaagacctcgctagccattggtggtactactctccattaaagacaagggcatttgctgattgagaaatcaatcatacaagtgtccttggaggccaccaaggctttgcctgaactgttctcagcctatgatggtttctctttctaaacctgttcttctaggttcagctcaaacatcctctcctatagaaacctttccccatcctcccagtcagaactaatgatttcttttcacttcaactgtacttagtttataatttatatgactataatttaataactgagactcttctgatagtacaaacaggtgctatcataattacctctgggcaacaggcaaaaatcaagattgtccttagtaaaccaggattcataccaggtcatctgatgtttagtatagcactcacccgactctgccttacattgcttatttaaaatgtctgcctccccttctaggttttataaaagttcttggctcacagtaactcttagtataagtttctgaaataaacactttgttatcacttttgaattgatggcttacatttttgttttggcatttaacttcacatttgtgcattcatgtgtatgcatttcaactcatctgcaagcttatatccctcaaagtttgctgctgggctaagagcagccactcaaaaaataataataggccaggcgcagtggctcacgcctgtaatcccagcgctttgggaagctgaggctggtggatcacttgaggtcaggagttcgagaccagcctggccaacatgatgaaacctcatctctactaaaaatacataaattagccgggcgtggtggtgggagcccagctactcagggctcctcagctactcagctattcagctactcaggaggctgaggcaggagaattgcttgaacccaggaggcggaggtttcggtgagcgaagattgcgccactgcactccagcctgggcaagagtgagattccatctcaaataaataaataaataaataaaaaccaaaaaaaaaaataaatagtttttaaaaaatcttgacagcataccagcatacattcattgataaagtcgacaagaaagtattggagattaaagattgccaaaacctaagtgcttttcttggcatcattgtccttgacctcaaggagttctcagtgtaatcagagttgtgttaaggtcagtgagtgaaggaaatgggtactgcacctttgcaagatagtaggaagcaagccagagaagagctggcattccacaaaagagtctttatttgggacaaaaatcaatatgaccaaatcccatcctaatcaattctgtaaactaaaggaatttttaaaaaataatttagcaggaggaagagtttcaaaatcttgtagggaaaccctgatgtaactcctgattattcacccaaagtgaaaagtaactattagtgaatgggttttattttaaaacctttcatttttagaatcttatctcttctaggaaaagtgtagtacatacgaattttttgtatgcagagtgaatttttctccaggcttctctgacatcaatggggcaaggtcataactctataaaacagggagaagcactgagcattttcagaaaggactctatctgtcttgaccaaaagacaaaggactggtcattgcaggatccccagaaatacattttagtagtttccaagtgaattcttttgtaaatggagtttctctccattcataagttttagagcaaaaatgaagccttagtgggtctagatatctggctaacattaactccctgtgtgaccttaaactggtcgtccccaaagctttatgcttttatacaattaacttgatttacagcctctccttcttgcccataagaatgataataccacctgcattactcatcttttacgcttatgtgagacacctagccacctatcagaaggtattcaaatgcaaagcattaagtttttacactttaatgtgaagtggaagaaagtcttgattcaaatgcacaatctctacctttctactgattccacatttgctgtcttttactagtgcagttaagtcccaaattagaaacataagtcgccccaacatgtgacaaatgtcctttgttgccagagaaaggacagtggggctgtgtcctcagccttagcaaccagaagattctgcaagaccaggacattctcctgccagagcctgctttagtgtccagtcctgttctccaaagagatggaaaaaaccaagtggaaaagtttcagtttattcaatataaggctccacattcaaatggcaaaactgctctgttcaggtcatatttcaagcccaacctatgtcagtccttagtaaaagcttcaaagcaataccagtcctttcccagcctggtttaccttgattagacaaacacagacacccatgtctgagtaagcactgagaccatggatgagtgctaaggagattaggtgtttggatagacacagctagggtgtgtgcgtgtgtgtgtgtgtgtgtgtgtgtgtgtgtgtgtagagagagagagacagaggcaaagacagagacagtgctcattgggcagaggacagagtagctgagatagtatcatttgtttattcatttgctttttcataaaatacttagtaagcacctacttggtatgtgccaacactttaataggtactagaaagagcaaaacagacagaatcacagtcttcagagaatttacagcctatggggttaattaaaccaatgattatcatagcatgtaacaaacaaaagagaaccgagaatcagctgtatggaaatgcacacaggtggcagatataaatagcagcagatacacgaatcagtgcgggtccatcatataactcctagctttagtctctaaacttaggctcccactcaactcaactcctactctaactcaagatataccataccttggtttgctctttctctaagcatcgctgttctagtcttctaaggagcaggaatataaatctacatctatgtgaaactacagcacccccaagggaaaataaagaatccagtgctattctagtaattttagggcagtagtacagtacaatgcaaagtataggcttttgaactaaattggcctgggttcaaatatgagccctctcacattctattaggttgaaccatataaaaatggagatattcaatcatttttttacagtttcacgtagttcatctctgtattctagaggtaaatcattttaacctaagtttcatttccttctgttgttagtttttttaatggtgctaatacccctacctttcagggttgtaaatgaaaagatgttaaaaaaaaatacctgacatatagtgggtgttcaataaatgttagttttcccaaagatagtcagatgcatgaatcataataagaggtatttctggtcaacactaagcttaagaatccaagaaaagatatatcaaaatgagacatctttgggtttggatagtgggggaggctgtatatacacaggtatgtatgtaggggcagggagtaaatgggaaatctctggctcttctgcttaactttgccgtgagcttaaaactgctctaaaaaacaaaatctgaccaggcctggtggctcacacttgtaatcctagcactttggggggctgaagcagaaggatccctcgagcccaggagtttgacaccagcccgggcaacatagaaagaccctatctcattttaaaaaactaaaaaataaaaaataaaataaaaaacaaaatccatttttttaaacaaaaagaaaaatgagggaaaatgaggtgttctgcttgttttatttagactctgagcacagagttcccaagatacattctgctgtggtattcacactgatctccaattaaacccttctcagtgtgtcatgagctattcattccctatagtcactctgttagaatagaatcttggtcgtgtcccagaggcctctgttgatgtggcccaactgagctggccagtgagaaaacatacacataaatacccatgatctcagcgattctctcccctccccaggacattccttagcagaaccaatctctctcactcggctggagcctctctgttcacagataggcctggctgggcttaatttagcaaagggcaggccccctgcaaaagccaggggtaagtctggagcccctgtaatgccccaggacaccttgtgtggagacaggagcccagccctgccgaaggagctaaaggggatgttcagaatgtttgtttttctcagctatttaggaactggagctcacaggaaccaccctttacttccttaacttctcacataaatgttttctttgggcagcagctatagaactggaaactaagtaaaaccttactttggaatataaaaactatattaatttttctatagataaattgttgcataggaaacttgctaaatatttttaaattatctgtaacatctaacataatctgacatttatccccaaattcagctttcaattctggattgaaacatactttgatctgttctctaaaaaggacaaagccagtcactggtgttttgcaaagtctgggaccatttttcctacacagaatctcacacaataaacagacaagatattagaaactaagttctaatatctagcagtcactccttccctggaagcctggctgtgtcctgaagccaggtcctatgatcaggcaactcttctgaagctctgcttccactagagacagcacttaccctgtagactctacagatgtaccatccaggatggcaggcatgagccacatgtggctactgaacccttgagatgtgactagtccaaatcgaaatgtgctgtaaggatttcagacttagcacgcacaggagttcaaagactaactacaacaaaagaatgtgacatctcattaataattttaaaatgttgatttcatgttgaaatgataatgttttaaatgtattattaacattaatttcacatatttctttttactttttttaatgtggccatcagaaaaatttaaattacatgtatggcttatatttacgttggacagcactgttctataagatgttaggaaaaagatgtatttgctttaagtactttgcattaagacatagtctgacctgaatcacagttaatcctgtggtctcatagcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccactgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacgaggtcaggagttcgagaccagcttggtcaacatggtgaaaccccgtctctactaaagatacaaaaaaattagccaggtgtggtggtgtgtgcctgtaatcccagctacttgggaggctgaggcaggaggatcgcttgaacccaggaggcagaggttgtagtgagccgagattgcaccactgcactccagcctgggcaacagggacatactctgtctcaaacaaacaaacaaacaaacaaacaaacaaaaaaaccagaagaaagcactggcagtctcttaccgccatatcaatccatctacacatctcgggttacattctctgtctttccacttataaccatagatcaactatccatgctcctatctaaagccaaaccttccacttatgtattaattaagtcctattccccctacctctcaaaggcaacacctagaaggtctcccctgcttctctttatcaatatttcactttctaatggaaaattctgttggcatacgaacatgctattattcatttatctttctagaaatcccctatggacctcatacccttatcaggtatgccccattcctttgctctcctttgaaacaaaactcaaagtaattattcatcctcattgactccaattcttctcctcacattgtttcttaaacccactgcaagcaggcttttgtcttcaccactccaccagaattactttaatcaagatcactaatgacatccatgttgttaaatccaaaggtcaattcttttttgagacagagtcttgctctgttgcccaggctggagtgcagtggtgcaatctcggctcactgcaacctccgcctcccgggttcaagtgattctcttgcctcagcctcctgagtagctgggattacaggcatgcgccaccatgtccagctaatttttgtattttcagtagagaccgggtttcaccatgttggtcaggctggtctcaaactcctgacctcaagtgattggcccaccttggcctcccaaagtgctgggattacaggcgtgagccaccacgtctggcgggccaaaggtcaattcttaatcatcgtattactcaagctctcagcaggatttcaaaaggtggatcctgtcctcttcactacacacattcttcatttggcttccgggactccagactttttctcctacttcactggtttgtaccttctctatcttccttttctgattcttcctcttttctccaaattactaatgttggagctatacaggaccagtctctggtccttttctcttccacctggaaaggtctaactccaactcctttggtcatctcctatggtttcatggctttaaatatttaaatttaatatttaatgatctatttgctgataactcccaaatttatgtctctagccctactctatttcctgaactttagacttacgtattcaactgcttacttaatactgccacataaaatgtctagcaaatagcttacacaccaaatttccaaaactgaacccctactctccaccttcaaatctgctccatccgtagccttccctatctcagttatggcaactccatccttccagttgcttactccaaaaaccctggaattttccttgattcctttatttctctcccattctgtatccaatccattggcaaaatccttttagatttgctaccttcaccacttgttcccacatgcatcactattacctaagtctgatcactatcagcccctacatacattactgcagtgtcttcctaagagtcctcctggtgtctacttttgttctacagcctatttgcaatactgtaaccagatttatcatttcaacaagtcagacaggactggcatttgttagacccctcctctgctcaaaacccttcaataggttcccatgtcactctgagtaaaagctgaagtctttaaaatcatctacagggacttactacacaagccccataccctctggggcctcatcttccagcatgcttaatcttgattatgctgcatcagccacagtggctttcctgatgtttctctgcctggaatattcttcccccagttctctgtttggccaacttcgtcatctccttcaagttgctatttgaaaattattttctatggcatagccactttgaaaaatagttagacagtatctattcagaaaataggcagaaataccgactgggcatccctaatctaaaaattcaaaatccagcatgttccaaaatccaaaactttttgaggaccaacatgatacctcaggtggaaagctccatacctgacctcatgaaaggttgcagcaaaaatgcaggcacaacacccagtttattcagcatccccaagagaaaaacataattaccttcaggctatgtgtacaaggtgtatatgaaacataaataaatttcatgtttagacttgggtcccatccccaagatatctcattatgtatatgcaaatatttcaaaatctgaacacatctgaaaatcttctggttcaagcatttcagataagagatatttaatctatatatacttattatataacctaacagttccactactgggcatttacccaaaagaaataaaacaaagacttgttacatgaatattcatagcagcttaatccataatagcctgttactgaacacaactcatacattcatcaacaaatgaatgaataaacaaattgtattatattcatacaatggaatactactcagcaataaaaatgaatgtactactgatacaaatagcatggatgaaactcaaaatcattattctaagagccagatactatagtctgtattttatgattcactttcaatgaaattctacaatagacagaactatctatcaacagaaagcagatcagtggttttctgcagccagaggtatgaaaggtttgaaacacgtggcaccagtaggacatatggaaacttttttggtgtgatggaagtatttttttatcttgattgtgtggtgtttgttatacagtggtatacatttgttaaaatttatctaactgcatacttaataaagtttatttaaacaaaacatgaaaggaaaaactaaaatgacatagcaagtggcaatgcaaactgccaagtgcaaagaatgagtaaagagcttggttggcatggagactaccagtctaggatgcttttattgcctcaggtcagcttggaaggccataaatgctgtgaaggtaaacctagaaacaaatcttcctgcactggtaactgtcatgtttatttgcttccctttccatcccatcctttcaaaaaaaaaaagtaaaaggtagtgtggtccacaaactaccgtgtggctccccatgatccccgcctcttggtgtttgtgcccttgtgtaactccttctctttgggtatgagcaggccctgcgacttatttctaaccaatagaatatggcaaaggtgaaggaatgtcactcctgtgattatattaaatttcaaggctctcttgcttgcagatttgctctagagcctctccttgctgacttgaagtggccatatggggaaagctcacatggcaaggaacactaggtgacttcaaggaaccctggacagcctctagccaacctctggcaagaagtcaaggccctcagtcctactgctacaaagaaatggattctgttgacagcccaagtgagctctgagtcagattcctcagtcaagcctctagaggagaatgcagcctggccaataccttggctgtagcctagggagaccctaagcagacaacccagctaagcggtgcctggattcctgacccacacacactgtgagataataaatgtgttggggggtgaaggagggatgggggtaggggtggctgtgcatttgggtatggaagggtgttttaaatcgctttctaaacacggcctctcctggccactccttaatactgcaacctgctctccactcctgtaattttttttcaacatttgttttaggttcagggggtacatgtgcaggtttgttacatgggtaacttgcatgttgcggaggtttggtgtatgaatgaacccatcacgcaggtagtaagtatagtacccaatagttagcttttcaaccctcgccccccttctaccttccactggggtaggccccagtgcttattgttcccatctttgtgtccatgtctcaaagttttgctctcacttataagtgagaacatgcagtatttggttttctgtgcctgtgttaattagcttaggataatggcctccagctgcatctcttttgctgcagaagacatgatttcattcttttaatggatgcatagtattccgtgctttatatgtaccgtatttttcctccccagtctactgttgatgtgtatctaggttgattccatgcctttgctattgtggatagtgctgcagtgaacatgtaagtgcatgtgtctttttggtagaacaatttattttcctttgggtatatatccagtaatgggattgctgggtcaaatggtagttctcttttaaattctttgagaaatcaccaaactgctttccgcagtgactgaactaatttacattctcaccaacagcgtataagcacttttctctacaaccttgccaacaccttattttttgtttttcacagtaggcattctgactggtgtgcaatggtgtctcattgtggttttgacttgcatttctctaatgatcagtgatattgagcatgagaattttttcaaatatttgttggccccatgtatgtcttccgttcatgtcctttgcccattttttagttgggacaaggtctcgatctgttgcccaggagtgcagtctgatcactggagttcagtgatgcaaacacagctcactgcagccttgacctcctaggctctagcaatccttccaccactgcctcccaaagtgctggagtttcagatttgagccaccacacctttgctcatttttgaagtggggcaagacccccacttcgtaggactattacttgattgagattaaatatgtgtaaaatgcataacatggtgcctggcttatagtaaacactaaatggatttcttcttccataggatttaaatagggagcaattttttttctatcaagagctgatcagaaataaatgggaagcatttaaatgctctccttcccctgtcccaagaggactttcactttccaacattctacatactttatttataatatttattgtttattttctgtctactcatgacagactataagttctatgaggatgggaatgcctgtatgtgcttattatatgacctaacagttccactactgggtatttacccgaaagaaataaaacaaagacttatacatgaatatattgatatatactccagtcacctccaatagaatctagaacacagtaggggcttagtacatatttttaaatgaatgaagactaatgtttagtttaaactaggattgacctattcttatcttcggcagagacagagaataactaattaccacttgtcacatattgagacttcagtacctaaaaggcattattaggtcacctgtaagtctgttttcccccaaagtaaaaatcccaattccattgcccttttcacataagcctcattttctaacctttttagtttggtttaacgaatttcctatttcctctgaattctggagttccaaaccagactcagcacaagcctaacagggcaacctatacagataaggacagcccaggcacattgcacacggcaagttgcacctgttttaagagtaaaaatgaggtcaatgccaccttgtactgcaggtacctcaatgagacaatgccaccccttcctgccacaatcttggcaaaagtcactacgaaagtaaatatcattttactagagtcctttctttctctccagtgaataacacaatgtagttattcactggaaaacatcatttgcatttgaaagagttactaactaaattctaaagaatgtaccaaagccttgcttaactgtagaatgaggccacacggctgctgggataccaggtactctccctgagcctattgatggcaaatttcatcctgtgaaaaatgggaacaagacacccacttcataggactattatatggttgaaattaaatatgtgtaaaatgcataacatggtgcctggcacacagtaaacacaaaacagatttcttcctctatagcatttaaatgggaagtatttagcgtttacttgccatgtgcatgagtgaatttgggaaaagtggggggaggatatggggcaaagaaggacagaaagggcctaagagtaggaagaatttaataccagaagatgggacaagacctgggtctagaaacctcttctgcagataaagtagctgcaaattatagggaaggagtcctcaggctgctttccttataaccatttattttcctgcaccttatatcaagaacgttaggcactggttaagaccctgtccccttgcagcagtagagaaaacaggaggaaggagacgggaggtagaaatttggaagctagcagttgaaggccaactcagaaagcgtcaggtggaattccattcctaattgacatcaccatcctctaactgcagcaattctctccagcccttttatgtgctccctacagaaccaagcttccacacagctgaaggaacctgtctgctctcaccccagcttcacagaagatggcagggactggttattactaacctgcctcctagtcttctgaggctccaaatggttttgtcagcaagctgagcttccccacaatcccacagactagaaggggttggaaagaacaagccttagaacaatactgctccccacctctaagggatctgctcctctgagtcccagaagttcaccgccttcatttgatttctgctacaggaagactctgggaatccagctctggacccagcacttcctgatttttgaagtagagagttgacaaccctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaagaaaaacaaataagaaaatatgaacaaagcctccaaaaactctgggattatgttaaatgaccaaacctaagaataattggcattgctgaggaagaagagaaatctaaaagtttgaaaaacatatttgggggaataattgaggaaaatttccccaaccttgctagagacctaaacaaatacaagaagcacaaagaacacctgggaaatttattgcaaagagatcgtcacctaggcacattgtcatcaggttatctaaagttaagacaaaagaaagaatcttaagagctgtgagacaaaagaacccagtaacctatgaaggaaaacctgtcagattaacagcagatttctcagcaggaatcctacaagccagaagggattgggcccctatcttcagcatcctaaaacaaaacaattattagccgagaattttgtatccagtgaaactaagcttcatatacgaagagaagatacagtatttttcagacaaacaaatgctgagagaatttgccactaccatgccagcgctacaagaattgctaaaagaagcttcaaatcttgaaacaaaacctggaaacacatcaaaacagaacctctttaaaatataaatctcacaggacctataaaacaaaaatacaattcaaaaaaacaaaaacaaaacccaaaaaaccaaggtatacaggcaacaaaaagcacaatgaacggaatggtacctcacatcccaatactaacattgaatgtaaatggccgaaatgcgccacttaaaagatacagaattgcagaatggataagaattaaccgaccaactatctgctgcctttaagagactcacctaacacataagagacttatctgacacataaggactcacataaacttaaggtaaaggggtggaaaaaagacatttcatgcaaatggacaccaaaagcaaaagcaagcagaagtaactattgtttttttgttttttttggtttttttgagatggagtttcactcttgtagtccaggctggagtgcaatggcgcgatcttggcacactgcaacctccgcctcccaggttcaagcaattctcctgtgtcagcttcccaagtagctggaactacaggtgtgcaccaccatgcccagctaatttttgtatttttagtacagataggtttagtacaggcaggggtgatccgcctgccttggcctcccaaagtgctaggattacaggcataagccaccgtgcctggcccagcagtagttattcttatatcagacaaaacaaactttaaagaaattgcagttaaaaaagacaaagagcggcattatataatgataaaaggccttgtccaacaggaaaatatcacaatcctaaacatatatgcacctaacactggagctcccaaatttataaaaccatcactaatagacctaagaaatgagatagacagtaacacaataatagtgggggacttcaatatgtcactgacagcactagacaggccaatgagacagaaagtcaacaaagaaacaatggatttaaactataccctggaacacatggacttaacacatatatacagaacattccatccaacaactgcagaatatacattctattcaacagtgcatggaactttctccaagatagaccacatggtaggccacaaaacaagccgcaataaatttaagaaaattgaaattttatcaagcactctctcagaccacagtggaataaaactggaaatcaactccaaaaggagctttcaaaaccatgcaaatacatggaaattaacctgctcctgaatgatcatgaaatcgagatggaaattaaaaaaatcttcaaattgaacaaaaatagtgatacaacctatcaaaacttctggaatacagcaaagtcagtgctaaaagggaagttcatattcctaaacacctacatcaaaaagtctaaaagagcacaaacagacaatcaaaggtcacacttcaaggaactagagaaacaagaacaaaccaaacccaaaccagcagaagaaaggaaataaccaagatcagagcagaactaaatgaaactgaaacaaacaaacaaaaaatacaaaagataaatgaaatgaaaacctggttctttgaaaagataaataaagctgccgggcgtggtggctcacgtctgtaatcccagcactttgggaggccaaggtgggcggatcacaaggtcaggagatcaagaccattctggctaacatggtgaagccccgtctctactaaaaatacaaaaaaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttataggtgggaattgaacaatgagaacacatggacacaggaaggggaacatcacactctagggactgttgtggggtggggggaggggggagggatagcattaggagatatacctaatgctaaatgacgagataatgggtgcagcacaccagcatggcacatgtatacatatgtagctaacctgcacgttgtgcacatgtaccctaaaacttaaagtataataataataaaataaaataaataaaaaataaaaaataaaaataaaaatacaaaaaattagccggacgccatggtgggcacctgtagtcccagctactcgggaggctgaggcaggagaatggcatgaacccgggaggcggagcttgtagtgagccgagatcgcaccactgcactccagcctaggcgacagagcaagactccatctcaaaaaaaaaaaaaaaaaaaaacctagaagagatggataaattcctggaaagatacaaccctcctagcttaaatcaggaagaattagatactctgaacagaccaataacaagcaacaagattgaaatgctaatttaaacattaccaacaaaaaaagtccaggaccggatggattcacagcagaatgtaaccaggcattcaaagaattggtaccaatcctattgacactatttcataggattgagaaagagggaaccctccctaaatcattctacgaagccagcatcaccctaataccaaaaccagaaaaggacataaccaaaaaagaaaactgcagaccaatatccttgatgaacatcgatactaaaatccttaacaaaatactagctaaccgaatccaacaacatatcaaaaatataatccaccatgatcaagtgggtttcataccagggatgcagggaggtttaacatacgcaagtcaataaatgtggtacaccacataaacaaaattaaaaacaaaaatcaccatgatcatctcaatagatgcagaaaaagcatttgacaaaatccagcatccccttatgattaaaactctcagcaaaatcagcatacaagggacatatctcaatgtaataaaagccatctatgacaaacccacagccaacgtaataatgactgggggaaaagttaaaagcatttcctctgagaactgaaacaagacaaggatgcccactcacaccactcctcttcaacatagttctggaagtcctagccagagcaagacaagagaaagaaataaaggggatccaaattgttatagaggaagtcaaactgtcactatttgctgatgatattattgtttacttagaaaatcctagagtcctccagaaagctcctagaactgataaaacaattcagcaaaatttctggatacaaaattaatgcatgcgaatcagtagctcttctatacaccaacagcgaccaagctgagaatcaaatcaagaactcaaccccttttacaacagctgcaaaaaataaaataaaataaaatacttaggaatatacctaaccaaggaggtgaaagacctctacaaggaaaactacaaaacactgctgaaggaaatcatagacgacacaaatgaatggaaacacatcccatgctcatggatgggtagaatcaatattgtgaaaatgaccatactgccaaaagcaatctacaaatttaacacaattcccatcaaaataccgccatcattctttacagaattagaaaaaacaattctaaaactcatatggaaccaaaaaggagcccgcatagccaaagcaagactaagcaaaaagaataaatctataggcatcacattacctgatttcaaactatactataaggccatagtcaccaaaacagcatgatactggcataaaaataggcacagagaccaatggaacagaatagataacccataaataaactcaaatacttacagccaactgatcttcgacaaagcaaacaaaaacataaagtggggaaaggacacccttttcaacaaatggtgctgggataattggctagccacacgtaagagaactaaactggatcctcatctctcaccttacacagaaatcagctcaagatggattaaggatttaaatctaagttctgaaactataaaaattctagaaggtatcatcgaaaaaacccttatagacattggcttaggcaaggatttcacgaccaagaacccaaaagcaaatgcaataaaaacaaagacaaacagctgggacttaattaaactaaagagcttttgcacggcaaaaggaacagtcagcagagtaaacagacaacccacagagtgggagaaaatcttcacagtctgtacatctgacaaaggactaacatccagaatctacaacaaactcaaacaaatcagcaagaaaaaaacaaacaatcccatcataaagtgggctaaggatatgaatagacagttctcaaaagaagatatacaaatggccaacaaacatatgaaaaaaggctcaacatcgctaataatcagggaaatgcaaatcaaaaccacaatgtgataccaccttactcctgcaagaatggccataatcaaaaaaataaaaaaatagtagatatggatgtggatgcagtgaacagggaacacttctacactgcttgtgggaatgtaaactagtacagccactatggaaaacaatgtggagattccttaaaaaactaaaagtagaactaccatttgatccagcaatcccactacagggtatctacctagaggaaaagaagtcattatacaaaaaagatacttgaacacgcatacgtatagcagcacagttcacaactgcaaaaacgtggaaccaacccaagtgcccaccaatcaatgagtggataaagaaactgtggtgtgtatatacacacatatatatatatatatgatggatatatatatatatatatatgatagaatactactcagccaataaaaggaataaattaacgcattcacaatgatctggatgagattggagactatcattctaagtgaagtaaggcaggaaaggaaaaccaaacattgtatgttctcactcataagtgggagctaagctataaggatacaaaggcataagaatgacacagtggactttggggactcaaggggaaagggggggaagtgggtgagggataaaagatcacaaatagggtgcagtatatactgcttgggtgatgggtgcaccaaaatctcacaaatcaccactaaagaaattactcatgtaaccaaacaccatctattccccaataacctatggaaatgaaaatacaaaaaataaaaggaaaactcaagctggaaactgtttagggcaaacctgcctcccattctattcaaagttatctctctgctcactgagataaatgcatatctgattgcctcctttggaaaggctaattagaaactcaaaagaatgcaaccttttgtctctcttctgtgacctagaagccgcctcccccactgcaagttttcctgcctttgcttcaagttgtcccgcctttccagacctaaccaatgtacttcttacatacattgattgatgtctcatgtctccctagaatgtacaaaaccaagctgtgccccaaacaccttggtcacatgtcataaagacttcctgaggctatgccaggggcacgtgtcctcaaccttggcaaaataaactttctaaatttactgagacctgtctcaaattttcggagttcacagtgggcaagactagatttacttttgtgttgagcagatactgagcttgactgatgagaatctggagtgtgaggtctgacggagtaactctgagagaggaagctacctgtgtggtctcagggagaagatctgagacttaccaagaaaaagtgacctgaaagaactggctgacttcaggcccttgaccagtgcctagaccctctttctgcagctccagatcatagccatcatgctggcagcctccctgccgctcatccaggcaccttaaagaagggcttcctcttcccaagcctctgggtgggctttctaaagccctgtgtgcatgaagaggtggcttgtagccctttgcagcagcagggcttacatgaggctgggatatgaaaagctggcattacaatgcagcttgtgccttgcattcactccccacttcatcaagccaagtttctaaataacagggatagtaactgcccactgtggcccaatgtcacttctaaagttgcttggcaaaaagccacatgactattacttagctctccacagaacggcatgtaccaagtcggatcactgctgtcggtgtgtgggtggattagctgctattgaacatgatagggcgggcccctttccagtttgcaccagccccgctctgtgcctactccatgtatcatagagcctcctctctctgtgcagttgaacttgatcagatgagatggcaaaagccagagcagggagcaaggcaaaagagaaaaatatgttcacggtgacttttgaaaacatatggatgaaactcctgaggaggctgaggaactaaaccttttcttttggcagtaggcacagagtgcagattcatctctctgtgaattactctagctcctgctgtgtgagttctattttagcccagtaatgcaaaaagaaagaaaaactaagttctgacaagcacttacatttcttgaatttttgttgaaggtcccagaggtcattgtaagcagcctgaacaggtagttagggctcctggattctagtctcagcttggctactaatttaccgtgtgacgttaggcaaattactattctgagctttagtcatcttatctttaaaatgaagggtttattctttagaggaagctgagtgaatggcatacgggaacactctgtactatttttataactttgctataagtctaaaattatttttaaataaatggttttcttaaaaagtgaaaggattatgtagattatcttcaagatcctctctacctctgaataatgattttatgttcttacttatcttccttcaggtgaaagtaagtctctttccagctatccaaacatataacagagtggaatttttcctcactccttctgccccaggcaagatgttgatcagccccaacacaaacctgttttctgctttaaacatatcctatacctagggcaaaatttaaattatctaaaacacatttaaaaacaccccatccatacccactttgttctttcaaacaagtaaattcacccagcagggaaaagctgttgctggcagtccatgcctacagaatctcagccttgccctagcaacgaggctaattataactccggctacctggtaaccgcactagatttccctgcattggctggcagttctaaagccatctcagctctgcctgccacctcccatcctgagaagctgtcagagaagctgagaaactatgagtctcttttaagcaactatctaagctgtggtgagaacacccatgtatcatagagcttcctttctctgcgcccagagaaaggctgcccagaatcacaggacttcagaactgggagggatgtgtgcgtcaatcctggtccagcccactcatttaaacacaaagaaccagaagcccagaaaaagtgacttgccttagcctggccttcctcttgattcctttccctcaattctcccgtcctgatcaatcatcaagtcctacaaatattttacctcttaaatattttaaagatgagttgcctcccctctattcctactgccacagccctcattcgggccttcatcttctttggcttggcaagtctgttctcactcacttcctgccttgactctcttgaatccacctttcccatgcatcagagggatctagcaggttccctgcagcttaaagcccatcagtggtgccttgtcttcttcaggataaagtctacactctttaaaatggcacaaaagactgtgtccgtcatatcagtctcattcttcgcctagtacttaaatccaccaacaccaaaccacttctaattctgtgcaagcaccctatggtttcttgcctcaaggcttttgcttgtgacaaaaactctgtccttccacttcatcatccattgactgattagtgcttattcccctttgaagacgaagttcaggggtcatcacgaataatcctttgcagattttctttccatccactctattcatttgggatagaagtgccccctttgagttgccttacactttgtacacagctctgttactgccttttactatactctagcacctgtggtttactcatctttgaagtcccaacttctagtacttggaacatagcaggtacctaattaatgtttattaatgaatgaatggataagtccaaagctttccatgatttctcccctgcagcctcatcttaccaccaccacaagccctccaaaccacatgatctagccatactgaatgattccagtgtgccaagtgcacattgcttttgtacacctctgcttttgtatattgtttcttctgtttgaaatgccttttcccaccaggcgcggtggctcacacgtataatcccagcactttgggaggccgaggtgggtggattacctgaggtaaggagtttgagaccaccctggccagcatggcgaaaccccatctctactaaaaatacaaaaattagccgggcatggtgacacacgcctgtaatcccagctacttgggaggctaaggcaggagaatcgcttgagcccaggagacggaggttgcagtgagccgagatcatgccactgcactccagcctggctgacagagcaagactctgtctcaaagaaaaaaaaaaagaatttctggattttccaggcatggtggctcatgcctgtaatctcagcactttgggaggccgaagtgggtggatcacgaggtcaggagattgagaccagcctggctaacgtggtgaaaacccgtctctactaaaaatatgaaaaattagcgtatgtttcacagcatctgtaatcccagctactcaggaggctggggcaggagaatcgcttgaacctgggaggtggagattgcagcaagccaagatggcgccactgcactccagcctgggccacaaagtgagactccatctcaaaaaaaaaaaaaaaagaagaaaaaagaaatgccttttcccatttcttgttatgttactaccttttaggattcaatgcaaacttcaaacacttggcaaggcctttcctggtggattttattgcactatagcaaaatctgtccatacctctatggtagcccttattataccatttttatttatttgttgatgtcttctccaccagaatctagcacagtagctggcatatagtagataatcaatagacgtttgactgaatataccaatgcatatgcgcaaatatgagcaaaaaaatgactaaaatgatattgcaaacaagggaaacatttgagacagaaatttagaatgtctatttttttcaagtgtaacatgctacttctatcagtgcataaacctgaatgtacatacactatagaaagaagtggccttgtaataagttcatgcagaagtataaattatgtagacattgttagggggataactgaaagtggattagaattaaattagggcccagaatttagtctgggatttgttttccagtggttgaaagaaaaattcctaagtattcaaagggaagaagcatttctcaacaggcaagtattatgaattctaattaaaagctctgaaaaaatgagataagttgtgttaaggaaaagcagaaaacagagttgcctttggttaagagttccactatttttataagcaactgacttttttggggaaagttgctttaagcatttttttttctgtgtgtatgtgtgagatggggtctcactctgtcacccaggctagaatgcaggagcacaatcatggctcactgcagcctcaaccttctgggctcaagcaatcctcccacctcagcctcccaagtagctggtaccacagccacacaccactatgtcagctaattaaaaaaaaaaaaatttacagagatgcagtcttgctatgtttcccaggctggtctcaaactcctgggctcaagtgatcctcccaccttggccttgcgaagtgctgggattactgacatgcgccaacatgccaggcctaaacattttgtgtgtgtgtgttaaaatatacatataataaaatttgccattttaactattttaaagtatatagttctatggcattaagtacattcacatagttgttcaaatatcactatccatctccagaactttttcccaaatgaaactgtagccactaactccccattccctcctccccacaacccctggcaaccatagttccactttctgtcttcattatttgactactctaggtacttcatttaagtgaaataataaatatttgtcctttagggactgactttacttagcatgacatctttaaggttcactcatgttacagcacatgtcagagtttcatacctttctaaggctaaataatatccagtgtctatatagcccacattttgtttatccactcatttgtcaatgaacacttgagttgcttccacctgttggctactgtaaacaatgctcctatgaacacagaaatacaaatatctatttgagttcctgttttcatttattttgtgttatacccagagtagaattgctggattatacggtaagtctatgtttaattttttgagaaactccatactggttttcacagcacctgcaccatttcacattctttctagcaatgtgcaagggttccaatttctccacatctttactagtatttgttattttctgggttgtttgatttttagtataatagccatcctaatgagtgtgaagtttgaaaaaatatttaaccaaaatcataaatattggttacaaatatttaatggatggattccctctatttctgccaactttcattccctgaaagaagaaataggtaagcatgacctcacgaacctcagaaggctgagaatggggaattggcacacacagtgtgcgtagacacagacacacatggaccatgttcatactaggcttccagagaaccatttaaaaatagtttggctaatgtaatcttgtctgtctcttatgttcctcctttcccatcatacacatttcttaaagttcgtgtaagtaaaacataggagaaaaaaacatagccactaattaaataaggcatccaagtgtaaaagaagagcaaactctgctacatataagaagacaagcattaattctggcaacagcagccacacagccactttagacaataacctgagcaggtgcatgctttctagtatgtgtctccagctatgcaggatagaaatcacaatcctttctatttatctaacgtctaatacactaaaacatgtttacccatgggggagaagagcacgacaggaattgatgactctaatttaggaaactaaggttcacagaagttaagtgacttggccaagatcatgtagctagaaaaggcaggttaagaattcaggtttccttagagttcaaaacttttatcacaacatttttgataaccccccaagatactcatccttctctaatagccttcctttggttcaagtccagcttcctaaatcctaccgcctgatggagttcctgagcttccttgtaagtctgcaggtatattgttcctcatcatgttgcccaaagcctaaagaaatcaggctaggaccaaagaaaatcagtcaatgagccaaaaagaaatttaatcaacccagcctttcttatttattttctttgaatgaacatttgtatctgagaatgccaaggtaaatttgatgcaatagggacacttggattatattatgttatttacacacaagcaaacaaaaattgagaattgagacaaataggacaaatggtcccaagtccactattgaggaaaaagaaactgatttggaataaaaaatagtccagcatgaatgtgtcagtaattaagacttatctggataagtttgccgtctctcaatttgtcacaataatggcaaatatttattgagagcttactatgtgataggcattatgctgagttcagctaattgactcatttcatcctcctctagaccctataagataggtgttattactgcccttgctttagctcagagaaattatggtatttttcccaacacaaatagtaagtagaaaaatcaagatttcaccccaggtctcgccaatttatagctcttagccgttatgcccagcaataacagaatagtaaaaacaaggacaatttggtaggcaagtaaaatcagtaggctgtttaccatagctatagaagtatgctatgcataaacctcaaagattgcgcaggaaaagtatcatccaatctcaaagatgagaaaaccaaagaagtttcaatctcagagaagtcaggcagcttaagggtcataaaacaacgcaacacaactctctcaactcatatctaagggctaagtccactttaaccttccaatatcattacatcatatttaaacattgactctatctggtcaaggacgacaacattttatttctcctgacccttttgctatcagatctggccttgtcagtttttcaatttcattcttagaatggaaacttaattcacacaagttgaacaagtagtcatcagggggcaaaacccagtggatgatggttttgtgtgctgtttggagactgggtgtttaccacacagcagtggatttcataaattccagggtcagacaagattccagtagcgacacacttgactaatatgagaaaatgcaggattaggcaatcaacaatgaggaagtcagccaagttgccacccaaaaattacttaccacagcagctgcagtccagaaatgctaacaagccagtctccctaggagtgggccatactcagctgtggaccactcacaacattttctcactttattttgcttcagagtcagtgtactgcaatgatttctcctttgcttgctttatatgtttaaaattgtcttccctaaaagctgaacttaaaattaatgtttgctaccaaaagggggtagcagtgcctagtcatgtaggcatatgtcccactctgtcggtacagagggtaagcagcctcttcctttttaaaaaatttattacgatgatttacaaaaattgaagcttacaggataaacactcaacaaaaaagtagccagtctcaagaaaccaatttttatgtatgaattaatattattttattaatccatggccaggatgattcttaagattatttcttaattctctgaacagcttaaaagagagaaactccttcttttttatttacttgctttgaggttgatactcttaggtttttaacataactctctagctttgacaactcctcttataatttaaaatccttatagcttccatttacaagtaaggattatatctattttagtctcctcaatcagctacctaggagaagacttgccacttggaaagagaaagatagcacccactctccagttctcttctcccaaagttgcccgtatttcccttccctgaagccaatcaaatactttattgtttctcgctaagagtaatttttcactcttaagtacaaacagctcaacaaaaattcccggtagcataaatatgcacatcaataaaataattactactcacaatagactttccattacatatgtttcacaagcattggttttcttaaaaagaaccacgcatacagcactcaaattattgcagattctaactcagtagagtttgatttaatgtttttacaatattttttttaaagaagtgtccttccaacgctaaggaaaaaaatcagaatcaagaaaattctgtttcttagcaacagaaaaatcaaacttctgttactaagtttggtaacagaacagtactctaaattatcctctgaaccacctgatttaccatgtgatgctgggcacattgctgctaattaatcttcctaatctcgtgggatcacaatatgaataacaagaatgaacatcagacacatctgtgggaattatgagggggagattataaagagtcaaaccttgtccccatatttaaattttataataactataactactagtagaaatataactactaccctctcatatatatgtgatgttattaagtttataaagtgttttgatatgtttcttatttcatcttcatggctgctatttattcatagaaaaataattctcagtatctgtagcattattgttaatgtcaatcctatagaggctggaacaggctcagagaggctaagtaacttgcctaactaagtctcctggttgacaataggtcttaatgcagtgttttccgaatccctcgttcttacatcaaaacagaactgtggctgggtgtggtggctcatgcctgtaatcccagcaatttaggaggccaaggtgggaagatcacttgagcccaggaatttgagaccagcctgggcaacatagtgagtgagacctcaatctctgccaaaaaaaaaaaaaaaaaaatacatacacacacacacacacacacacacacacacacagacacacacatatatatataaataattagccaggtgtggtggcacacctgtggtcccagctacttgggaggctggggtgggaggatcatttgagcccaggaggtcaaggctgcagtgagtcgtgacggtgccactgcactctagcctgggtgacagagcgagaccctgtctcaaaaaataaaataaaccagaacggctctagttcctatcaatcactcatcatgacatagtgtggtaaactaatttcaactctgaatgattgataatggctttatgtgttctgtttcccaagtaataagaacattttagcacaagcctttagcgcttttcaaataatcatagccaaatgagaaaattaatatgacaggcagattgaacaaacatttggtgagaaggaagaggaggggatacagtagtttgagatccctcaaatcatatgatgcagtagctgcctgacaactctgctaacacgtaagactagatagagacagggccatatctacttcctgtatgggacccatggcaatactagagtctagcaaaagggttgtcctctctgcatgtgacaataggctgtgttccactccccccacatacaccttgtgcagctcctataatctcatttatcacacttctccaggtgagaaatggtgccttctcacaccccacccaaagttgtttcctaaagatctttcgctagggcggagcagagagtgagatcaaatgattcagacagccatctgattcagctttaaaaaaaaaaaatcctggtgggggcgcagtggctcacgcctgtaatcccagtactttgggaggctgaggcgggtggatcgcctgaggtcaggagtttgagaccagcctggccaacatggtaaaaccccgcctctattaaaaatacaaaaattagccaggtgtggtagcaggcgtctgtagtcccagctactccggagaatcgcttgaacccaggaggcggaggttgcagtgagctgagatcgtgccactgcactctagcctgggcgacagagtgagactctgtctcagaacaacaacaacaacaacaaaatcctttccctcaaattacctaagaaattgtcctttccttctttgccctgaagacagttaatggggaaagttcctccctctgcacagtgaataaatccatccactattcctaccctaaccctaaggcaaaacctcccactcatcctctgtctctcgccatctctctgttaccaaccctcacttggcaatatccttcttgacacgtggcagctccaatgaggcacactcattacatagccacgtaaaagataaaaggtgaatctggaccaacttctggaaaatttggacttaaaacatggaaatgcaggagagacaggaaatagagttaaatcccccagatttagctatacacattaattgaattaactaaataatcatttgggtctcatagacaccagctatttccctgatccaagatgttatctagcagcctgtatcgcttcccagtcatccatcctcttgacaggacagagcacacatagaaaatggtatttgtatagtcctctggggtaaacagttggagagttagaatctctgataaggtcagaggcaaccagtccccggtcacttgggccacttcaggtcctgcttgtccagacacagagagggctgaggaaaccaatattgtggtgaccagctacgaggcttaatcctcataacccatagcccaatgtcctcttatcaaggtgctgtcctatctcacccacagctcagccaatccagtaggtcttccttccccaccctgatcactgacccatcaatcaagatagccctcccatccaaggaagaggccatttcccctcccactccacccaggccaactgctatcccacaggttactctcttcttcattttaaggcaagctattccaaagactaaaaatgcctaagattctgtcttaaaagcttatctgcatagtcatcttcaaaagcaaacatgaatttctcaaggaacggaaacacccttagcccctgcccttttctccatagcatcattctctgccccaccaagccggaactaggagggcactttctctaggagaggtatgacctggagatgatctgcttcagagccacctcagggatcttgcttaaaaatgcatattttcccaggcaaagtggctcatgcctataataccaacaacagtggaggctgaggtgggaggatctaaaggccaggagtttgagaccagcctggacaacatagtgccacccctttggtacgaattttttttttttttttttttgagacagactcttgctctgtcacctaggctggagtgtagcggcgcaatcccgtctcaccgcaacctccgcctcctgggttcaagcaattctcctgcctcagcctcccaagtagcttggactacaggcatatgccaccacacccgctaatttttgtactttttaagtagagatggagtttcaccatgttggccaggctggtctcgaactcctgacctcaagccttctgtcttccttggcttcccaaagtgctgggattacaggcatgagccactgtgccctgccaatttttttttttttaattatctgggcctggtgtcctgtgcctgtggtcccagctgctcaggaggctgagccagaaggcatcacttgagcccaagagttggtggctgcagtgctatgatggtgacactgcactccagcctgagcaacagggcaagaactgtttctaaaataaataaattttaaaaatgcaaatatccaccccagccccaccctctccccccaccttcccccacattactacatcggaatccctagggtgaggcatggaatctacattttaaaccagctcccaaggtgattgttccgcacagttccacgtcagtgtttgagagaggctctgatttattccagtcctctttctttacagagaaggaaagcagaaagcaggcaccagagaggtgaaatgagcttgtccaaggtcacaggttgttaaggtgaccagagctggacgaaaccccacctctctcgctgactagcacagcgccagctaggaagagcctagaatagcgaccaactggcaggccaaaccgtcccctgcccctgcccctgcctcggagaagcgggcccctgcactcacccgcttgtagatgtcctcccggctggcctcatacttctgttgcatgcgctcctccaggaagtagatgcgcagcttgaggctgaagttctccttcttcaggtcattgaggtgctgggacagagtgcgatatccattagacatgatgggcaacccatggggaggagcgtgcccgattgccccctcaacccaggaacatggtgcagctgcaccgcagcatgaagccagccggctgggacgctgctgaggctgcggaccgagaggctggggctacggcgacatggcccctattgctggagctctctccgggactcgggactgggctcactgctctgggtgctggagcgcagcacactttccttttttacctcagggagatatttgcggaatccctgacagaggaacatgctgcgtgaactcagacacaagtggtgtaacccgactccaagccaggactctgctgtcaccctcctggagcctcccaggcccaactgtaggcagttaacagcttctcggaaaagagagactgacccccaagagcttccaggaaagggggaggggagatattcaaggtgacagtgggtttgcaaagaagagaaggaaatagagggtggggagggggtatttaaatgacttgtggctgatttggactataagaccaaaaggagtgtggccagaagcaagaaataaggttgctatagaaaagaccatgtacataaaacggcccacaaaggtaaccgcatgtcaaatatcccctttctgtccagtgcaaatcttaaagagcttctaaccagaggagtctcaatttcctttgataatccagagctcacttctaatgagttcctttgcagttttcagccccaagctttttgagctctgaggcagttcaactaatagcctttattgccatgagccttcccccgaaacacaccatagctacccgcaaagaaagagcaaatcttctagctcagcggaatctttgcagactctatttaccagttacaaagctcagaaagaggcagggtcaagggatcctccctccatggaagaagggatgggcagaagagagtgtgggaggatgacagagagggagccgtcatcctggagcccaaagatttcaggcagtcactggttcttaactctggcacctgccaagtggagccgggcactcatcaccagatcttgctcctaaagtaatttaagatccttgagtgacagctgcaacattagcaggaagtattatttataccacattacattgaaggtgatgggagacaaccccagagcacagataacaaacacgggttctttgtggcaataatattaggttgaaaaaatatatattaacattcaagataaaggaaactacaaaatttacacttaattcaagccctcatttcctccccaacctacctgcttttcattcttccaattccttctcaaaccttcataatcattccagtcaacaactcctgagtactcaccaggtaggacattgggcatgagggatatatagatcaagaatgtcccaaccctcaaagagctacgtggccatacagctggccatgatatgttaagatatgtgttttacattatgatcctccaaacctgtgtttttcaacttttgtatgttacattgccatctagtacatatgcatacactcttaactgaagtaaatgtttcaaaaagtaattgtcaccatcactatgtgtgatgtcctctgatatttcctatttctttttctgccagtgacccacccgacggatttcatgacccactaataagtttcagcctgagtttaaaaaacgttgactctgggggagcccgtaagaaagagtagtcagttcttactggggtgatcagagaaagcttcattaggagttgaatttgcactttgccttgaaaaataaaaaatgtttgagtggataaagtggccccaggagggcataattagagtgaagcattctcccaaatagatttagattataaataggcaaaataggcaagcccaaatatttaccatttgaaaaaaaaaaactacacatttaaaatccatttaactattttcactaaatctgaattcttagaatttgagaatgccaactaggcttagttagagacagtgaagaaaaaagtctaagttaaaacaactcaaaatatccttttccattcccagttctcttactaaatagctatgttatagaccatttctctagaagcctaactgtcctcacttaaaaaatgaaatggctttaaaaattggtgattttttttttttttgagacagagtcttgctctgttgcctaggctggagtgcagtggtgcaatctcaactcactgcaacctctgcctcctgggttcaagccattctcctgcttcagcctcctgagtagctgggactacaggtgcccgccaccgcgcccggctaatttttcattgttttagtagagacagggtttcacagcgttagccaggatggtctcgatctcctgaccttgagatccgcccgccttggcctcccaaagtgctgggattacaggcatgagccaccgcgtctggccaaaattagtgatttttaaggccctttcctggtctaagctcttcaaggtgataacccagttaatatcacctccattttgctcaaggggagccaggctgccagagtttagataagtgtttaatcatgctttggctgtctacttagattcctttatcaggtaaaataatttcataaaagttttacaggaagtaaaactgtgtatgaatccagggtattcttatgcatcctagatttctgttggacatttatgcttatttcctccatgatatcttgttcttctatctctctggatccttttctgtgttttttgccagctcctgaaagtgggtatttaaatgatggtaagtcctcagccttctacttttttttctcttcacatttttatccatggaggttttatccacttttagggctatactttcaccttcgaaacaattcccaaatctccaaccgagtcttctcacccaagatctagccgtacatattcaactcttggcttagatcattcaacttgagtgttcccaaattccacccaagcaaagcctttcctcttaccctagcctggaaagacttcttcctcttttgaactctaaggcagatattaacattcaacaagtgttcatatgctgccttatgatgtggcttttgttatcttgaagggttatttacatcttttagggttacgtgactttttgtgtgtttgatctttccaactagtctgaagctgcccaaggaaaaagtcaatgactaactaatgcatcttcataaactcctacagcttccataacaacctgagacctctccaacagcattcatcccattgtgctgtcacagtctgtttacgatgacctcaacctggctagagtgttttgagagctgacaaggcatattttgtgtccttgtattcttgttgcatagtactcaggaagcactccctaaatatttgtggaatcaatgaacaggaaaatattccataaacattgtacgttttgctttgttatatatgggctggctcacctgtattattctcatagatttccaataatatgaaaaaagtttgttttaatagtcctaaataaactatatttggtagaacacttattctagaagacgtagaaaaatgacgttttgttcacttacatttctaagtttacatgcccaccctgatcttttccctgaactccaattgatatctgactgtctagtagaaatctctgcttgaatttagacatcacatacttgtgatatctaaaactgaactcctgatctttcccagtaaacatgctcctccctcactacaccttttttcaacttgtaacaactcaatattttcagatttttgagcccaaacctttgaatcatttcttgattcattctctctcctacatatcatctgtctgtaaatcttactatgcatattatacattatagtatatatattaataacatatatggtagtataatatatatgttgtagctgttgtattatgtatgtaatatataatactatattatatatactattatactactatatatatattttatatatatgttatactaccactactgccactggtatttctaccaccctgacccacagtactgccatcttttccttacatgatctgaatagccccttaactggtgttcctgctcccactcttgttcccttgtagtctattctcagcacagcagccacagtgaccctttcaaaatacgtcagattactcctctgctggagagccccctggcttcccatctaacttagagtgaaaggtgatgtcccttcaccagactgcaaggcctgaggccctacaccctcttcttgcctctcctattacctcctctacttcttcctaccactctccctctgttctctgctgtagccacactgtttctctttgttatttctcaaaaacaggaagcaagagaagctttcttttccgaggcctttgaacttgttgacccttctgcctggctgctctttctctagggaggtgcacgattctctcctcaccttcttcatctttgattgaatgtcaccttcttggtgaagtgaatactctttaggcaccccatgcctcatcccagctctccaaatcccccttcattgttttttattccgtagcactatcaccttctaaaatacattttcttatttattttgtttcttgtctgtctctccccaccagcatgtaaacttcctgagaaaagtgggatgttttcttagtttgttcactgctgtgtcaccagtgcccagaacggtgcctgatacatagctggtgctcaataaatatttgttgaattaaagaatggatgagtaattaacctgctgatttatttctcattggagtaatacaacttaatcgatacacaagattatgtagatgttttaggataaaaagcatacctagtagcattcctccttataaaaagattataagtaaaataaattactctaacagactcattttaatacaccatgcagaatctggactttctacaacagttccgaacaaatatggaatcgtatatgacaaattataaaggacaatatgaactgtacaaatagtaaaaactgggccaggcatggtggcttatgcctgtaatcccagcactttgggaggcccaggtgagcagatcgcatgaggtcaggagttcaagaccagcccggtcaacatggtgaaactccgtctctactaaaaatacaaaaattagccgggcgtggtggcatgtgcctgtagtcccagctactcaggtggctgaggcatgatgattgcttgaacctggaaagtagaggttgcagtgagcggagatcatgccactgcactccagcctgggtgacagagcaagactccgtctcagaaaaaaaaaaagtaaaaactataaaaattaggaaggagaggtggccagagaaggtaccacagagaattggcactttagcttgtctcaaaggatgagttgagcttggataggcagtggggagaacacaaggcagtccaggcaggtggaacataagcgaaagggcagtgtgcccaccaggccaaagcaaagggcacatactgtcctgaaataggccacagagatgaggggaaataaaaagccgtctcaaggagatcttgaaagccagggtgagaagcctggagtttgcccctccaggatcctggctctcaatctggataagagtgaggggaagggaagtggaggtggggaggagggcagtgggggtggggagggccaggaactgctgactgggaagattattttctttgtgtattgcttaggtttcgttttacttatttgttttcttgcagctttaacaaacatcagcgctgcatgtggaaacttggaaaagaaaaaaaaagctttaacaaacaaaaacacacatacctgagatgcacacggcaacctactagctcatggcaaacaggcctatatgttgataacctctgcattgcttaggaaataaaacactgcagattcttgagcaaggggaagtgcttctatctttgttcttcctttttctcctagtacatataacatctttactctggtctcagaatgtttcttccaaaccttaatggctctccccttctttttccttaatttcttcattccacccctggaataacgttctagtccagactagaaatacaacgtaaataaagactcaatcaatgccaacagtaggaggaggattaccacccagctgttgcctgtcatgccccattaacacaaccaaccgtcaagtctgcctttaaaaaacccagcttgacatttgcttcatcatattcagaccccccagctagctcatataatgtatgtacttgaaaacatattaattgtttaccaatctttctcctaaaaataaagcttcactaacaaaaaatgattaatcttcttaatggacacattcttttcaaatataatcaaacttccacaattttaactgtactaatttgatatctgtggataattcttacctttaccttccttgaaaataaaaatattttaaaaataagttaatacggcaaatagaaaaacagaagagtagtgctttaagtaacccttgacactttacatcaatttacacatagacaataaatatgatcactattatacatatttatctagggtgggtagcgtggaactgtgaaaagagcaatagctttgaaccatgaagaccagcgttcaaatcccggctctccttttttctcattgggtcattttggggaaactacttaatagttaagtataggaagacagtcagaagactgggatctgggcaggatactaagaaggttgcaactgtatctgtaatggtaacttttgttttttcacctgaggaaaataaactaaaaataatgttttctaacatttagatattcaacacatggacaagtgtttaattattctttgtatattcctgttgtttgtaaaacagcttataatttttaaaactattttaaagggaatgaaagtaggaattacagggaggcagttatcaattagatataaggatgaattctctagtagagttagatgtaataaagatattgccacactctatccatatgtttatacatcaaatttttactgagtacatacatcatgagacaaaataaacttcctgtcacaaaaggtgcttgaccaaaactcaagaatcacctttcagggatactgttaaaagttttcccacatcagctaggagttagctctagagggcttttaagatctttggccatcctgaaattctatgcttgaaacacgttttctcatagaaacgctcctaccaaaggccagtgagagaactatcactttgtgaagaatttcagaatgcccactagctctcctgtagccctaaaaggtaatgagagtctacctgttcagactgagagctccggctgccttgtgctacagaagcagtaagtgcatgtaaaggacgccatatttctaagacaaaagcagtaacaatgactcaaggatgatgcccaatagacgatttaacctataactttgctaattgtcatattttcaaaacagccctatgggaagggtacacaaatgtctggggagtatttcctgctttttagcacccagggaactacaaccaggagcccagcttattttggattggggatggggatagacaagaagagatggggcagggagaagagacggctggtttattttacatacacatattttatttataatacatctctgtgtctaggcgtctctatgctgttctcataaaatctgaattatacaaataaaagtttaattcctggctgttttggatgacttgggcctgtattacaaaattaatcagatacaattatactatcttcacaacaacaatcatctacattggttttgacaatgtacaaagtacttccatgtgtattatttcgtttatctttaccacaacctttgaagtaggaagacatgatgatccccattttactgcctaggacagagagacatcaggaggttaactgacttgttcactgagaaagcggaggagcacagactataactccaacagtttgaccccatactgcatacgcatcagggccttaatcatgagactgtatgacccttctgagcctgggattcacttgcaactgggtattccctcttctacctcaggccccctataccttttcaaaaagtgtccttcactgtaaataatcttcctggtggtgaccctaaaggatctgacaacctggatctatgtaaaaaaaaaaaaaaaaaaattgttttcttcattttcaagatgaataaactaaagttggctctcaaagggttaaacaaagagttaccatgtggcctagcaattcctttcctagttatatacccaagaaaattgaaaacatatggccacacgaaatcttatatacaaatgttcatagcagcattactcataatagccaaaattggaagtatttcaaatgtccttcaactgatgaatggataaacaaaatttagcatatccaaatcatagaatattactcagccataaaaaggaatgaagtactgatacatgctacaacacaaatgaccttgacagcattatacgataatgtgaaagaagccagacacaaaaggtcacatactgtataattccatttacatgaaatgtccagaataggcaaatccaggcagaaagtagattagtggtttccaggaaccagggagagggaaactgggaagtgagtgttaatgagtatgaggtttcctattggagtgagaaacacgtactggaattagacagtggtgatggttgcacaactctgaatatactaaaatcatagaattgtaagatttcagaagatgagctgtatagcgtgttaatcgtttgaataaagctttgtttttaaaagaagacaaagaaataaaccaaagctgagagaagtaactaacccaatcctttatcttttataagagtttttttaatgataaagactcagttaaagtccaatttgattcagttcagttaaagctaaatggcttagaatgaatcatgtctaaatattctgtataccaatcctacctatattatagggccctaaaagaagggtcagacgaagtatgctctaagtggctctcagtactgaatattcacagattaagttttacaaaaaggtaaagttttgtgataaccctcagataaaacagaaacatatgacctatgttttgacataaaacatacgtatttggcctgttctgaaagatatgtataattttcacacaccacattctaccaaggaaaatgtcaaccggagccaaccaacttggtgttccactcatcaactcttttatgccaacatggtgtttctgcccttgtctcagaagccaactactgatacctgcttcagaaaactgactatgaattccacaaagtcctgcttttttcttttggattgtacaatcaacaaacaagtcacccttctaaaactctgtttctgaaattttaacataattcctgaagttccagagtctcttaaatgctaaaatattaacaataccattccattttttcccctaacactcagaagcatactgatacccatcctgtacacagccttttcttgcctgataacaagagcactaatgacagagctattgcatcaggttgattaataaaccccgtcttaggcagcctcatcatgtggataaagaaaaggagttaagatgatgttcctgctgccttccccaacatagaaacacacccacaacacccccaatcctggaataaccagatgttatcttcatcatcacactagagcactgtaaaccacatcaaaacaaaacgaaacaaataacaacttccctggccaccaaaaatagatggcccagccagaaatagtgctgccagaggcagttaaatgagctgcaaggcaggaatgacagttgagctgcagtgatgctggggcctcccaaggattaccggactccaaactagattctccatcactttggtccaatcaacatcagcaggacttggtatttgttcacaattggttcaactcagattatttgctgagcttctggaattcagagagagtgacttatgggctcacctttttctctagattttaaataatcctttctccatttttttctaggagtgaaggcaattttgaaggcatgactacgacctgctctggccacaagagctaagagttgccaggtgttgtggctcaaacactttgagatgccaatcccaacactttgagaggccaaggcaggaggattgcttgaggctaggagcttgaaaccagcctgggcaacacagtgagaccccatctctacaaaaaataaaaaaacaggccaggcgcagtggcacttagggaggccaaggtgggtggatcacctgaggtcaggagttcgagaccagcctgaccaacatggagaaaccccgtctctacaaaaaatacaaagtttgccagtgtggtggcacatgcctgttatcccagctactcaggaggctgaggcaggagaatcgcttgaacccgaaaggcagaggttgcagtgagtggagatcacgccattgcactccagcctgcgcaacaagagtgaaactccatctcaaataaataaataaaataaagttttaaaaagtcaaaattatccaggcgtgatggtatgttcttgtagtcccagctactcaggaagctgaggtgggggatcacttgaatccgggaggtcgaggctgcagtgagccaagattgtgccactgcactcaagtctggatgacagagcaagaccatgtctaaaaaaaaaaaaaaacaaaacaaaaccaaaaaccaagagtccacagtgataccatgaatgcccatggctgcaacaataatgccttgaccagaagtagggggataagggaaaagatagagccaacatgaaccccgattgaccctcccttgctccatccatgacagaaagcctcctatttctgaattcaccaggctcatgctgcctccaggactttgcatgggtagcagcattagcctagaatttcacttctctttaattcccacccatctctcacttaactaatcccaactcacccataaggatctaagtcagatattacctactaaaagaaacctatctggccctaatgcctgggcaagggcttctcctgaatgcttccacagcactgcggacctactcttattgtggcccatttcacagtatattgggattatctgtttgactctctccccagtagatctggagttccttaacaacaggaagaatcttctttacttttcttccaaaaacagaaatcgctttactgttttttgtttgtgttgctgttgcttcagtggtcataaaagtactacatgtgcctgtctgttccagttgttctctttctcagtggagggcataacctagtagttgaccaagcaagaaaacttgacatcatttattcgttcaaaacaaacaaaaaagaagaaaagaaaagggcatgcctactatgtaccaggcattatgctaatcactgtatctagaagtgaaaagacaaccactgtccctgctatagtgagctcatgttctaacagaaaaggcagactttgaacaaataactcacgttattgaagagagaggtgaaggtagtctggaagtttacaacaaggtgacagtgggtaggatgtgagtgaagagatgaattggtgatcagtcgtctttgggtttcttcagcctcactggttctacatccagtcaatggcttagctctatcaattctgcctctgaaatttctttcacctgtccatttctctaatttttatactggcatctccaccaacctttgcctggaatactgcaactgttttctctgcctctagactactcctcctatgcagaggtcataaggaagccaaaaggatctttctaagaggaaaatctgatcatgtcacctctctgtctaaaagctttcagcagttcccttgagctcagataaaatttaaaagcctttacataacttgcaagactctgtatgatgactcctctctcttttctctggtttcagttctctgcattccttacatcccattctctaggaatactgactatggttctttctctcatcgggatcttgattcaagctatttcctatgcatggaacattcttcattctcacactaccacccccttattagtggctacttcttattccttcttcaggaccctggttagatgcagtttcctctaggaaactttccctgaatcccccaatctcttcagattgagtaagtgcccagttatatattccatagcactctttacttctattacaataataattacattctgttggaatttgctaatctgtagactctatgaaggcaggaaccatgtttgcctattcaatattgtatctgcaatgcttaaggtatgctgcacatagtaaaagcactagaatattttttcaatgaatagataattaaaataaatataatactcagttataaagaaggcaataggctaattccatcatccagacataatcaatatcaatgttttggtatgtatccttccagacatttccatcttttctccctcaaaaatgagatcttattttttgtaatattcagtcaaattgctgttgccgttgttttgtttaatcttaaatttgttataatggacatcctcccaagtcagtacattgctctataatgttctattgtatatatattccacacttgaaataatcctcaccttgagtactaatattgtattggtatagagaatactgaaatataaacactcatccttgaacatacattttcttttttttgttttttttgagacggagtctagctctgtcacccaggctggagtacagtggcaatctcggctcactgcaacctctgcctcctgggttcaagcgattctcctgcctcagcctcctgagtagctgggattacaggtgtgcaccaccacacctggctaatttttgtatttttaggagagacagggttttaccatgttggccaggctggtctcaaactcctgacctcaggtgatccgcctgcctcagcctcctaaagtgctggaattacaggcgtgagccgccacgcccggccgaaaatacatattttcatacattcattcttgatcattgtgcaactaacagctagaacatggcctggcacacacgatgcactcataaatggatgagtggattaacaaacaaatgaataagggggtcagctatcaataagcataataaaattgtggctaagagtttaggcactagaaccagtacacttatgtccaaatcccagctccagcacttgccatcaattactagtgttttcctagcttcagtgtctctctacaaacaaagacaatggttgtaccaacctcaaaagactattaggagaactgaataagataataaggtcaagtgcattctcagaacttggcacactgtaagcacttacaaatattaattggtatcatgatctttgttgctattttttaaatttagtattggaatggaaattatcattagaatggaaactttgcaaagtccacagaaagaaagatagggcttctcttcgaacaacgggagaagagaagaaaacaagttttaatgaggagacagaaaggagataatttaaaattatgaaaagaattattctaattcaagtgctacattctctgtgaaagtggttgctctcttttctgtgttggtaatcatacctttcagaatgttcagggttgtccaacttttgtaatttcattctttttgataaagtttctttattaattgcatgaccaaatgtaagctaatatttacaactttgaaaagtttacacacgcacacgcgcgtgcacaaattagaaaaaatgttctatcccagtatttaagatttatttatttatttgagacagagtctcgctttgtcgcccaggctggagtgcagtggctcgatctcggcttactgcaacctctgccctctgggttcaagcgcttctcctccctcagcctcctgagtaactgggattacaggcgtgtgccaccatgcctagctaatttttgtatttttaatggagatggggtttcaccatgttagccaggctagtctcgaactcctgacctcaggtgattcgctcacctcagcctcccaaagtgctgcaattacaggcatgatcaccacacctcgccatatttaagttttaaaaacatacattagtttggcaagtactcccatcttgaaatatctctttcaatattgccttagatgttatttaaattaaatcttgtataatttaaatttttttatgccccaatcagattgtacattctttgagaatggaatctcatgtccatctttgtatattctacagcactcagaagcattccttttactctgtagttctataagaaaaaaagtaattgatttgattcatatctttggtaatgttgcttaggaaagaaaactttgcatggaaagtctgtggaatgcctgtgtgtggaagccttctgtttccctttttaaacatgagattgaaaagggaaaacaaactgcacttgtgattgctgaaagtttaatatttaccccctgcctcctagtaactttttgaatgtcttaagataccagtgaaaacaaaaccagtatgtttgggacactgtggtttggaagaatgaatgcattttttttaaataaaaatgcacttcactagtagtattcattttccaaggctgtaattggagagaaacactcgagaagcaccaaaattgtggaacataaagagggcagtgacaggaccccaattaacctaaattagcacaggttacccagactgtgataactcagagctccagaaactccccaaaatgaaaaagccttctgcttttagcacttttttttttcttttttctccccaaagacttcaagattcaagtggaaaagttcaccaggatgggtgggacctgaacaggctgactcactgcggttagattcagactgccaaggaaagctgcagagtacagttaggcatacactacagctggttttgatgatattttcttgttaaagacaacattattaaaaaaatgtgtaaataggacagggcagtggaggccccctcttgattttatagccaaagactcccacccttccgtggcttttctgtaccgtctgccatgttgattctatgtaaaaaacccaaatgcaggcattccaccaatgtaatgctctccttctctgagagtcctttcatttccccaagagctttggaatcattggagttacagtggttccgttactttattcttatataactttgggcaagttatttgaaccttgatctcttcactagtataatggttgtaaaaataatatctatctcataagttaggaaaatgaactgaaaatacactaaattaaatatgtcaaatatctagaaaagtacctggtgcataatgagcactcaaatagtatttattgttattagctactattgtgatcttcttaataaatcctgtcaaatattatttcaaaaagactctttctctcccgtccttttcatttttagttttatcattccatttaaagtggaaaagaggccaggcgcgtagttcgcgcctgaaattccagcactttgggaggccaaggagggtggaccacttgaggccaggatttggagaccagcctgaccaacatagcggaactccatctctactaaaaatgcaaaacattagccgggtgtggtggcgggagcctgtagtcccagctactcaggcaggagaactgcttgaatccaggaggcagaggctgcagtgagctgagattgcacccctgcactccagcctgggtgacacagcaagactccttctcaaaaaaaatgaacaataaaaaaataaagtggaaaagaaatgtacatttcttgacttcctagtttcccatcctacccaatcaactaacacaccaataccctccttaaaactattcaacttattgtgaataccaggtagaggcagaagagatacaaatccaataggatatctaatttttaatacttttcagctagtttagttgatgaatatttactgagcacttactatgtactacattatgctatattctagagactagaaaagaatgggcaagaggtgttttctgccctcaaggagcttagagtcttggtatatattctgggattagagagtaagagaaggcatcctaaaattaaaaaataaataaatttaaaaaggcacctgagctgaatcttgaaggatgagtaaactttaaccaaataaacaataggagagaaaaggttttcaaggcagagggaacagcaggtacaaataaatgaaagtatgaaacagctttgaattgcaagcagttcagaattaatagagtaaaaatcatgtaatagagaatactggaagacaaaagtggatttacagtttacctagagaggcaggaatctggtaggatttcaatctgcatcaatctaaataggaggaactagtgattccatttccaaataagccaacaccttcattagcaccaaactttcaccagctgagttccccaacataggacatgcccactatctttaggtcacaaagacatcaggtgttttcaggctcaatcatgagttattgggcaagttcctttgttattctttttgccattagttcatcatttgtaaactggaataataatcatggcttttcttttttttattatatttgaagttctgggatacatgtgcagaacgtgcaggtttgttgcacagtatacgtgtgccatgttggtttgccgcacccatcaacccgtcatctatattaggtatttctcctaatattatccctcaccttgccccacagcccctgacaggcccctgtgcgtgatgatcccctccctgtgtccatgtgttctcattagtcaactcccatttatgtgtgagaacatagggtgtttggttttctgttcctgtgttagtttgctgagaatgatggtttccagcttcatccacgtccctgcaaaggacatgaactcattctttttttatggctgcatagtattccatggcgtataagtgccacattttctttatccattctaacattaatgggcatttgggttggttccaagtctttgccattgttaatagtgctgcaataaacatacgtgtgcatgtgtctttatagtagaatgatttataatcctttgggtatatacccagtaatgggattgctgggtcaaatggcatttctagttctagatccttgaagaattgtcacactgtcttttacaatggttgaactaatttacactcccaccagcagtgtaaaagcgttcctatgtctccacatcctctccagcacctgttgtttcctgatttttaatgatcgccattctaactggtgaacatgccttttcacaaggttgttgtaaatgagatcatgctgtcacatacttagagcaatatctgccacatagaaagtgatcatcaaatgctagccagtattatgtatgtgctgctgaagtcttgctcattccagagatgctgcagctgggtgctgtgatcagcgagaaagcatagggcaagggatttttctcaacacatcattgtgaccatttgtaggtaaaatttatttctgatccaataatgtgttcagatttatgatcatggtacataaacttatggccctgaaaaagtcacaatttccgtgagtcctggttccctcacttaaaaaatggggagagtgatgcttgttccgtgtcttataaagacaaaataaaacaacttatgagatacacttaacccactgctcaatacactaaacccactgctcaatacactaaacccacagagaatcccttcatcagtggattctctgagtggggaaaagcgcctacataacgaagttggtaaggttgggaaattaattaaatcactcactcattcaaaaatacaaatgaagcatatatgctaagcaatgccctcctttcatcatggagtgtaatacctattgacctcaacctgacaaacatacaattggagtttgtatacacatacaaccatgctgttggttgtgggtggagaatgaaagaaaagaaacactgttgtatgttggaaatgttgctttctttgtcccttttttctacaccaacataaatgataattgtcactttcgcttgttaattgactaattatgttttggttccataatgtgccagtatttgcatttttagtctgttatctctttccctgtaatcaaagagccttttttctctagaatttcctacatcagcaaacattttagaggtaactgcattactgaacaattataattacttttgacagattgagcacttttagtattacttctctcctgttctaactctctttttcttacctctctatagtccagtctcttatttgaacatatctctcttccttcccccaaatctcccctctgtctggaatattatactctacttccctgactagtaaaatctaactcagctttggagaccttgctcaacgtgaagcccccaggagaaatgtcctctggtaagaggcctttccctactcctttaataaaagtagacattttctctcaagatctcagagtgtactgtccttatctctatgaaagcacttgccatgctatattgtatttaatgcaatgtctgtacttccaaatagactataactatctaagggcaggaactaaagtatctcatttaatgtgatcatgtgtttgttgcatggataaatgaaataagaagggattcctggctgcttcttccaggcctgtctccctttgtctttaagccctggaggagtcgaccctactttggcaaaaaacatttagcatgtcccctcctctctctgagtactgctacctatcctatatcccaaggctaccaaatgcatattttaaactttacagaaaataccatgttatttagtattttaccatttttagggtagggcataggaatgtgttcctatctctcctgtattttttctaaccaatgttttctctaatttttaaaccctttcatggaggcgttttgtattttaggtgctgtcattcagagtccacaggatggatgaatggatatgaaaatgaacaaacgtgtgacacaacactgcatgatttacctgcaatgactttctgatcaagcctgaagtgggttgtagcctctttatttactttttatttgacacatagcagagagagatttaaactatctcttattggccttttccctgcgtcttagcttggtttctgtcagtgtttcccagcatcgagaaataaggactaatctgtcatattagatctaaactctaaaagaaaaggactttgggccttatatctgccacccattctttcaatggaggtgacacccctcatttctatatttccagtcatctctcaatgaaaaggaacatgcaggctggctggcctttggagagcaccccacacagttttgaggagctctgcagctctgcttgccctttctgcatcacagcagatccaaaaggtgaaaaaaaaaaaacaaaaaaaggagggggttggggtgttagcatccttgcttcccccaccagcaccacacagctgttcggaggtttagtcttcaaaagcctcttgattaccatgcaaactctccatgtcttaaaaaaaacatacacacagtatacatgagaatgctaagcataaaatttgaagaataggctgttaattcttaggcacacgttatatggtgcatattctttgcccacagaaatatctggtaggatgtacagaaagtattggtgaaatatttctacttacaaattgagggaagatggggtaaacccatgtcaacacaaaattttttgagattagaattttactttttttttttctgtcaaaagttatcaattccaattccagaatgagagaaaccccagtatctcacagactatttacacattatttatgtgggacctgcttgctgggtatccctgagggggcaccaaagagctatttctttcttccttttttttttttttttttttttttagagcacaagagtataagaaattccggctgcctgtttctgggctatttaaatcccagtagacatgctctcttgtacagacttcctgggctcaacccagctcacagggagctggggaatctgtattacattatcagttattgtttttggtcaaatctaaggacaaacatatgaagaagcagagcatgcagcactggttcaggaggttcaagcaacattatcagattcttgttgagaaacaaatggttgttactgtgccaccccacactgcagacaattcctagatatcgagagaggtccaagctagcaacagagaatttaatactagctgctggaccgggactcctgggctcactatgttgcagctacagattctcagaatgccatttaaacttcctgagtttatctgagaagtaaaccaagggtgtaggtgatgaggcagcatttactggtacagttagtccccccttatccacagttttgctttccatggtgtcagttacccacagtcaaccacagtctgaaaatgttaaatagaaaattctagaaatgaacaactcataaattttaaattgcacattgttctgagcagcatgatgaaatctcgtgccatccactctatctcacccttgaatcatccctttgtccagcacatccaggctgtatatatcgcccaccagttagtcactcagtactgtctgggttatcagattgttgcagtatcacagcgcttgtgttccagtaactcctattttacttaacaatgtaaaagtgcaagagtagtaatgctggtatattgttataattgttctatgttattattaactactgttagcctcattaacatttaatttataaattaaactttatcctaagtatgtatgtatagaaaaagacatagtaaatatagggttcagtactatgcagtttgaggcatccaaaggagggactgctgtacaggcaagggtccataaccacaccccccagcacacagctgacagagcatatgtttattgggacatgctcttgaaagagacaccataatgataataccatccataatccggaccaatccatgggtcatatttttatcaggcatcactattccatagtactgcttctaattgggataacaattatccactcacatgacttaccttctcaaagtctcgaagagcctgggtctgtacctgagggggtttctcaaatgctctcaaggaatatgtctgcacaaacgggaccttttcaccacttctccagatctgtgactgcactggagggcctcgatctttagtgtcactaagaaaagctgtcaattaaacagaacaacaaaaaaaaaggtttatataataacagcactaggatcattctaactggcacattccagcagaattcagtttctgcaaaatacaaactcaatctaggccacatagaaacagtttacttaaagtagtctgtggtagatcatattaatagccatccccagtgaatcaaactagtttgggtccataggcctttgcaatgtgatactcctgccattaagaagtagagcctatttccccaactcttgaatctgggttggcaaagtggcttgccttgactggcagaatatgatataaatgctactgtatgagttccagagactagctttgagaggccttgcatttctgctcttgccttattagcatcccaagacaaccatgctgtgaagaagtcggtctaccccactggagaaggaaaggctgttcagggaagtgaagatgccccagctgacagtcaccacctgccagacatgtgagcaaggctgtctgagaccttcagtctcagtcaagccatcagaaagttgcagccagttgagtgatcccaagtgagaccagcagcgataatgcccagtttgccaaaacagaattgtgagaaataataaatcattgttgttttaagccaggtgtgggcagacattttcttaaaggaccagacagtgttttaggcttgtgggtcatatcatctctggcacaggtactcaactctaccctgtaacacagagcagacacagaccatgtgtaaatgcatgagtgtcactgtgtggctataaatctttacttataaaaactgactgttggcccatgggctgtagtttgctgctgacccctgttttaagtcactaagttttgggatggtttgtcacataacaaaaggtaaccaaaacagtctaaaggaaagaaccaagctgctagcaaactatctctaccgataatttttcaggttactatttagtaatagtaacaattataacagccaacatatttaaagggcattacatgttacaaaatagtttcacatgaattatttcatttatgaagtcgctgcaatcagtgaaatagacataagtgattattaagtccattttactgatgaataagtaaagattcagaaagtttgcttgaccaagatcacattgctaaaaagtggcagaaccaatcccatcttttctccatctgtctttcttagcagtatgctactactgtgttattttagcaattaaagggattgcaataggtctgagagtggggaaaacaggtaaagaggcagagactcaatcactccattaaccaatggaagcattgctttgggagaacctagtggagtctaagctgtaattaaccctatgcttgcttttgagaagtaacattgttaaagaatgagaaagcaaagcctctgtcaaacaaagtacacagaggacctcatgttggggcagggttggagttacagacaggtagaaaacatagaaagctacatactttcttggctgacagaaggaaataatgaacttttattatggaactattttttaaataagaagacagtcatggcaaagcattaagcgctacagacagtgtcagggcaagtaagagcaaaacaggtactgggtgactgcctggctgaggaaaagttaactagacacttggggaaaggagatccaagggagtaagaggcaaaatgcctttgcatgcttttcttcctatctctttttctttctctccttctcactctctcccttccttcctttcttcctttctctttctttttttttttctcttttcccccacctctctgcctgcctccttccttccttccttccttccttccttccctccctcctctctccctccttccctgccttctttccttcgttctgccaacttgccagaaggagcccaagaaaaagcacccagatgcttcagtcaacttcttagaattcttcttttttttatgttcagaaaagatggaaattcatttctgctaaagagaaagaaaaaattggaagacagggtgaaggtgaacaggcccattataagaaagaaacaaaaatctatattctgtctacaaggaaacgagagagagaaagagagagaagaaagaagttccaggattctaatgtaccaaagggatctcctttttcttgttttgttctgaaaatttcaccaaaagagcacaggagaacatcttggctaattcattggcgatgatgtaagaaaactgagagaaatgaaagaaatgaagaattactgctgcagataatatacagccttgaggaaagaaaggcttttaagattatagatataaaggctattgctgtattctgggataaaagaaagtctgatgcagggaaaggggaagttggaaaaactggaaaaagaaaaaagaagaaaagaaaaaaaggactggaaagacattggtgaatagaaagatgaaaagggtgaagaaaaaaatgatgatagtcaatagggtggttttaaaagaggcttttgttttattaatttgtttttgtgtgagtgtgtgtgtatgtgtttgttttttgcctaaaagtatttaactccgcattacaccactgatttcaaagaaaaaaagctgaaatgtaagatcatatgatttgtttttaaactgaacactgtatactgtctttttatttttgcaaaattaatgtagtatccagtgtgtctttagataaccctgtccttaatgatattttcaatagccactaaccttgcctggtactgtttcggggtttaaactagaacagaaatttaaggcaggctttattagtgcatagtacaaatcaattacatatatatggagatattatttttccctcttcaattgtttttcgtgcagcttacccaatataattgttctgttagttgtacactactctgtgatagcaaataataataataaaataattatgatgatattgcccctgttttggtgatattctgaatgtttatacgtaaatgcaaaatttttaattaaaagtaattagaggctgggcatggtggctcacacctgtaatcccagttttttgggtggttgaggcaggtggatcacttgaggtcaggagctcaagaccagcctggccaacatggcgaaaccccatctctaccaaaactacaaaaattagccaggcgtggtggcaagcgcatgtaatcccagctactcgggaggctgaggcaggagaattgcttgaacctgggaggcggaggttgcagtgagccgagacggcaccactgcactccagcctgggtgacagagcaagactctgtctcaaaaataaataaataaataaataaatgtaattagaaaaaatgatttcttccacatttaggtgaaattaaatatactactaaggggaagataatctgataaaacagaataacaatacattacagttagattggtggatatgatagaaagagcaatgccttgaggcttggatttgaatcctgaccacttgctaattgtgggaatttaggcaaatctcttaattttgctgatatattgcctctgtaaaacaggggtaataatatctgctttatagaactgttatatggattaaataaaataataaaagcaccttgccacatgtattatatgtagtaagcattttatccattcccctcacatttttgccctagtccttcaatttttgcctcaaaatgtagaatattgacatttaaaatgttgagcacagtaacccttggaatttgtggatttaacacacatttcaaatactaattttaagtgactctgaaattcttaacttattcaaattaaaaacttttttccaaattgtgcatataaacaatctgtgcttccaggctgttatgaaaaaggcaaagaacttagcaaggaagtaaaaccctcaggtcgagaacaagttttgtggaaaatagaccccaaaagaatgttatcttccctttggttttgcaattcaggtagatctctggctaatgttagtgtagtaataattgtgctgttgttaggaatacattaatagtgacaatagataagatacagagtgcttattccttgatagcctctgtactaaaagcttttctcaatctcacctatgagattaacattattattatacccattttatttatttattattttattattatttaattttttttgagactgagtctgctctatcacccaggctggagtgcagtgccacgatctcagctcactgcaacctctgccttccgggttcaagagattatcctgcctcagcctcctgtgtagctgggattacaggcgtgggccaccatgcctagctaatttttgtatttttggtagagatggggtttcaccatgttggctagcctggtcttgaactcctgacctcaggtgatacgcccgcctcagcctcctaaagtgctgggattacaggcgtgagacaccatgcccggcctattatacccattttaatggtgtattaagataaagatttcattttagtaacataatttattttaatcattgtacaagtgagtttagccttgcaattacagaatcgttaaaagtatgaagaattcacataagtatctgtaatgatttactgtactatgctgcttctcagtacatagaattatagctagcttataattctcgtgtgaaattgctacagtagtatgtgcaaatttggaaattcacaaaagtttgaagatattgccatgatgaatttaaagaggccataattcaagagaattaagatcaatagaaaaccaagaattggccaagtgccaatttctctcacacactttggaaagctggagtgggtgtattgcttcaggtcagacattcaaaaccagcctgagcaatatagcaagactcccacctctaaaaaaaaatattaaaaattaggcatatgtctatagtcccagctactcaggaggctgaggtgaaaggatagcttgaccccaggagtttgaggttgcagtgagctatgatcacaccactgcactacatccatagtgagagagtgagaccctgtctcaaaagaaaaccaaatgaataaacaaaagaaacaaagaatttaacaaggcaaggcccacagcatccttacctgctgtgtgactcgttctgggtaccatctccccatcatcctctgcaaaataatctctgtggaggcaaacacatcattaattaatgagatactaccccacaaggctcccatcccagggatcgaggagaagacacctacctatttgtcatttctatttatctctctgcaagtatttactaagcttctattatgtatcagggaccgtgtcaagtgctagggatacaaaggcaaacaccacagaagagttcctattctcaataagtacatgagagccagccattaaataatttcacaagaattaactactattgtagtaaatgttgtgaaggaaaatgcagagggaacttaactagcacagggactcagagaaactcagggaaaggaacatttaaacgtagatgggaggatgtcaaccaggtgtagaatgggagaatgggagtggaagagtgttccatcatgagagaacagcaaaggccctgagtcagaaaggactctggcctgttagaggaacaaagaaagccaatgttgcaaccaggccacgcaggaccttgtggtatggggtaaggccactgagtctaatgtgaaaagctacgggaaatcaatgaaggattttaaattaaggaaagaatggcaatgatcagatttatattttagataggtcattccagctgcattctggctctacacagtgagactgtggaggggcaaaaatggatggtgagaatctatattccaaataggaagttgtgatggtttaacaaaggggaaattttaaaaatttaagatatgtttagaaagtagaattgacacagaaaccttgaaaaatagacaaagtttatgagtggaaatgttaataacaccatgattcagtagcaagaggtgtatctgttcagcatagtaaataccaccatccctagcagagaggggacagtatctcaaaatgtattcaacaaatacttctcaagcccatgcttgacaagtgcttttaggcactgttgtaagctccacaaatgtagcagtgagcaaaacagacaaaaatccctgcactcatggaatttttacagtaaggggagacaataaataaattgtatagtagcagttgggaacaagtgctataaaaaaaaggaaagtggggaatgtggatagggagagctggaggtaggaggaggtagaggggattgcaattttcagtagacaaggctgctctatgaagccataaggacaggcatgggggtctctagggaaagagtcttctaagcagagaacataaaatgcaaaggcccataagagggagcatgctagttagtggctgggtgcagtgagcacgtggtgagcagtaggaggtgaggtcagggaagtaatgggaagactgggcagggggcgcagactgtttgaagcctttcaagacatggagaggcatttagccactagagtcttgtgaatcaaaaagaaagacggactcagtgactaatgttttaaagggggactgtctactgtcttgacaactgactgtctgatggggatgtcagaaacagatgatttcaataaccctacagaaagatgctttcaataggtagcttattctttaaactcttgggggctcccaagaattctgtaaacagagatgtagaggacttctctctttctctctttttttttttttttttttttgagacagagttttgcttttgttgcccaggctggagtgcatggcacgatctcggctcaccacaacctccgcctcccaggttcaagcgattttcctgccccagcctccccagtagctgggattacaggtgcctgccaccatgcccggctaattttgtatttttagtagaggcggggtttctccgtgttggtcaggctggtctcgaactcctgacctcaggtgatccgcccgcctcggcctcccaaagtgcagaggttacaggcatgagccactgcgcccagcctacaggacttctctttttaaaagccagaagatattcacagggaggcagaggaggacctggcatttgcttggaaattggtggttttttcttccctgcctcagggctggatcttggcagaaatcttcactttgttaagtcccagatggacatgaaaataccagacagggcacatcgggctacacatgccacctgacaattatttcgtatccaaaagtagatcaccagcttgtgattcttccaggccccctgcctctttcccttctcctccttaaaagctttccctgagagtaaacaatgccaaagaggaatgtactacgtatgcactcccctctgtggaggtaaaataggagaaggatgtcaaaaccatcaaccagaacaatgtcttaaaaaaatctgtggggaaaaaatttatacttagctgctgctattcactgagcatttctgcctagtccacagacaaaggtggctgcatctgctgtcaggagcaaggtcaaccctcaggccaaattcagcccatccgacatgttttatttagcccacacaagtttgacccacttctaactgctcttgggaaatgagtgggtctgccaacactgggcctgccttcccacacagcgggagaacttgccccctttacacaggacagggatgtgttttccagtttgccacagtccctgccactccctgtccttgtcgtccctcattcacttaattatgatacttgcctggcatcttgcaggtttctgatgctgttaccccagtatagaccaagtgcagacagaatttcatttctgctttattaaggcacagtcttgagaaacccattggcttcacacacaattaattaatttgtggcaacaagctactatattggcttgcatgtcactttcacctctctgggcattagttttctctaatatttataaaagaaggacatgactttctaaggttccttgcagtaattatgcagttctattctaatagatgcttaagcataaaacccattttaatactgtccaaggatccaggataccttccagacatgatctcactcaatcttctctgctctgcagattgcacattataggtcaagagcaagctacaacacagcaatacatatcagccctaccagacacctcacccttcccgcatcacccacacccactctgagcacactgcctgcctgatatgaatcaataactggaaggatagagaggtcactttagatgggtactgagttaataagcatactcgcagtgtctcaggagatttttaagaaatcactttagctctattaacagctcaagttccctctcttattgccagagaaaggggctcactcagctgctccacaagttacaaaggaatctgacgctccccaagggaaggggctcagactgaagaaacacagagtataagtctaaggggttgcaatttgtgacaacatttgataaaccaaagtgcaaggagaattggggtatggtagagacagactccaagcatggacacacacacacacacacacatacacacacacacacacacacacacacacacacaaagtggtaatatatgttggtacattctttcgtattacccaagttcagaaaaaaattttatatccttgtcctagtttctcaaattcaagtgtctctagttttttaaaatatcaattcatgaatgactcatgctcagctaatatgtggttcaccaggccacttttagctctcctgcatttccatatataatctttctcccatgatgctttcacttaaaattttgctttttctgtataaatgaactatatttttcctcaatgtcttaccttgtctttctccctacgtcatcaatctgctaatgacaataccaattccactaaaaccacatatattaatattctcaccaggacattattttgctttcggaagtaccaagcattttccaagtacaacctactcacaagctgttcacctgcttgatttctgcatggtatatcactcatattttcttgagttgctgataagtagctattaagatattagactcaaataacacatcaacattcaatatcccatattacttggtttttctatggctttccagggtgattaagttgagaatgatcaggaaataattgcttctctgaaggccatctgccaccccctgatattctgacattctcaaactgtcctgtgatgatttcttccagtaattttctaagaatggtagtttcatttatggccagggttatccaaaacactcagttttgctttacttgaaactggccactgatatagctcctttcaagattcaagcatctcattggtcccactagtctagtttctcataacattgtggggaggggtagacacttgggtttcttcttgcttaggagcctgcagagagagatattttctataaggcaggtatagaccttcctccgtaaactgttatttctggtattattttcttgtattttagtctgtctaatttgtggactgagaggaacaacagatcatatgaatgaatcatctcattcaaaagcaatgacaagatggtaatcatcattacaaagcaggttctatgagtctttgaacagtatgagatatttgtattctaggaccaaaatcaccactaaaactatttctaaggtactgatgcctgtctaggctccatactttcttctctccagtctcacctactaaaataattaacctaaggttatttattcccatatgagtgtctaaactcccaaaggaatggtgattttcaggccctctcttcaggccaatcacaggtatttagtttgttctgagaaccacatagtctggccctcctacttcatcactaaccaccacccttgcttaacatttctaagcctgaagaccagggccatctcccagaggtgttttctagctttcaagcttctttatatatatatatatattttattattatgaacaaaaattcagaaggagaaaaaacaatctgctatagcaatacctagagcgaaaacctgggccttcattgctatttttagggtttttataattccattttgtaaacatttattgagaagttgcttatatgccaggtactggaaatacaaaggtgaaaaagtatatataccctgtggttaaagtactcagaatctattgagggaagcaggcacatgattcagagagataattattagaaaaattagatttaacagagatttcagaacataaataagatagcaattaattttgtcctggtggggagtgggctgggacagggtggttggcggaggggtctaggacatttacagaaaacagataacactgaatctaggtcttaaaggatgggtgtaaatacacaaggaaacataacaaagacccaattataggaaaatgaacggtgtgttcagggggctttcattttgttttccccttcccaaccaccccgctccatcttccccccaccctgaggagccctgaactgcctcctaggacatcttccaacttcctgtttacctttccccctcctcaagccttcctccccaagcgctcaccctcaggtgggaatatgaagggaagccaagggtgaaattgtttcttcatttgcacctccctcctcaaacactatagcttagaagcccccaaaatgatttaaaataatgtcagcaagaaaggggctaagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaaggggctaagatttgcactattgtgaaaatacccatagaaacaaactagaaaagaacccagagaaatgaaaagtccggaggtttagagtggcggaaaatatactgagcatcctccccctttttttcttactatttttgccaaaaggctaattcttatttttaaaaagtttgaataatctatttttattgaatttacattgctcttcctaattaatgaccttgataaaagataactatggaaaggattcggctcggtgtggcctctcaaacagtgaggggcgtgtggcatgacagcaagactgctgaagtttgctctttcttggggtcctcacaggagtaggcattgaaccaaatgcagattctgttccaattcccatattcttggagctcatttaacatgagttgctggtttctgtttcaaatgaaataaatttttcaaacgttccaagatgcatttttcctatttttaatttacagctatattcaactgtggcaaacacaaaagggtcagaatgagaagaactgtggcctattttttaatatgggaagctctggccctgacagtttataaatggtaagattttagaaatagtgtcaacttaaaaacaaagacatctacagttaacaatttctggactgctggtgcataattttataattccacaggttttcttgcactggaattttcctcaatactaatcttgtattaaatgaacatattattatcatggacaaccatcaccactcaccaccaatgctgcctctgcaatttactgaatgcctgatactttctaggcatcagttcattcagtcatcatagaatcctgtgaagtacgtcatacaatccctgtttacagatgaggaaacaaggggcctggaaggataaagtaatttgcccaagatcgcacagctagttggtgtcagagcctgaacttgaaaactgtctatttgactccaaacttttactcttcccaatatgccctatttctaaccacacatttacagggaacctcctttgtacctgccttgactccagggaactcacccctgagaagctgaggcgaaaggaagggtggacggtttgctgtgctgatgagatgggatttttgtctcaaaccctgacacaaatttgtttcttagactatcaacttatccctgatgggcacagcttacacttgagtatttgagtactggtgtaacagatgccatgtgacaaaataattaaaatcccaaaacggaagtggctagtgtgactttttatataggtcctatcgtgaaaagtgagtcatccatcattttatacttctctatctctaacccacttttttcagaatatttacatctttctccaacccctcccgtgataacacttggcattgtccctacccaagggaataaactgaaacgcgggaaaggtggtggaaacagaaacaatcaaagtggaaaaggcattagtgaacaagctctgagacttctcagatgtgtttttttcctcttgccaaggagagacactggatatattttctatgttccaaatgttgccaaataccctcccacaatgtggcacccgaattgtaaaaacacatattcaaatgcaaatagggtaaaagccccagatgcagaacgttaagactattatataatacagtgaaattatcattttttctcatctcaagatctatcattataacctctgcaagtgaggatgcttaattggcaaagctcccagaggagagagagcatcacggtgagcctccttctgcatgctgactaagtgtgggctgacttggcaccgatacagaaacatccactttattccagtataggctgcaattacacccttcactcaaagtctattcactgacagtgaccatcactctgagaggctgttttctgcagtgctaagtccccaatagctacagtgagctacaaaatcatcgtgcatccacaacaatttctttaagtttcgggatctttgttttgttttgtttttggtccagcactaagtcttcatcctaaagaaaataaggaaactaacattactttcttgatgctatccatcaaggttcagagaaaccccttaataagtaagtaattatttttcctcactttaccttctgaggtcatcacatatccaaatatctaataaattttcctctacctcccctgcatcagccaagacataggtatcactctttcaaaagaagacatgaaaataacctgctttggattcagtcacattaccccagggatggtgtatggtctctccacccacctctgaaacttaccttttgcattttgcttttggtcctggcaatgcaccctacaatcctcagttttcattaacaactaatatccacaaggcactggagtatattgcagttggctcaatctttctagagccctagactgaatgttaagaaacaggtgatttttttcccctttccacctacttttatattcacataatctttcagtttcttttctttacaatgtctatttttgatgattttaaaagaagtacatgcctcgtagaaattttggaaaagagaaaagtgtacagagaaaaataaaaataatctttaaaattctaccacctgaaggcaacattgataaagatttgtatgtatttagttgttcttcagtttatttgcctgtgtgaattctgcaaatggaaataatattgaatgtaacagttctgcatcttgcttttatttacactacggaaatcaaaggttgtgaggaatatatttttagaggaagagaaagagtcagggaaggaggagcaggagaaagaggcaggtgggaggaggaggagaatttctcagcagcattatagacctgttgaggattagcaagaatgaatctagagtctctcttctcagtgcggttttataacatactaaaacaacactcatagaatcctctaggattttaaaataaaattgactaagggttaccaagccgggagatggttaaggcagttagagattctaaagcagcgttgagaacacgattcaaagagctgactctgacgtctaggttcagtatggaggtgaataaacagcagatggcctggaagatacagagagttgaggaactggaatacatgacgcagtaaacaacattcagaaagaatgaggaagtggggaacttgacctgtggtcaagaagtataatttcagcattaaggatcctaagggtggaaaatctggaagaaagatgagctacaaaagatggctgtgctgatagcatactgaagtgaattcgagttaaggctatgtcaggtcaaggtataacagtgatgtatgtccatgcctagtgacccctctagaatgtcagtctctggaagggagggtttttagatcattcactatcatctgtccagcattaaagaagtctagatcataggaattggatgcgtatttcttttttttttcttttcccgtaactgaggaaacaagacacatatttcttaaacaatgataaatacaatctgaatgtataatggtgtcaagtttgataacctgttgtatccattctacaataaggagacacccaccaaacagatattcccatcggccttttggggaatgttctctggaaagctcttaatagatgaccttctaagtgctagaggcaatgttagatgctgaagacttatagacaaaaacgtttcattctgccgataaacttggagtatggaaaatatcaagttaaccaactagctacatgctacaacagagtaggcagagcgtgttctggctacacccagatctaggttctaaaaataattcctaaaggaggtacttctgaatctaacctctgaagggtatacaaatttatcccagcaaaggcaaggctagatgtgtaggtgggaacaactggtatattaaggcccactcataataattttagctcagggtaaattaagtcgcaatgactctccaaccagctccccgggtctgctggcaataatgctgctcctgtggtgccaataacctgaaaatctccaagtaatacaagaaagttatacacagaaaacctccaagtgatacacagaaaaacctaaaaccaactcaattccaaactttacatgttgtcatttggtagacacaaatgtgaacttcttcctgcaataaaaacctatgttgacttagtttaaaagcagcatataaaggatgttgcccataatcccctaaccaaacaaggcatctattttctcttttctctgtccttgtaatagacatcctaataggtatacatagttttgatgtaatttacatctatcttttactttcttatgttaaaattttctgtttattatcatttcaggaaacgtttcaggatagtaatagagattaacagcaacagtgaagcattttaccctagagaagggtaaaagttggaaatgttgctattgattcacctaggttatgccactttaatgtcagtgtgcctcagtttccccctttacaatacagggattcaggtcttgaaaaagatatttaaattgaatgcaatatctttcttatgggactataactttaagtaatttgcaatgtactttcaagaactggaaatgttgacatagttattctacttctgaacatctctcattcaaaaaataatgctgtggaagaagatgctttatgcacctagacatttatcaagtattatttataatagttaaaaattggaagtctacatcctttgggttaggcgtaatgatttaaaagacactgtaaatccacagcatgttattctacattatgaatgataatataccacattatgaagtggaaaataaattcattcttaaattgtgtgaaatgctagaaattattcaattttctttgtgagtcaatgctttctagttttttttttttttttttttttttttttttttttccgacagagtcttgctctgtcacccaggctggagtgcagtggtgtgatctcggctcactgcaacctccacttcctgggttcaagcaattctcattcctcggtctcccgattagctgggattacaggcaccccccaccatgcccactaatttttgtatctttagtagagatggggtttcaacatgttggccaggctggtctcgaactcctgacctcaagtgatcctcctgccttggcctcccaaagtgctgggattacaggcgagagccactgtgcctggccagtgaatgctttctatatgtcagaagttattgcttctttccaccctttccaccatgaccatgataagaagacactagttgcaagttacctcttccctcactggccttggaaaagacaagaaagaaagacgtttctgtggaatgtaacaagcagaaaaggactgaagataatgagacagattaaggaaagatgaatcacaggctgtgaaagtgctatgaaaataaaacagtattattatacaatttattataaatagtctatgactaatttagcactttagccataagcgttcagaaaaaagaaattcagatcatgcttgtcttgctggccacagaactcagaaaatgctctgaggcagaggaaaacaagtcctcagtgcatttgagtgttttaaaatagaatcacatagagccaccttgggtcaatatgacatctcttgtattctggactttcttctaactttaaatgctatttgaatttttgccagagacaacttgtggaatgttctgagcccagtttggaattttatttataaaatggggtagatttcaatagaagtagtgtcctggggcatccactgaatggatggatgctccacttagccttgaaaatatgatccctcagccacagtcaggcgagcctcccaggatggggacggcaccatgaggtgttacttatcctttctgagacaaaaacaaccccttcccagtctttaggtattttaaacatagtcttagcatgtagctgaaaaaatgggggttgggggagtcaggtccagactgatctagtgtgtggaaaataagcaagtaggagtgaaagcattgattctggcaaattccccaagccgaaatccaagtataggcccatttaaaagtagactggagttgccaaggcagaatttccttcttaaaattcagataattagttgctagcagtgctgaatattaaacaggaaattcaacttccaaagatgtttcaataatagaattctgaaaacaagcattttcctaatatgaagtgttacatgcaaagcaccagcaccataataagtaaaggtactggaattaactaggccttcatacaacacatactagttgtgtgaatgccagcaaatcatttaaccactttaacctcagtggccatatatctctggttgtaactatgtctttgtaaacaggactctctactaactcaccataaattcagagaaaaataaatgtccctgattcctctaggctaaacatttatatagagaaaaacaaattcaaataagctatcaatggagatctgttaagtacaatatagctgtggtaaatggacaccttgtcttgcttgaaggctgtactccagaaaagaaacaaagtcaaaattcttaaattttgaaaccagatcattaattttcttgaatgttacttccattttccaaattttcacagatacagcaagcaaatgcaattaatgcttgcattttattaaatcaaattgcaggggaatagaaaacaaaacaaaacagactaatttgctttccttttttaaccttcagtcttatagtttgcccttaaacatttctagttcactcttttcttgagttatgtgttcggggaagttgtataaggttcatatatgattcacctgatgtttactcagctttctcatatgctagaaaccagaacatttccactgaaatggggaagataattagtaatgactttttcagcattgaacgatgtggtaggctaaaataatggccttataagaatgtccacattcctaatccccagatcctgtgtatatgccactttccatagcaagagagggctttgcagatgtgactaaagattttgagatgaggagattatcctggattatctggttgggtccaatgtaatcataagggtcctagtaagagggacactggagggtcagaatgatcaaaggagatgtgatgatagaagcagaggccagtgatggcattgctggaaggggctatgaacccagaatgtgggcagtctctcgaagccatgaagggcaaggaacaaattctcctttagagcctctagaaggagcacagtcctgctgataccttggttttaacctagaagaccaaatttcagacttctgacctccagaactttaaggcaatacatttgtattgttttaagccactaagtttgtggtgatttggctgggcgcagtggctcacacctgtaatcccagcactttgggaggccaaggcgggtggatcacttgaggtcaggagtttgagaccagccaggccaacatggtgaaaccccgtctctactaaaaatacaaaaattagctgagtgtggtgccatgtgcctgtaatcccagctacttgggaggctgaggcaggagaatcccttgaacctgagaggcggaggttgcagtgagccaagattgcaccactgcacgctagcctgggcaacagagtgagactccatctcaaaaaaaaaaaaaaaagtttgtggtgatttgttacaccagcaacaggaaattaatacaaacagtaatcctgaagtactgataatctttaaagcagaaggtgtagggagttgctagtccagacaggtggatgctaaaaatttagagcagtagaagctgtttgcctggttgacactggacctgccgggtgagaaaacctcccctcatcatcaagttcttcatcagctccatgagcttattcttttgacaactctcgccctgttcacggaaataaatctgaaagctggtgaccaaatcagctttttgtaatgccagtatattcatagaaaatttgctattccagagccaaccatgctctgtccaaatgatttaaccagtgagtttggcaacagtcaggtaacggccccagcgggtagggggaacctttccattgagctgtagaggggcagatgatgtgtagctgggagtagagcatatctaactttgagaactaaaataccaagcaccttgtcctttgtgggtaaattgagcaagtagctagcttcagaaacaagtcataaactgagtcacctacaaaactctactaaaataaagtaaaagcatagattttggaatgaaacagttcaaggctatatttctttctcggctgtgtgtgtcactctgggaaaattatttaatctttctgaagctcaatttccttttcttaaaaatgagtataacatttacttcatagggttgtaaggattaggtgaattaagtattcaaagagattagcacacaattaaagcttaataaatgttatcaattatggttaatttttattctttcaatcccctatccactgtgtacccagagcagccactgcgtatctctgccttagtgtctctctattaaaattatagatgatgacaatgtaaagccattaaaggcagagacccagtctcattcattgcattcattgttttattcttagcatctagcacagcgtctgacctgtttggggctctcaaaatttatttatttatttatttatttttgagacagagtctcactgtgtcacccaggctggagtgcagtggtataatctcagctcactgcaacatccgcctcccgggttcaagggattctcctgcctcaggctcctaagtagctgggactacaggtgcaggcaccacacccagctaatttttgtatttttagtagagatggggtttcagcacgttggccagactggtctcgaacttctgacctcaagtcatccacctgccttggcctctcaaactgttgagactacaggcgtgagccatttcatccggccctcaaatttttaataagtgtttatgaactaatctgatctgtgagttaggaaggatctgagatgtcagccatgatctgtgattataggatttttccaactgtgacccattaggtggagaaataaattcagtgaatcagagccaacattttatttttaaagaaaaagaatagaatagcaaatatcagagtgcaaaacacatagtaaagttaagtattgttacaagaaactttgttacatatgtaagagtacttggtggcaatgtaaatatattacttattgtgagtagtggttaaaaaatatgtgaacattctgaatggtccaccttgccagcatttgctactttctatctttttaatttcagccattctgatatgtatatagcagcatggtgttgtggttctaatttgcatttccctgataactagtgatgtggagcaccttttcactatgttcttccctttggataccctctttttttttttttttttttttttttttttgagatgtaggctcgctctgtcacccaggctggagtgcagtggtgcgatctcggctcactgcaagctccgcctcccaggttcaggccattctcctgcctcagcctcccgagtagctgggactacaggtgcctgcaaccacgccgggctaattttttgtatttttagtagagacggggtttcaccgtgttagccaggactatctcgatctcctgaccccgtgatccgcccgcctcggcctcccaaagtgctgggattacaggcgtgagccaccgcgcctggcctggatacccgctttagaaatctcttttgtaatctgtttaaaaaaaaacaatctggcagtatttactaaatctgaacatgcatttcctattacgcagaaatcatacttctacttatttactcaacagaaatgtgtacatatgttcatcaaaagacctgtacagaaatgttcatagcaacactgtttataatagctccaaactggaaattgcccaagtgcctattaagaatagaatggacaaataaatttgatatatttatacactatagaagcctatttaaaagcaagaataaatggactacagtaccatataacagtatagaactccaaaagcaaaagattgagtgaaaggagccacgtacgaaagagtacatggtgtataatttcatttacataaagttcaaaactaggcaaaattattctatggtgttaaaaattaggataatgattatccttgaagtcatcaggagggcttcagggatgctggtaatgttccctttctctatctgaatgcccatcccatgagtatactcagtttgtcaaattaattggactgtaaatatataatttgcgatttttccaaatcatttctgaatttgtctgaaattgttacatgtaaatataaaatttttaaaacttaataaataatacttttttcttcaagtgtgaaaaacactggcagagagcaaaaggccctgatacactcactcccatcaccatcaagtggtcatctagcctttgcctgagtaactccagggtcaacaatctctttactgcccatactgcccaggcagctaacttgttagaaagcttttttttaatttttttttgagacggagtctcgctctgtcgcccaggctggagtgcagtggcgcgatctcggctcactgcaagctccgcttcccgggttcacgccattctcctacctcagcctcccaagtagctggtactacaggcgcccgccaccacgcccggctaattttttttgtgtttttagtagagacggggtttcactgtgttagccaggatggtctcaatctcctgacctcgtaatccgcccccctcagcctcccaaagtactgcaattacaggcgtgagccacctcgcccggtctttttttttttttttttgaggcggagtttcgcttttgttgcccaggctggagtgcaatggcttgatctcggctcaccacaaacttctcctcccgggttcaagcgattctcctgcctcagcctccggagtagctgggattacaggcatgtgcgaccacgcccggctaattttgtattttagtagagatggggtttctccatgttggtcaggctggtctcgaactcccgacctcaggtgatccgcctgcctcagcctcccaaagtgctgggattacaggcatgagccactgcacctggccagaaagctttttctttacactgagccataactcgcctcccaacaactcgcttgcatcggttgttctgtcctcctaagagattctaatgtgattcaatccctctaccaccaatagctcttcggaaatttgaaggaagctaccacatcctccccactcccagtcgtcatttctccggactcaggagtcccaggtccttcctttggccatccctcaaggcatggctttgagttccctcctgtctcttgattgtacttattttatctaatgatgcccagaactaagcacagccctctcggagaggcccaagaggagcagaaaggagccaaaagtaaaatcatcacttttgatctagacagaatctagacagcctacttcttctgtcaacaaaccctaagcttcaatttgctccttctttaatattcacattataccattcactcctgttgagcttagcaatcaactaaaagcacccaagtcttttgcataagccccaaatttaccttctgtgtttgtaccgtcttcactctctcaggagtcagagcgctcatttggccccaccccaattctccaaagctaaatcccacagatggaagcatatctgttatagagacaccgctggaatagtctccctaccctcccacccactaaaaaacagaaacgaagtctttgtctcaatacatggtctcttatccttaccctttccttgaatggggcttcattttaaagtgtgtctgggggaaggactggaagaaaacgcagtttcacaggccatctccaaaatctgacctaaaagccaactgttgcctggcctcaataaagcctgagcagtgtggtgccctgatctctttccttctccattcctcccccaagtgggctccaactggaggttgtggagatgagtgctgctgggctctgctcactcagtccctttgcctttgtgtgagtagtgacagatgaggctgagaaggaaaacgtggcagggtgagaataaacctgatattgttcaaagcatctgacatcaaacatatctctcaagaagacctactggaatccctctagccacacgaacaaggaaacgacagagaaccatttctacagaaagttccaggcggcctccctgggtatttttaacatcaggactcggtggaggggagagtcattaagcaagggaaaccccgtaaaacagaacatgtgaaaatgaccaagagaggtgggctgggaaccaggcagggcgaggctacagaaaagggaagctgtcacgggaccctggtggtgaggggcgacctctctctccctaagggcgctgggggaggggagggaggaggaccaccaagtctggagcgcggcgagaaggaaacagcccacctacctcgtccaggtctgctccattttccaggctctttccttagtctcaggacgctcctcacccgggaggggaagcagcctgggaaaatgagaagccttgcccacgaatctccagcgcaaaaggcagcagctttttcctccccagctcctttctgcgtcggcggcgaagagagagctctgctccctgcttttttagaaaatggatttgacgtggccgaacctgcggctagccgtgcgacccgcacaagggagggactgttctcagtaggaggctggactcagagcggcgcggcgcccggggctgtttcgtgagctggagccagcggctgcccgggcggcggtgcgcgcactctccaggctgagacacgactggctggcacgagttgctcggcaccagctgagctgtcaaccgcgagcggaggcggggctcccgacaaccagtgtgctggggcagaatcggcccaggttacacgccccctgaaccaccctcgcgtctccccgacccctctctcgctggctcagatgaatgatgacggcagagggcagagagcttagaggacgcggtaccaagccccgtccctcgcccatcccaacgaaggtcttagaatacaatcaaccaactacaggaagaatttgtagaggaggttttcttgtgtgtctgcatcgccccacccacaggtaaccccagagccagagatggagtctaggaaggtttaggagcaatcccggctgaatgcagatgtataccctacgtggtcatggaacacgatgttgtcttcctagagatgtgacatgccagtttcaccattaatccagggacaggacccttcatcaggaagggaagcatcccaacaaaaccttacagccctattagctgcctgtatcccagacatctcctgttttagggtattctacctcctcgtttttcagtttcgccagcaactgggctctaccaatagcttcaaggagggagaagcttcctgactcccagaacactagaaaagcctcaagacagtagccatcaggacctcgacactcccttgtgactgttttaagatcatggaaaaggcctctttggagatggcattgcctcaggccctgtaccatgtacttatgtatcaagatttaaacaaggcagacatactataattagagtgcttgccaccctgaagctcctttttagctttcaaataagaccgttttattaaatgacataatcactgttattattagcactatcactgaccttttttttatctgaaaaaggctttatagtgcccacatgtggcaatgttaatttcgttgtacttgtttcagagatgataaatttgagaccccaaaaggcccaaagtctctgctaaggttctgatacaggctgtgttctccattgggtggccccagagatatgttccctgaatttctaaagctacgacccacaagacttctccaggatgaatttattctttcaggcctcctaggcatttaactcaggaagaacctggcatgcctgggtattggtgagactgtggggagtctgtgttcttgggggaacctgtcatctgtctgttatctcttggattggttcccctacatactagtacaaagtaggggtggggaggggaggataacaaaacatttgaaggtttagcagaactgtctaaaaagcccctagtctagactcctccaacacttgatttattggtaggaccacactgctccagagctcaaaatgttaccaggaaaaatttcaaggtccagtttgatcttagacaaggctcacaggccacctgtcttgaaaagaatatcctgttgcctctgatgggggggaagaaaaggcagggagagtcagattcccatccttcataccaaagttggggctatatttagctttgtctcaaatcaaattatgggctaccgagttgtggagaggaactctgtctacaggcagctcactggattcaagaaatgatagcactaactaggtgagctgtggggtctcagaagtgacgctagaaaatacgttcatgtatttttaaaataacttttttcaaaagtttatagcacattcattgtaaaaacatttgaaaaatacagaaagttatatagattactcagaatacccagggatcttcaatattaaaaatgtgttgcatttttttcccactctttaaaaaatgcatcttttaatccaaacaccaactctttcttacacacatgggtatattcttgagaagagaaatttccttgttgttttaaaaattatacttattgtcaaaagaacaatttttttgcgttagatttcagaagaaaaatattcacccatataaccactgctacagcacaaatgtttaaatttctccaaattccctttagtcattatctatatatattaaatatctatttacataattacgattacagcttaggtatatgtttatattctccttctttcacttagtaaatatttgtccatgcttttagggaaagttcatagttattattctaatgagtgtacaatattttataatattagtaggaccatagattacttaaaatattctactattgcatagttatgctgtttctgatattagactgttataaataatgccttaatgaagagctttctgcctttatcattctccttttttgaattatgctatggttgaatgtatgtatgccttcaaaattcatacattggtacttaacaccgagtgttatagtactacagggtggggccttttaggaatatgtcttaggaagtgataaggcatgaacactccactctcatgaatgggattagtgctcttaaaaaagaggttgaaaggattgctctggtcccttttgtcctctgtccctccagccatgtgaggacacagcatctgtggcaacaaggagccatcttgggagcagagagcaagctcttccagacactgaatctgccagcaccttgatcttggtccagccttcagaactgtgagaaataaatttctattatttacaaattacccagtctaagctattttgctatagcagcaggaatggactaaaggcgattttcctgggataaaaggactttctaattttattatcttagcctcaaaagcactagaaattctccttttattttttttcttatttaatttgtaaataattggatagttatattttagttctatatctagctagtatacaaataatgtaacaccatctcattttgctttacgtttcttagaatactagctagtaaggtcttatttcatatcctttcttggaaaccacatgtgtagtagccagtctcatgaaatccttgtgttgagtcactgtattagtcatctttttgctgaaacaatgctgctcaacaaagaactccccaatctcagtattatacaacacacatccatttctccctcaaggatctatagtttaggtatggattggtttaagtctgtcattttcatggcagagtgcaggagtgcaagagagttggcagagactcatgatgactggtctctgctcagaactggcacagtctcgcttctgccattttccgttcaccaaagtaagtaacatggccaagtccaaagtcattggtgcagaaaagtacagtctgcccacagagtgcaggaggggagagtaatatttgtggaacaataatgcaatccaccagtcactgtatgtgctgctttcttgctttttgttaagcttttctccttgtagatacatggtaactttattcttcctcatcccattttaacttagctatgacttttgaacagtgaaatgtaacttgtttcgttggctgaaacgtgagaggaagtctcatgtggtcacttctgggaagaacgcagacatttttaagagctagtacataattggcccttttcagtttccgctgttttattgatccttgaagatcaataagatgaagctttcatcaacctaagtccctgagttactgtgatggtcagagccttcctgctaaccctaattgaacatgtagaatgagcaagaaattcatttttgttgtattaagttactgagatttggagattatttattactggagcataatctagcctatcctaacacattgctttttatttccattttgcaaccaagtatcgttatgtgtgtgtctgctctcagttttctggcttagaactcaaataaccggccgggcgcggtggctcacgcctgtaatcccagcactttgggaggccgaggcgggcggatcacgaggtcagcagatcgagaccatcctggctaacacggtgaaaccccgtctctactaaaaatacaaaaaattagccgggcgaggtggcgggcgcctatagtcccaactacacgggaggttgaggcaggagaatggcgtgaacctgggaggcggagcctgcagcgagccgagatcgcgccactgcactccaacctgggcgacagcgagattccgtctcaaaaaaaaaaataaataaaaagaactcaaataacctgggtaaatgatgttgataaattaaactattcattttattctttcctgagggcactgctcttagtttggtcaactgattgtgcttcagggaatacctgaattgatgataagggacaaaaaatcggaaggtgtcacagtctttacagtcagctccaaatattccaatgatacttttacctttcattcagtttttaaaattcattttccttttcttctctccaacttgtttctgggtaaaaaggattattgatgttgatatagtttactgcataatctatacatcaataataaaaatagctatgtctaatatatttttgccagatcctcctctaacaattgtgtgtatactaactcttttcatcctcgcagcagtcttttgaggtaggctctagttaatgcccactttacaaatgactaatgtggagcacagggaggtaaattatactgcccacattcacaaagctgattgatggcaaagctgagatttgaaaccaatcagttttgtttcagaatggcctgcctaaccattttgcgtactgcttccctaattttgacacgtaacattggctgggacttagataggaggacaatatgtctgcaacatctgtcacttcagtgatccctgtgatcacctggttagtcagaacatgatgtcttcttgatccatcacagctccatgtctgtctctctaaccttgggcttaaaaaacaaatgccctttccagacaaagaggcatcattctgagatcaaggatacagtgtctgtagtagattaaagatgaccacaaattacttgctacttctcccattgagaggtggaatctaattctcctccctttaatatgggctacccttagagacttacttgactaatagaatacagcagaagagatgtctgactggccaggctaggtaagtaagaagccttgtagcttccatgtgagactcttgggacatgtcttctaaggcctaagctgctggataagtcaaactaccatgctagataaaccacgtgcagaggccatgagaccacatgacaaggggaggggcctagctgagcacaacgaccagcagttcccatcagggtgccaggcattatgtgtgaagcagtctcccatcagctggacacaactgagcaaccctaactgtggccactatggaataaatttgccctgctgaaccatgctagaattattgattaccaaaatgatgagatacaataaattgcttattgtgctaagttttggagtagtttactaagtaacaatagataactggaactaaatttggtatctgaaagtggactttcactataacgaaaactgaaaacaaatggcaatgactttgtacctggttgccacagaagttagaaaggcctcgagaaaaatgttagtgaatattggaaggacatcgaggagactgctggagagactgaaggacagtaaagaaaatactatggggggtggctgaagaaatgacctgtgttatgtagtggcagaaagttttcgtctttgataatgtgggaaaatagaaaaggtgcccaatgaatgggaggatctggctaaggagattttcagcagaatttcaaaactacaaagaggtttcttttagccacattattataagatattgattaaaaaaaaaaagaaaaaaaagtgggctaaaaaaggagccatttggtttttaagcagaatttagaggaattataaagaggcaggacttgctgggttcagaagagatcgggtgcattcagggtggcatggccgtagactttgctgggttcaaacatcaaactgcttctcatcctcaatctctctagacagggaaagctttcaaaataagaaatggcttcagggcaaaaataaattccaagatgtgacagctagacccatgattaagacctcaattaaggtggtgcctcatatatcctttcagttaaacaaaaagccttctacaatcttgggcaatgtacctctccattggacaaaagagtttctaagaattttaaggttctgttatcccatgtcagactcacagttagtccaagcaaggtgaaaaagctggcttcagaatgaaatgtgggtgtggcttttgcctagtaaagttcgttatcaattagtatataagacgccttaacatttttaagtgaattataccagcatggactgactgaaaaggatgaagagagtacaaagtgaaaagatgcctttggaccctcaacctgcctcagagaagcaggctgagaaagttacccagccaaaaacaaggattacttcttagggaaaaagaagaacggctcaaagaatggaaccaagagcccagaggactgatggatagccagagggaatcattcccaggagcaggactgggccctaatcaaggaactggtaatatgtactcagctagatttcaaaattgctgtggactactgaccgctgtatgcctgtgttctctgactcttcgaatgggagtgcctattatggttatcctatctctgtcccattgtttcttgggtgtgagagccccagtgacttcagatcaaggggaactatactcaaggagctgagtgccaggagcctcatcatcacctgaatttgagttagatggtgagaaagtggacttctaggctgatgcagtaaatgtcaggaaacttttgagggctttaggagagtgtgagtttattttgcttgtggtaataatgtctgtggccagaggaaaaggaatgtggtagattcaagatggctacaaattttttgctacttctcttattcagaggtagaatctaattcccctcccttggatctaagctggtcttcatgacttgcttgaccaatagaatgcagttctaggtcataaactcctgaacctgggcaataagaaaccttgcagtttccagtaggcctcttgatatactgagctgccatgaaagaaatctgactaccttgctggagctatagagaggagaggtcttgaggccaccagcagtcctcaaaggcatcaggcacacaatataagtgaagttacctgggacctccagagcagccctgccttccactgaataccagcaagtgacccagtcaatactgcatggggaaaacaaattgctcagctgagacctgtccaaattactgacccacaaaatcataagatacaataaaatggttgttttgagctactgaattgtggggtagattgtttatgcaggaatagacaactgagaccatgccttaaaatggacacagtatttttgatgcattatctcattcattcatccaataaataattactgtgaaccattatgtgtcaggcactactctttattctagagacacagtagtttaaaaaaaggccagcaaagaccctgttttcatggagcttacaatctactggtttagatagataataagtaaaggaataactacaatatgccagatggtgataagggcgataaagataagtgaagcatgtcaagggagcatcccagcaagacaaccctctttttatagaagagaaaacagagtcttagaaagattaaataataggcagtaagagaagcaagttcctaggtacaatgaaactggagtttcacttgatgaaacactgttcaatagaatttataaattcaaattgttgtttagcacaacagaggaacttaataggcagaagtgtggcttggatggatgttcctgactacccaggctgtccaagtaaactgttgtatatacaagaatgaaaagatctgaggtggagccaaggtggccaaataggaacagctccagtctagagctcccagcgtgagcgatgcagaagacgggtgatttctgccttgccaactgaggtactggggagtgtcagaaagtgggtacaggacagtgggtgcactgcacccagcatgagccaaaggagggtgaagcatcacctcacccgggaggcacaaggggtcagggaattccctttcctagtcaaagaaaggggtgacagacggcacctggaaaatcgggtcactgccaccctaatactgcacttttccaacagtcttagcaaacggcacaccaggagattatatcccgtgcatggctcgggggggtcctacgcccatagagcctccctcattgctggcacagcagactgagatcgaactgcaaggcggcagcgaggctgggggaggggcacctgccattgccgaggctggagtaggtaaacaaagcagcccggaagctcgaactgggtggagcccactgcagctcaaggaggcctgcctgcctctgtagactgcacctctgggggcagggaatagtcaaacaaaaggcagcagaatcctctgcagacttaaatgtccctgtctgacagctttgaagagagtagtggttctcccagcacacagcttgagatctgagaatggacagactgcctccttaggttggtccctgacccccaagtagcctaactgggaggcccccccccagtaggggcagacagacacctcacatggccgggaactcctctgagacaaaacttccagaggaacgatcagacagcaacatctgctgctcaccagtatctgctgttctgcagcctccgctgctgataccctggcaaacagggtctggagtgacctcaagcaaactccaacagacctgcagctgagggtcctgactgttagaaggaagactaacaaatagaaaggacatccacaccaaaaccccatctgtacatcgccatcatcaaagaccaaaggtagataaaaccacaaagatggggaaaaatagagcagaaaaactggaaactctaaaaatcagagtgcctttcctcctccaaaggaacgcagctcctccccagcaatggaacaaagctggatggagaatgactttgacaagttgagggaagaaggcttcagacaatcaaactactccgagctaaaggaggaagttcgaacccatggcaaagaagttaaaaaccttgaaaaaaaattagaccaatggctaactagaataaccaatacagagaagtccttaaaggacctgatggagctgaaaaccaaggcacgagaactacgtgacaaatgcacaagcctcagtagccgattcgatcaactggaagaaagggtatcagtgatggaagatgaaatgaatgaaatgaagcaagaagagaagtttaaagaaaaaagaataaaacgaaatgaacaaagccttcaagaaatatggggctatgtgaaaagaccaaatctacgtctgattggtgtacctgaaagtgacagggagaatggaaccaagttggaaaacactcggcaggataataaccaggagaacctccccaatctagcaaggcaggccaacattcaaattcaggaaatacagagaatgccacaaagatactccttgagaagagcaactccaagacaaataattgtcagattcaccgaagttgaaatgaaggaaaaaatgttaagggcagccagagagaaaggtcgggttaccctcaaagggaagcccatcagactaacagcggatctcttggcagaaactctacaagccagaagagagtgggggctaatattcaacattcttaaagaaaagaattttcaaccagaatttcatatccagccaaatgaagcttcataagtgaaggagaaataaaatactttacagacaagcaaatgcggagagattttgtcaccaccaggcctgccctaaaagagctcctgaaggaagcactaaacatggaaaggaacaaccggtaccagccactgcaaaaacatgccaaattgtaaagaccatcaaggctaggaagaaactgcagcaactaacaagcaaaataaccagctaacatcataatgacaggatcaaattcaaacataacaatattaaccttaaatgtaagcgggctaaatgctccaagtaaaagacacagaatggcaaattggataaagagtcaagacccatcagtgtgctgtattcaggaaacccatctcacatgcagagacacacataggctcaaaataaagcgatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagacgagctaactatcctaaatatatatgcacccaatacaggagcacccagattgataaagcaagtccttagagacctagaaagagacttagactcccacacattaataatgggagactttaacaccccactgtcaacagtagacagatcaacgagacagaaagtcaacaaggatatccaggaattgaactcacctctgcaccaagtggacctaatagacatctacagaactctccaccacaaatcaacagaatatacattcttctcagcaccacaccgcacttattccaaaattgaccacatagttggaagtaaagcactcctcagcaaatgtaaaagaacagaaattataataaactgtctctcagaccacagtgcaatcaaactagaactcaggattaagaaactcactcaaaaccgctcaactacatggaaactgaataacctgctcctgaatgactactgggtacataatgaaatgaagacagaaatgaagatgttctttgaaaccaacgagaacaaagacacaatgtaccagaatctctgggacacattcaaagcagtgtgtagaggaaaatttatagcactaaatgcccacaagagaaagcaggaaagatctaaaactgacaccctaacatcacaattaaaagaactagagaagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagaccgctagcaagactaatacagaagaaaagagagaagaatcaaatagatgcaataaaaaatgataaaggggatatcaccaccgatcccacagaaatacaaactaacatcagagaatactataaacacctctacgcaaataaactagaaaatctagaagaaatggataaattcctcgacacatgaaccctcccaagactaaaccaggaagaagttgaatctctgaatataccaataacaggctctgaaattgaggcaataattaacagcttaccaaccaaaaaaagtccaggaacagatggattcacagccgaattctatcagaggtacaaggaagagctggtaccattccttctgaaactattccgatcaatagaaaaagagggaatcctctctaacttattttatgaggccagcatcatcctgataccaaagcctggcagagatacaagaaaaaaaagagaattttagaccaatatccctgatgaacatcgatgcaaaaatcctcaataaaatactggcaaaccgaatccagcagcacatcaaaaagcttatccaccatgatcaagtgggcttcatccctgggatgcaaaggctggttcaacatatgcaaatcaataaacgtaatcagcatataaacagaaccagtgacaaaaaccatatgattatctcaatagatgcagaaaggcctttgacaaaattcaacaacgcttcatgctaaaaactatcaataaattagttatggatgagacatatctcaaaataataagagctatctatgacaaacccacaggcaatatcatactgaatgggcaaaaactggaagcattctctttgaaaactggcacaagacagggatgccctctctcaccactcctattcaacatagtgttggaagctctggccagggcaatcaggcaggagaaggaaataaagggcatttaattaggaaaagaggaagtcaaattgtccctgtttgcagatgacatgattgtatagctagaaaaccccatcatctcagcccaaaatctccttaagctgattggcaacttcagcaaagtctcatgatacaaaatcaatgtgcaaaaatcacaagcattcttatacaccagtaaaagacaaacagccaaatcatgagtgaactcccattcacaattgcttcaaagagaataaaatacctaggaatccaacttacaagggatgtgaaggacctcttcaaggagaactgcaaaccactgctcaatgaaataaaagaggatacaaagaaatggaagaacattccatgctcatggacaggaagaatcaatatcgtgaaaatggccatgctgcccaaggtaatttatagattcaatgccatccccatcaagctaccaatgactttcttcacagaattggaaaaaactactttaaagttcatatggaaccaaaaaagaacccgcattgccaagtcaatcctaagccaaaagaacaaagctggaggcatcacgctacctgacttcaaactatactacaaggctacagtaaccaaaacagcatggtactggtaccaaaacagagatttttggtaaacaaaacagaccaatggaacagaacagagccctcagaaataatgccacatatctataaccatctgatctttgacaaacctgataaaaacaagcaatggggaaatgattccctatttaatacacggtgctgggaaaactggctagccatatgtagaaagctgaaactagatcccttccttacaccttatacaagaactaattcgagatgtattaaagacttaaatgttagacctgaaaccataaaaaccctagaagaaaacctaggcaataccattcaggacataggcatgggcaaggacttcatgtctaaaacaccaaaagcaatggcaaggaaagccaaaattgacaaatgggatctaattaaactaaagagcttctgcacagcaaagaaaactaccatcagagtgaacaggccctacagaatgggagaaaatttttgcaatctacttatctgacaaagggctaatatccagaatctacaatgaactcaaacaaatttacaagaaaaaaacaaacaaccccatcaacaagtgggcgaaggatatgagcagacacttctcaaaagaagacatttatgcagccaacagacacaggaaaaaaggctcatcatcaccggccatcagagaaatgcaaatcaaaaccacaatgagataccatctcacaccagttagaatggcgatcattaaaaagtcaggaaaaaacaggtgctggagaggatgtggagaaataggaacacttttacattgttgggactgtaaactagttcaaccattgtggaagtcagtgtggtgattcctcagggatctagaactagaaataccatttgacccagcaatcccattactgggtatatacccaaaggattataaatcatgctgctataaagacacatgcacacgtatgtttattgagggactattcacaatagcaaagacttggaaccaagccaaatgtccatcaataatagactggattaagaaaatgtggcacatatacaccatggaatactaggcagccataaaaaatgataagttcatgtcctttgtagggacatggatgaagctggaaaccatcattctcagcaaactatcacaaggacaaaaaaaccaaataccgcatgttctcactcataggtgggaattgaacaatgagaacacatagacacaggaaggggaacatcacacactggggcctgtttggggtgggggggcgggggagggatagcattaggagatatacctaatgtaaataacgagttaatgggtgcagctcaccagcatggcacatgtatacatatgtaactaacctgcatgttgtgcacatgtaccctagaacttaaagtataaaaaaaaaaaaaaagaatgaaaagatctgcccttcagtagctggagtggaatggggcaggagggtttggaggaggatgtgtggctctgaagactatacatagtaggcaaagtgccagctgtgactcggaacaaccaaaatcaggaccaggagcagtttagaagagaaaataattcttggaaaaagcagaagtatttgtggggtacaggggaatttgtaagggacttaatttcctaagtgaacaggtaggagttcagaggcagctaatgctcatgggacttaattttatttccacagttggtaaaactcaaggacagtgtggttaccttcattcatttaattaaacaaacacagagcatgtgctaggcattgctaaaatctagtgtagaaatccagtgttaaaatctagtgtggaaagccaggcaagcattcatcaaaccataatacaaaccagatcgggtaaagtgctacaccaagcagaacatgaaggagggagtgattaattaaattccaccagaaaagtttttctaaagaaggtagcatctgagtagagtactgaagtatgctagcaatataaaattttatcatacattgggattgcaaaatacagtgcttttatttaaaattaaaaaatattattagcttgttttcatcattccacagtatacacatatatcaaaacattgtaccccataaatatatgcaattactatttgtcaattaaaaaattaacttaaaaacagtattgatgaaaacaattttatttttctctggtagaaggaaaaatattcccggtctcctgtgagtgagtgcctaaggtcccattcatctgaaagagcggtgcagcgcagctgaggttgctggcaggcattacaacagagcagttaagattactggctctacagtcagggacatgggttccaatcctcctcctctgtcaatttccaaccatgcaattttggacatgacttaaactctgtgctttagcttcctcatttgtaaaacaaggttaatgataataactacctaatagggccactgtaagaacaaaatgagctaatatatgaaaagtttttaattcattgtctagcacattttaagcattctataaatcatagctatttttcattaatgtttgcataccaggcaggactccaatactgtgtagaagtcatgaattttaatttcagttctgctccaaagtgctccctagggctaggccagtgacccagattttccatttctcatctttctgatttatcatgtgagaccaaagcattggcaaggaagctgaataagtggatttcctcacttgctggctggaggtctagggagcagaaaaggtggacatttcccccatcttgtatctgtcttgaggaagtgtgtgtgtgtgagtgtgtgtgtgtgtgtgtgtgtgtgtgtttatgcaggaatagacaactgggacaatgccttaaaatgtacacagtatttctgatgcattatctcattcattcgttcattcattcattcattcaataaataattactgtgaaccgtgtgtgtgtgtttattcagatccatccctttcaatggttagccttgtctgtcagccataacaaaaacctcaaacctcaaggaaagaaattacaaccaagccttcagacagctgatggtaatttactcacacaatcccctttatcctttcaacacccactatttatctgtatctgacgttgggagaggggaaatcatgcaagaaatatggtatgtaaatttctggaaagggggttggaatagtgagggaagacttgtgtgaattacatgaataattctccttgatttgaacatagatatcagttctcaaaaattgaagggactgatgttagggtcaataaatacatttctgggaccagaaacaatactggaataaattcataaatagctttcaaggcattcatgacaatcacaccatcactaaaatccgagtcattttccaggatggggcaagtagttccagtacaagtcaaaggagcatgtgtcaatcaatctagactgctttaaaaatccatagtgataacaataactaaatggaatgcatgatcctagttcagatcttggattggattctgaattagaaaaaaaatatattgctgccacgttcagtggctcatgcctataatttcaacacttcaggaggctgaggcaggaggatcacttaaggccaggagttcgaaaccagcctgtgcaacgtagcgagatcttgtctctacaaaaaaaaatttaaaaattatctagggatggtagtgcaaaccactagttccagctactctggaggctgaggtgggaggatcacttgagcccaggagttgagcctacagtgaactgtaatcacaccactgcactccagcctgggtgacagtgagcaagaccctgtctcttaaaaaaaagaaaaaatacctctaaggacaagatagccatatatatccatggtccttgcctttgtttcttgtatcatgccatctactagctggtccctgaagccatatataataactttcactcatacacacatatgagtgaaaagtaacactgatttttttaactttccagcttgaaaaatttaaaattttcaacatatagtaaagttgtaaaactagcacaataaagtcctgtaaatctttcaattgcttcatagattgttaacattttgccacatttgttttctctctttacacacacacacacacacacacacaagcacacagacacaatcattagtattattttgatgaaccatttgagagtaagatgtagattcttcacccctaaatatttaatgtgtatctcctaagaatatttaaaatcgttgcataactgtattatgtaaaagaatataacacccttggccgggcatggtggctcacgcctataatcccagcactttgggaggccaaggcggggggatcacaaggtcaggagatcgagaccatcctggctaacacggtgaaaccccatctctactaaaaatacaaaaaattagctggacgtggtggcgggtgcctgtggtcccagctactcgggaggctgagacaggagaatggcgtgaatccgggaggcagagcttgcagtgagctgagatcgtcccattgcactccagcctgggtgacagagtgagactctgtctcaaaaaaaaaaaaaaaaaaaaaaaaaaaagaatataacacccttttcaggtcagcttttatcactattaagcagaacactttacatcataatctgaagtctcagcagtgaattacttaactaaaatcaggagctaccctctgctagatatttggctcacatctgtacaaccaaaagtgctgatcaaaataatcactcccaggacaaaggcaaaatatacaacaaagacaaattccctcttctatgcaccagccaatttcttggcagtttagaacagctgttttgtcctttcttccagctggcaaaggttcaaaaatatcaagatacagcctcagaaagcttcacacgaggaagaaattttaatgagaaaaatctcacgttctgtattcgcttttgttttcatttttattttagcatataaaatgtcaaaatactgagctgttgagtaccgtatcaaacatctggcaattctggacaaaagatgagcaaaactcaacagtcctttatctttgcaaagttcaagtggctttaggagttaatgccataggggtagggtgccacgcctcatgcctgtaatcccagcactgtcggaggtgaggcaggcagatggcttgagcacagtagttcgagaccagcctgggcaacatgtgaaacccatctctacaaaaaatacaacaaaaattagccaggcgtgctggtgcacatctgtagtcccagctactcaggaggctgaggtaggaaagtggcttgagcctgggaggcagaggtcacagtgagtggagactgtgccactgcgctccagcctgggtgaaagagccagacgctgtctcaaaaaccaaaacaaaacattatatcagtttggtaaaagaacaagcacatccaacattaaccatcacaattcctttcgaccagaataatcttttattcagataaaagtatcccagttttaggctatgcgtgtgatataataataacagacagagaggtacagaaatacccaagctggcccaggctcagagcttgtggtatacagaagagaattattgcatcctttatttgctggcttcggtacattcttaggagatagagggagggaaaaaaaaatcaaaaccagaagggtctggtgctgatggaccagatcaattggttcaaactttgattcaactgttaaggtattcagggctggaactaggatgggaggagcaaggcactcacctgaggtgcgaagtttaaagcgtgccaaaatctcggtaatcaagataaatcatattttaatgcaatattttagaaaaatagtaatgcaaaaaaaatccgcaatgaacaaaatatcaaaactttaaataaagacaggatctgaccctgcattttcatgattcagggagtgtcttacttgcttcgtcctagtccaggcccaacttgttcatccccagatgatgtgccaaaagccacatctttaggtgtctcctctggtgctctctagtgctatgttctgctgaccttgttggcaacagctctctgtctgttatgaatggttggacatcaggtggcacctttaagataccacaaggtaaaagcaactctctgagccaaggccagctcttccaacctccttccaaacagtcttacgtctcaagggcaagtttctgtgatgtatagggcatcagggagagggtagaatggggtagaaaggggagataatgggagagggaaaaaagaacaggtgacctcatgagttggcactaatgtaactagagtgcaatttttcaagagtctatcttttttaagaaaaccttgagccccaactcttatttggaggcacctgctcactcacctccaaaaccaaatccacctcacctctattcttcttttcacattgtgtacgggtagttctggaaatcaaagtggccatgctgcttcctccatgcagcctgtagtgaattcaagtagtgtaggatacttcaaactggagcttctctactgtgaatagctgctcatccccaagtaccaaacctaattttgtgacaatgaaaaccatctgcaggtgccccctgctggtggtactatcctagagacttgccttcactgatgtattttgtttggtcaatggtccagaaagtcacagtcacagtcaccaacactattccctatgcccttacacctaagcaggttcacttatttatgctacccgccaggcacctgcaggtgtgtggcatttgcattttccttctatggcttcctagttcctcatggtgggaacctggggcccgacttcttgcctctcaaactattaatatgtctgcctcacagggccaggcacttctctagtcttgagtcacccatgtcattcttttaacctaccctcgggtaggacactggagccatagatgtgaaccttagcctttaaggcacgcaagaagacactgaagtccccagggccagtcactgccagcaatgtcttccagcggtggttgaagggatgactgaggcaagcagagtctgagtttgttattgttctgaggatatagacaaaaatctttaataaggcttacatagcttggcatagtcttcagcctcagctctggttatactcccccttcccttttgtgcttagtttgtactagtcttgttccagaagaagaaagggagaactaattctgctgctcctctggtgtccaggagctcaggtaatggatgcagactgtaataggcagtctctaagttggtccccagtgatccctggtcatcaaacccttgtgtaattccctcgccttgagtctgggatggatctagtactcatttgtaatgaatacagtggggcagcagtgatggaatgttgcttccgagattagattattttttaaaaagcaaaaacaactgtggcttccatttggagtatgcatgctctctttcttttagatcagttgtgctgtgggaactaagctaccatgttataagcagacctattgtgtggacaggaactaaagcctgccaaataccgtgtgcgtgagtctgaaaacggacctttcagcccctgtcgagtcttgagatgacagcagccccagctgagtgcttgactgcaacctcatgagagaacttgaggcaattctaaccagctaagctgctcccagatttctgaccctccaaaactgtgagtactaaatacttgcagttttcagccactgaggtgatttgctatgcagcaatagtaatagtaacaaacacacagacttctgaacctttccccaatccaaggtcattctgtggagttagagacccactctcccattcacaaagaagctattattctctctacagtaaagaaagacaaagaagtcagagcagttttttaacgctgcacatcaggaaactagatgtatgctgaaaatttgggagtgataagtaggacctttcccagtctgtagaatataccaccaaagcatgctcactcgagaatgtgcttttgattactaccaagcacacttttttttctttttgaagatatgtgcaaacaatgaaaacccttcttgctgaaattacaatatagccgtacattttggttgaaatgtttatttggagatttcaaagtcaaggttgatatagccaaaagataatacagattagactatcatggaaacaaaaagaatctaaaatttgatattgttcgtacactagggtcactgctcatgttaacatttccttcattgcatccactttctcggagctggtgttgtagggttagatgtgagtgtgaatgagcatgcgtacagtggacaaaatccccccattctgtaaatgcgtgtgcctattattctgggcagtgaacccagcctgctttaagtctttgttatttgaatagtgtcccagactctcctttgaaatgtgcggttcacctatttttattaaccttaatatggagctttctgatgcttttttgatagattcttggtcgtgcccaggtacacttcctttcgttttaaacaggtcatatatttctctgtgctggccttcaggtggtgtgccatataaattagaaagcaaattttcacaaggtcaaattttaatcatgcagcttagtatttttaaacagatgacattttcatacttggtatgctaacttgaagaccagaccatttttgcccaagttctaccaaaggttttcgttttatagtcttcatttgttttgttttggtttactttttaacaaaaagcaaacctaggaaaaaattttaaaaacatacaagatgcacaaaaacaattactctaatacacatgaaacagaaaatcaacacctgccaattaaacacaacttctaccatttcataactgtgtgatcttgtcaaattacttaacctctctataaaacgggatcacgatagcatctttctcacagaattatagtgaaaattaaataatattattcttatgaaatgtttaagatcgggcctagcatttatcatttactcgataaatattaatcatgtaattatatatgtaattatggtgataatgataatgttgctgccatgagatgtcaggtttcacaatataaaatcattacagaattctgtttggaactcctgtgagacctagtatgaatcacctatagttatgaggctgctctagcaaataaatctaagagaacaggcaacttcatgaagaggttaaagtgtcctagggcagtggtctccaacctttttggtaccaggaaccattttcaaggaagacaacttttccatggacagggtgggggatggatttggaatgatcatcaggtattagatcctcgtaagaagcaggcaacctagatccctcatatgcccagttcacaatagggttcccgttcctatgagaattgaatgcagctgctggtctgctgatcgacaggaggtggagctcaggggtaatgctcgctggcctgccactcacctcctgctatgcagccggggtcctaacaggccagaaccagtaccagtccatgctctgggggctggggacccctgttctagggaaataccatcaccatgtctgctacccctcccaccgtgggcgctaccaccatttggtcaccatatgcaaccctgtgtgaagatattcttaatactatccagggtccttttcatttgagtgacctctatctctttgtcccaccatctaactcccaccctcataatgagtggggagaaaacctccaccagggtgaagcaaaaaacctcaaacagaggcttcaaacaaaacttaatataaagactccaaccatgaagttgtctctttttatcccccggttatcttctttgttggttttgttttcgggatctgcagggtaccaagttatctgctagaaggctcagtccttctcttcttaccagccccactgctaccgccatgatgtaaatcgctatgatctcacattggtgttacttactgcaatagccagcaaagcagctcccttccttccactcttggcctcctaaggtctgttttccaatagcaaagtgactttttaacatttttcagatcatatgatgttcctgttttaaatcttcattggcttccccatgtccttagaataacatccacttcttaccacggcctatgaggtctcaggtgacctggctcaggttcacctctgccccctcctcttatttattatgctccagctgcactggccattttcttcctcaaacacactaagcttatttctaccttaggggttttgcagttctttcacctcctgctttaattcctctctaacgaaatttttttaaaataaactttattaatatcagaaatccctttatttgtatatttatttatttgttttctgtctacgtcctcactgagcctttatccaataattttgttcctcattttattctagcacctagtattgtgcctgccattccatatataccttttggaaagatcagtgaacagactccagctattttttaaaataggatttactggaagaggagacccacagaatcaaaggaacagttgaagactcaaaagaacaggctcagaaggggcaggaatagggaggggcaggaacaggggaagcaattaggatctaggtagcaagaaggggccgattggttctggccactttttgctactcttatgttgttccactgatgatgcaatgctcaaaaaatcagatcattgggaggccgaggcgggcggatcacgaggtcaggagatcgagaccatcctggctaacacggtgaaaccccgtctctactgaaaatacgaaaaattagccgggcgaggtattgggtgcctgtaatcccagttactctggaggctgaggcaagacaatggcgtgaaccccagggggcggagcctgcagtgagccgagatcgccccactgcactccagcctgggcaacagcgagactccgcctcaaaaataaataaataaataaataaataaataaataaataaataatcagatcatcctcgtgtgggtctcaagattatcatttagctcgggataccttaaacaaacttcccaccaagactataaaccatggcaaagaagacaattctagccaccccccccccaaaaaaaaagtagggttattgtccaaagaagggaggaatggacacacccacagtcaaaaacccaaaacaaaacaaaagtctgcaataatctctgacttgacattttgtcatctagaagacaactactttctttctttttttttttttttttttttttttttgagatggagtttccaggctggagtgcagtggcgcgatctggctcactgcaacctacgcctcctgggttcaagtgattctcctgcctcagcctcctgagtagctgggattacaggcgcctgccaccacgcccggctaattttttgtatttttagtagagagggggtttcaccattttggccaggctggtctcaaactcctgacttcaggtgatctgccccgctaggcctcccaaagtgctgggattacaggcgtgagcaaccgcgcacggccaacatctactttcttgcagtattaactgatgtttgtttaagagatataaacagatttcggccgagctcagtggctcacacctgtaatcccagcactttgggaggccgaggcgggcggatcatgaggtcaggagatggagaccatcctggttaacacggtgaaaccccatctctactaaaaaatacaaaaaattagccgggtgtggtggcgggcacctgtagtctcagctattcgggaggctgaggcaggagagtggcgtgaacccaggaggcggagcttgcagtgagccagatcgcgccgctgcacgccagcctgggaaacagagcaggactccgcctcaaaaaaaaaaaaaaaaaaaaaaaaagatataaacagatttcaatattaagtcaaataaaagaagaaagataaatctgttcaaaattatacagcatactaaaaagatatgcttttaaatgtcttctctgtcctatgattcagaataaactagaggtcaggagacagttccatgagatatccttttggatatcccaaactaaattaattctctcctttccctgacatctgcttctcataccatattatctatctcagttaatgaaattactatttactctctgactggcctaggaatttgtttagacagagtttacttgtctagagtaataaactggagaataacatttgtttccaccatctccctcatttcccacactcaattaatcaaaaaatcctatcagttctaactcaaattctccaacctatctcttcctcgccattcccaataccaatgcctgtgttcaggcccttattacctttggccgtgaaccacttgcaacagtttctcagtgatcttcactcaatccacttaagcccatctctcacacgattgccacacttacaactctaaaacaaagatctatgtctgccagactcttctttaaaagcttctataattccacactgtctacaaaaataaaagccaaccgcctctgtgtcttagctgaaatgacagaatacaaaagtttctcagaatgatttataaatgcaaccttttctttaatatggaggttctttaaccctggtatacatgagaaaacttgtagtgcatttaaagaacactgatgctaagacctcaatctgaaaaagtctgatttaattggtctggaatgaagccttacatcagctttttaaagacctcccccaaataattctaatatgtagtcagggttgaaaactactaatttataacgtggctagaaagacacttctacttccagacagcatgcggtaatagggttggtattcattccccttcacccctgacagaaattactaaaaaataggacaagatatataaaataattattttcagacactggatgtcagacaacataggaaagttatccaagagaagagagaaacaagcaaagtaagccatacaactgtcctacttaactgccccagagctcacagagagggaatccaggcagagcctggtgatctgcctgagttgaagagatcatgcagagatttgagaaggccaaggcaggtagagttcatggggaagagtaccagaaagaatagaaaattccagagatctgtggagagtctccttgaatattcagctgaatactgatcggtatatcaggaaactaccaaggttggggtaagaaccacacaagagaatcagattaaacaatcctcttggctcatacaaggctggaagtagtttgtttcatcatctactaaagtgggaaaagcctcataattaacaggatattggctagagtacttagaagggtatcacccaagtaatggggaaaattaatcatctttaaaaagttgcttgggttccccataatgaagcttaagatcaagaaggatctgtttccaactaacttaactgtgacccagaataaagctcaataatgtttatgggaatgcaaaactatctaacacccaatatgtaaaatgtttaatgtgtggtatcaaatcaaagtattgccaggtgtgcaaagaagcaggaaacagtacttaaaatgaagagaaaaatcaattaccagaaacatactcagaactgaacaaatgttagaattgttattatagtattttaaatgttcaagaaagtagaacaaagattgataaaatgaagtaaaatattaatacatgggcggggcacagtgcctcacgcctgtaatcccagcactttgggaggaggcgggcagatcacctgaggtcagaagtttgagaccaccctggccaacatggtgaaaccccatctctaataaaaatacaaaaattagccaggcgtggtggtgggtgcctgtaatcccagctactcaggaggctgagacaggagaattgcttgtacccgggaggcagagattgcaggttgcaaggagctgagaccgtaacattgacaagagtgaaactccatctcaaaaaaaaagaaaaaaaattaatacatgaaagttacaaacttctagagatgaaaaagacaatatctgagatgaagaatacactggatggaattaacaacagattagacactgtagaagaaaaagttagtgaacttaaagacatagcaatgaaaatgatccaaaaataaaacaagagaaagaagacaaaaagtgaacagagcatcagtgatcaatgggaaaaatttaaatgacctaatatatatgtaactgaagtccctaaaggaacggagttatagagggcaacaaaaatttttgaaaaaataatggctgaaaattgtccaagtataatgaaaactgtaaacacacagatccggtaagcgtaacaaatccaaagcacgagaaacatgaaagtaaccacacctaggcacattttaatcaaattgcttaagatcagtgataaagagaaaaatttataagtattcaggagaaaaaagaacattatatagagagaaacaaggataagaatgagagcataacttgaaaattaaaagacaacagagaagccaggcacagtgactcgtgcctgtaattccagcactttgggaggctgaggagggcagatcacctgaggtcagcagttcgagaccagcctgaccaacatggagaaaccccatctctactaaaaatacaaaattggctgggcatggtgacgtatgcctgtaatcccagctactcaggaggctgaggcaggagaatcacttgaacccgggaggtcgaggttgcggtgagccgagatggcatcattgcactctagcctgggcaacgagagcgaaactccatctcagaaaaaaaaaaaagacaacagagcaacatctttaaagagctgaaggaaaaaaagagcagtcacctggaattctacaaccagcagagtaggtttcttgtgcatacaacccgtgtagtcacacagggctttgcactcagaaggactggcttggtttaatgctctgttgttgatgacttgaaattcttaataatatttgaacagaggggtctacatttttattttgcattgagccccacaaagtatgtagtcagtcctgataaccagcaagaatatctttcaaacatgaaggtgaaataaagactttttcacatacaaaagctgaaagaattttcccaccagcaaatctgcacaagaataagaaggattaaagaaattctttcaggcagaaggaaaatgataccagatgaaaataatgaagaatattggaaatggtaaatatgtcagtaaatatgaaactttaaaaatatcttttacatcactaatcagtaaggaaatgcaaatcaaaaccacaatgatatttcactttatacccattaggatggcaattattttaaaaaacaaaaacagaaaatatcagtgttcatgaagatatggggaaactgaaacccttgtacactgttgatgggaatgtaaaatggtgcagctgctgtagagaacagtatggtcgttccaaaaaattaaatatagaattaccatatatgcaataatccctcttcttttgcaacccaaaagcattgaaaacagggacacaaagagacatctgtacatccatatctgttgcagcattattcacagtggcaaaaggtggaaacaattgaaatttccattaacagatgaatggattaataaaatgttgtataaacatacaatggaatatgatttggccttttaaaaggtacatcattataagcctgagcaacaaactgagaccccatctctacaaaaatatcaaaaaaattgcttgtaatcccagccatttgggaggccaatgtgggaggatcgattgagcccaggaggtcaaagctgcattgaaccatgattgtgccagtgcactccagcctgaatgatagagtaagactatctcacacacaaaaaagtacgtaattacaacacatgctacaacacggatgaccctaaaagagattatgccaagtgaaataggctggagacaaaacaacaaatatatgatcccacgtataaaaggtggctagagtagtcaaattcatagagccagaaagtagaatagtggttaccaggaggtaggggagggagaatgggtagctactgtttaatggatacagagtttcagttttggaaaaagagaaaattttggagatggatggtggtacttgttgcataataatgtgaatgtacttaatgcaactactgacctgtacacttaaaatggctaaactggtaaatttgtgggggaagaagagtttatttagttctttttttttttttttttttgagacagagtcttgctgtgtcaccaggctggagtgcagtggtgtgatcttggctcattgcaacctctgcctccctggttcaagcgattctcctgcctcagcctcccgagtagctgggattacaggcgcatgccaccacgcccagctaacttttgtatttttaacagagacagggtttcaccatgttggccaggatggtctctgtctcctgacctcgtgatctgcgtgcctcggcctccaaaagtgctgggattacaggcgtgagccactgtgactggactatttagttctatttattcatttatgcaatgatggtctcagcagtaggtaataaaatataaccttatatttaaaattcatttttcattttgaaaggtttggatctttgtctcttctttctactttactattttatttatttatttatttatttatttatttatttatttatttatttttaatggtggtggatctgagatctaccttactgttttaaatacttaactccgaccaaatagaagataaatacaaattgtattcccttacttttctctaaggccatgctggtacaactagaattggctctttagaatgtaggtatcatttatagtaagctggagatttgatcacagaatgatacatgtaagaatgtcatagcacaaaaaaatgcacagatatttttaaaaggacaaatttcaggacactttccatctgagttcataagaaagtcctcttgagtatccttcaaagttaaaaccctctccccttcagattaatgaaaatattaggatgcatagaacacaatgggcactggtgatatggcccatggtagctgaattagattgagtataaatgaagtcttcacataatagcaaagaggccaacagaagaaaggccagaaagccacttgaaactcatgtccatggaagaccaaatgaagttgatttaactgttcccttagaaagatattatcccattgcttagccctcaaagtgctcatactgctactttccttctttatatcaccagttctgggagcaaacctcctgaaagaatggaagtatagactgtaaatacaagactgtgggtacagcaaaggggctctgatgctctagttgtttgtgtctagatactgtcaaatgtcccttgtgatgcacaattgcccttagcggagaaccattaaccaaaataaatgaaataatatgtcatgttcatgcatcagaagacccaatgttgttaagatatcaattctctataagttgatctatagactcaatgtgaccccaatcaaataccccactggctttttgtctacatttacaagtgaattctgaaatgtatatggaaattcaaagaacctaacacaatgaaaacaattttgaacaagaagagcaaagctcaagaatttgactacgtgatttcaaaacgtataaagctactgtaaccaaatcagtttggtattagtctaaagatggataagggaggctgaggcagtagaattgcttgaacccaggaggcgaaggttgccgtgagccaagattgtgccactgcactccagcctgggcaacagagttagactccatctcaaaaaaagaaaaaggaaaaaaaaaaggcagataaataaatcagtcaaacacaatagaaacccagatacagacgattatatatgtggtcaattgatttgaacaaaggtgctaaggcaattaaatggaaaaaggatagtgctcttaacaaacagtgttagaacaactgtacatctacatgcaaaaaaaaaaaaaagataaaaaagaaaaaaaaaaacaccttgatcacaatatacaaaagttaactcaaatggatcataggcctaaatgtaaaaatgcaaaactataaaacttctagaaaaaaatagaatatttttgtaatctggattaagtaatgatttcttagatatgacattaaaagcagaaccataaaagaaaaaactgataatgtttatttaccacagcaaaattttaaaatgtctggtcttcaaaagacactgttactaaaatggaaagacaatctgcacagtgggagaaaatatttgcaaagaacatatataataaaacttgcatttagaatatgaaatgaacccaatgaactcagtgaaacccaaacaactcaatggaaaatgggcaaaatatttcaacagacactttaccaaaaatatgtagataataatcaagctcatgaaaaaaaagctcaatatcattaatcattagggaaatttaagtcaaaaaaccataagatttcacacccactagaatggctataatataaaagatgtacagtaacaagtattgagaaggatgtggagaaatgagaaccttcatacattgctagtgggaatgtaaaaggtacaacccttttggaaaacgatttggcagtttctttaaaagcatgcctagtgttatataccccgagaaatgtgcccaagagaaatgaaagacatgtgcacagataattatagcaactttatttgtaatagccataaaactggaaacaactcaacgaatggtgaatcaataacgtgtagcacattcatacaatgaaatactactcagcaacaaaaggaaatgagctactgatacccacaacagcatagataagtttcaaaataattatgctgagtgaaagaagccagacaacaacaaagagtagatactgtatgattccatttatatgaaattctaggaaatgcaaagtaatatataatgacaaaagcagaggggcgggaaggaggaatttaaaaagggcagaaggaacctttttgggatcatggataagttcgtcatcttgattgtggtgatgatttcacaggtatatacatacgttgaaacttcaaattgcacactttaaatttgcccagtttattgtatgtcagttatatctcaataaagctgtagaacagcaacaacaaagagatggctagacaagcatattacagtagttgaagtttgatgttagaaattcactgaatcttctctgaagtcattgtcctctgacagttgtctgcaggtttcaagctatccacctacacagaatgtgcaatctgctgggcttcaaaagcacacattgaggcagatggccaacagctgacaattcacttaatttctctttttaaatagttatatacttgaaaaaggatcgagtttgaattaaatcctcacagaaaatttctatcacagcatgggattcacttcaataaagcatcttcccactgtcataaatctgcttgtgttcttttggcaaaattttcttcccactcaacctggctttgttatcttgtcaagccagacaaaaattcacctcctgtataaagccgtctctgatcatctgcctttttaaattttttaattttttaatttttcttttttgagatggagtctcactctgccacccaggttggagtgcagtggtgcaatctcggctcactgcaacctccgcctccctggttcaagtgatcctccttcctcagccttctgagtagctgggatgacaggcgcaccaccacacccagctaattctttgtattttcattagtgatggagttttacaatgtcgaccagactgatctcaaactcccgacctcaagtgatccaccggccttggcctcccaaactgctgggattaacaggcatgagccaccgtgaccggcctcatctgccttttagcaccatagagaggtgccattaaccacctggtttatattgccagcatgtaggggctgtaatatggtaccccagccccacctccctaccccatcattattttttcttaaagaaaataagcttgccacttagaatttaaactttacaattaagataaactgatttagagaataaatgtagacacttgaaacagtcacaaggatccccaaaccagattataatctgactgaaaatattagcatatcagagatagaaaaagagatgtacctaagaagggaggacaatcatcagtggacacttactgtccaggaaaaaagaacctatgtgtacaccttgatgctctgaagctatcaaattatttgaaatttagaatccactaattaattcctcttgctctagattcaagtttcaaaaacaaccttttggctgtaatttggctctcaaatgtggcacatataccaagagatattttgctggaatcataaaagagagtctagttccctaagatgttaaaattctcattataaattagtaatttgttattctgggtttatatagtagtcctgtgatttatcagtttaagaaacagacttggctgggtgcagtggctcatgcctatagtctcagcactttgggagggtggggtggtaggattgcttgaagccaggagtttgagaccagcctaggcaacatagcaagactccatctctacacaaaataattttttaaaagtagccggaaatggtggtacacaactgtgatctcagctacttgggaggccaaggcaagaggatcccttgagcccaggagttggagactgcagggagctatgattgcaccacttcactccaacctaggcaacacagtgagactccatctctgaaaaaaaaaaaaaaagaaagaaagaaaaagaaaagaaacagacttaacaagttaaagaccagatttcaacatattttccaagataatgccactttctatggcctgttagggaagtcagctttccttggagaaatagagagagagagagagagagagagagaggtctacagttcatctttctgttacagcacttactccatactccagttactgaagcacattatagaactacagattctgagttacctgagggtagttttgtatccagtttgtgctggcctccaccatcattgctcaataagtaacactgaactgaactgaatttggataacgtgcaaagctgcttttttacattttttagttgattgagagttagaaaatcgtaccaaaaacaccactccccaagtataacctctaatacgctaacattcattaaacctctaacactatagctaaagttgttacattttttaaagtacgctaaactggggaattgatttttaaataaagggcaaagtagcactaacctcagtcaagttgctgtaagtgtttcatttgggaattgtgaaattttttaaaaacatttcaagacttatcattacatcaacgaagatgaatataggtgtagtttgtcagatgagtaactattaaggaaaccatgaatgtttgctatctactttcacaattaaaccacaatttagaggatcaaattctaaccctataaacttttttttaaccaaagacagggagaaaaatcatactcttgtgataaggagtcataattcattttaaattctgcaggattaatgctgctttccagataagaagaattcaccccgtgtgcgtaaggtgattaaggagccttggaattataaatacacattcagattaatttttttgttctaagctttaaataaaatttcaaagtattttataaaataattaacatcccatagatatgcttttttaaaaaagtaattaggtctataaaagtaatttgtataaggcaataaaaattttactttataaaaaaatcaaacaatgaatactttttgcttaattctttcttaggagcagtaatttattatgggttccttagaagacatgtgatttatttaagctctattaactgaatgtgagtctgttttctgacataaacagtggatagtgttatgaaaaaataaaattgtcagtgaataggctaaatttcatagttcacaaatatagctatcctgaacatagaatacagatccaatgaacatttagttttataattagcactgttttaatccaaattccaattttatgcatgggaaactgaggcctagagaaatgaagtaactttttacagacccgttagctcagaggctggaatcactaggcctggtagtttgatttatgagtactaccttccatgagataaaaagctaaaaatgctgtgatgaggacatgtttatttctaaaaagcctgcagcacaatctatctcttctcccaaaaatcgtatgtatgacagatttttatgttactgctgctacacgaagaaaattgagcctaatatgttcggtcttccaggccaaagcaaaggattgattttagaaggaacttgtcctgcatggcctccatccagccatcaggcagggctccagctctgcaggggaaaaagagatagcccaggaagagggaatcaccacccaccccaccctgcgatctgtatctaagagaaataaccctgaaaagaagagctataagagatggcagtgtgtgctttcgtccgggtgcacttcccgatccttcatctttcatgcccatctctgatgtttccatcctggtatagccttctgagtcatgtgttcatctctcctttggctcaacccaacagacacagcctgcaatctcacctccgtcaacacagcaaatgtctgtgtctcaaagacctcgagatagagcttcctatgctttaacccttccaggggcacacctttatttctgggcaactcaacactgtccctcctcctgcctccaccacgggccccattacctccctacccttctccaagcagtagtcactcagcgccaacccctctcaggcgtcgggatcttcagtccggggccccagccctccgcgcggttctcctgcccagcgcaccgtgcgttgccacccccatcgcgttcctcagcctcccgggctccagaggcaggagctggccatgctctcacctcatccagggtgtggccgccgcagctgcttcttcctcctcggccgctgctgcccagctcccggctggctccgggcgccgtctttcccggctcggggtctgccgtggggactgaggggttcgcgtcgcgtccccggaccggtaaggcgtgtagtgagcccggcgggacgcgcgacagcagcagccaaagtcgcatcggcggcggcagcaggacccgctgtctgtgcccttcatggatttcctgggcctggccaccccagtcctagctacggttcctgcttgttttcctggtgtcttccgggactgccagggcgcatcctctgggcctggctgagcatccccgtcagttccctgggcctcctccgcggctgcctctgccacctgctccgcccagattgctttggtccttctcccgcagacacactcagctgcccttcatcctctgtcgtctccccattctctctccacccactgcctcattcccagatcccacgccgtttcttcctttctatccgctccaatgtcaccttctctttatttccaacctcagataagttt

SEQ ID NO: 1126 - DNA, 785 bp, Homo sapiens
ttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagcacagatgaaaaactgggaaccatttgtgttgggtccagcatttgccatggacaagatgccagaacctgtatgctttcggatgaggttctcatcatcaaatttctccccatagatggacttgtcaccagtgccattatggcgtgtgaagtcaccaccctgacacataaaccctggaataattctgtgaaagcaggaacccttataacgaaatcctttctctccagtgctcagagcacgaaagttttccgctgtctttagaatcttgtctgcaaacagtttgatggagatgcggcccaagggcttgccgtcgacggtgatgtcaaaaaagacgacggagttgaccatggctgatagtacagggctcacagtgatggtggcgtctgcaaagataaccactgatctttttactgtctttatagt

SEQ ID NO: 1127 - DNA, 20516 bp, Homo sapiens
cacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacaggtgagctgcttactcacgacccgcgaccccaagtctctgtcagcgcgctttgccctcagcatcggattccttcctaggaccgggagacctttgtgacttcccgggcactcccgacctctctgaagtgcgcttttatcttttggtgtaggagagactaccggcgaagaggaaatctttcctgaaggaggagttaagttttttgtgttagctgtttctctttagaaaaacgctctggagaagtggtagctttggttgattgtgatcacccagtgttctttgactctttagggactttgttaaaattcaggatttctaattttctgctgctaataggactgctgatggataaatcctgggaaaaaatcagccaagttcttcaagtctataacgtggcacctgatccttgacctagcttgctgacatcttttgaaagtgggtgaggtaatattgccacataaaagcacctgttaaatttcagtacatcacattctttcaggattatccccagttcccaccttctccaatacgccgtaccacattcctgcaatacattgtaacttatttttttctttgtctttcaataacttgagtttcctagcgggcaaacgacgggtcttaatcatctctttgttatccataccttttacaatagctgctttatgctagtaggtgctcaaaagtatactgaattgattaaaaacagcactaactccagatgtcttaaaagaaagatgttttgtgttttagaaacacagtggaaatttctgaagtaagacaagtttctggagcaagcttgggaggttctgaagacaaagctgagaatggaatttatataatttgtttaaagtgatcaattttattttacttttccatacagtctaagtaaaaccttgagccttaaaaaaagatgagatattgaaaaaatagtttgcacatttcttctgttggacttttcattcatatattaatgcaaaaaatttttactgagcacatcaaatgtgccaggcatagtgttaatgcagggagttagagtacacagtctctacctttgtggagcttacagtctagtggaaaaatcagataaccaacaaactattaaaatgtagtttaactgctaaggagaaggaagagggttttgtgcttgaacatggaaaatatatctaagttggttttaggaaatcaggaaagtcttcccagaaggtatgacactaaggtaacagtaggatccagtagtaaggaactattattctatttggttatatgcctttttaggtttgatttggaaatatagttactttcacttttaggagagtggtgatacagataataaagttgcaggtcatgctaagtgaaatatattctattcattacataaaaacaaagtctaatctttgaaataaaccgtgaacaatttaacataccccgatttgctaatgtgaaatgtttttcaggaatactctaggaccatcctgcagaaggagtgtaattgttcaaatgaacctaggaatatgatttgaacaaagtagatagtgcaggggaatatccttgaaggatgtgtagtttgactaaaaaatagttttcctacagtgggtggctgtgtgttgggggtaggggggatggaatctggtcaatttttaaattattgcattgaattccagtgttagcaaagaatacaaagtgaacttgaaagtctacttaatattagtggcccctactctctgccatgatactttattgaaaaattaattgatttattgttttttaattataaatttggtattggtttcatattggtttatcaagatgggatgctttgtttaattgacaaggaaagaaattttacacacaaatatttttgtgattgtagtgccatagtattttcctttaggaattttgactttgaataataaagtttgcctaaacttttaatgtctgtaaagatctgaatcttaggcttacttttactattttaatagtatacagaacatttataaaagcgcctactacataccaaacactgtgctaagcctattaagttcatttttttatttaatcctcatactaccatattagaacaggtactattaaaatctccaataatagataaggaagctctgaggcttagagaggatagatcacttgcctaaattcacagctaatgagtggcataatgaaatttttcatcagggtttttccccttggcactgttgacatttggggatggataattatttgttcttggggactgttctgtatattgtgtaggaggtccagcaatattcctggcctctaccctctagatgccagtagtaccactacccttccccactttgtttgtttgtatgacgacaaaaatatttctagacattgctaaatgtctcatgggggcaaaatcaccccaattgagacccagtggtttttattaagtttttgtcgactcagacaaaaacttaataaccactgtactttagtgcctaaccactgtactttactgccttgttctaaggccttttaatgatgtcttacctcttaggagtccaggaataactttttaataaacagatatctcaaccaaacagttttatatttaatcaccttaattgtccaggccagataattcaatgtattttcatttttgtatgtttttgttttcttatcagtgtactttcagtatttacactgataatagatatcatattttaggtatttactaggtgcctgtacaagctgccatattaccgaagatggacagttattcagataatacaatagagagtaaaatttacaaaataatgtagacagagtattttatacagggtgtttcctctgtgtttaactgaaaatttagacttagggcaggaagagagatgagcgtttcttctcaaatgtggactccctaactgataccctgtttatcttttttcctcattccttttatggcatgtttctccttttaggatttttgcaatttctttatctacctttctgttctgcctcaaaattattgtattttctttcattttcctctggcatcgtgaagggcagtccagacttgaagaaagtgttagatctcaccaaataggcagcaggaagctccaagaaagcagatagataacatgttatacagttaaattgtctcacgctcccaatcactgagggttgattaatccacttactgtaactgcttttagaggaaagtggttggttcttggtgctgctggtctttgaccagctgagttcagtgggtattgatacccactgaactcagctatgaaaatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataatcatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctccctttttagcttagaggctaaaaagtttgacttctcaagtaaaaaattgacataataattctaatcacctcatgaagaataaacgagttaaataatgtaaagtgttcagaacagtggctggcagaaagtgaacacttaataatttcatttgatcatttctgaagaatcttttctaattccatcttgcctttcttttttttttttttttgagatggagtctcactctgttgcccaggctagagtgcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcgtgaacccccatacccagcctcatcttgcctttcttaaaggttcacagatcagaactgcacataatcgatacactggatgcaaatatgtaatgaatgaatgatttttcacattacaaaattaatttgtgcgtattatagaaagttcagtaaatacataaaagcaaaatgaccaaaatgttaacagtgtttattaactataatctgtactcaaattatatccattttggtggatgaccttaaacatatgtatgtgtgtataacattaaataataggtaataccgtaagactgtttcacctaattttttccacttaacagtgtttaatgaatattttctcatatcattaaactctatacagcattgttttaatggctgcatagtattccattgtatgaatatgccagaaagattattatttaaccatgaagattgtgctagcattgtgttctcaaggatggtaatgctaactgaaccagcatggtaaggtgttggttggcataccataatccctataaatacatccccagtgttgtatattggcagtctttacattgctgtttgcaaattcctgaaattgcagaatgcttttggccagtttcttatagttgatacagttgttagtctttttctcaggttacagtaatgtttacagtgcctcttgtaaagtcaaaggatttgtaccaatctgagtggcaattttttccatgtttcttcaactagtccttttaagattctcacctgcctttagcaaagaacatatatttaacacctgtggttgcagttatgtaaaaaataccgatgtcacagccccacctccaagatgctgacttaattggtttggtggtggagactgggcataagtagttttgtttttgagatttccccaaatgattctattgtgaagccaaggttgaaaatcaccgatctatgttgatattctttcttggcacttgagtagcattcccaacattatttgcatgctttttatctactcttgtgggttcagatctcttcagaatggcactggggaaacaaaaagattggtaagtaccattcaaatttaggaaaatagaatattgggcactagttcttattggctaaaagcatatgacagtattcactcttactggctggccatatattagtagtactgtttaatatgataattttgatataattattataaagtactgtttaatatataaaactgtacatacatacagacatacatatgttaatatagaactatttctcaaatatataacaaatatatgtcaataaaacaaataattgccataacagtggtattaaacaagataaatctacaaactaatacctcgactggactctgcctatctcccctggttcacctcatgcttattcaccttcttattcatactgaaatttccagttcaccatttttacatatagcttagaatcttattatcctgtaattgtacatttgctgatctgccactttatcattttattgttgcttccttgtttttattatcagcttagcagtacactatctacaattttaagatatcactttgtactttatcaaagttagacctcagatcctgggagaccctagcataaatacttttctacttaaatatttagttattaaacatctgccaaagggaggctattctttctatgtaaaataaataattccaaaataggattatttctttgcatcacatggcagtgtcctagtctgggttactatacaaaataccataaattgggtggcttataaatgacagaaattgatttttctagttctgcaaggtgaagatcaagcaccagcagatttggtgactattgagggcctattcctggttcatagatgtcaccttctggctgtttcctcacatggtggatggagcaagctagccctctggggtctcttttataaaggtactagtcgcattcatgagggctctaccctcatgacttaatcacctcccaaaggtcccacttcttaataccatcactttggggggttaggatttcaacatgaattttgtgggggataccagcaaacattcagactatagctgggtagctggcagaaagctcccctaccccacatgtggatggaaaaacaatgtctatttgcttcccattcttcaggcacttcctttccctgttggatctagtagattggagatgcatggttttcttcttttgaaatgacactgctggtttttccagtagatttgccccctctttttaacaaaaataattgtaaaagcagttagaaattgttcaggaaaatattacctgtaattataacatgtgaatgctattattttcatttttgtctgcatatatccctcgatattcaaacttttgctgtccaaacttgggaaccaaatagatttcttcagtaaagggtatctgacatgctaatctttgtctctacccttggtcatttttatgtaattgcagtcaaagtgttcataataatttgcagtcactagtacacacatttagttttgtttaaatgctaaaaactgtaacacttgtggaaggttctgctggatattccaacataaaaatgaaattcaccaatcttgttcctaggatattcccctgagtatagcacatgctgtgtagttctgtgccaataactgcaaatgaaatgggttaggaggagagtactgtcctaatagtggaaagaagactggattgaaagttaagagtgcttaagtgtatttgaggtatatgcttttgcttcttagcaaataactaatgcgatcatcttgaagaagtaggggttaggtcttcctctgtactctgaaagtaggttgtctttcctccgttaaaatgaatcttacttacctgtaaatgaaggacctcattcagagtgtcctcataatatggtgcttctcactaattgatacagcattttgtggaaaattcttaaatgaagatgtcttctttcagtctggccgggaccttcaacagtatcagagtcaggctaagtaactctttcgaaagttgaatgaacagtcccctaccagatgtaccttggaagcaggagccatgacttttcagtgagtgtaatcttgatttctttatgatcatttaagtgtgaaatacagtaacagaatgcctgataaaaaataataatttttaaaaagtaaagattacttaaaaatgttgtcttttgggaggagcaacttctctggctctaattctacaaaatggacatcttgttggttttttcagcatgcttacagtaatttaacctgttaacatgtgtctatgctgtgcccatcatgcaataatagataacttcttgctttaggactgtcttggagccagatatgtgtaggttagtacccttgctcaaacatttcctaacagtgtaactttgagcagctcacataacttctctaagcctcagtttcctctataaagtagtgaaaataaacataggaggtttgagaggattgtgagggaatccgtgtgtattacttagcatcttgtctgacacacatgggaagggtcaataattattagttattattattttgaaaaaagaaaattataaaagataagagcatcttaatcagtggttataaacgatacagctgatagaggactcaaaggaacattattggattttaaattatctacaaataattggtatttaatgtttaatacatgccaagtttgaagctgacaaaatgggaaggattaaaaaggaaaagagtacaagagcatcagaggaaaataaaaacggattagttaaataatctttgctattttagggacttagatagtaagataacttaggccagggaggaagctgctatgtttacttttaaaaaacaaaacaaaaattctctacctataaaagacaagtaaaaagtacatcaaaacaaaaataaaaccctaggcaattggctaagaaaatgttggacattatgttttatgatgtattaatttttataatatctgaaatattttctagaactctaattttcaacaccaaaaatagtcactcacttaatatctagtatcctcattttcaccatggtttagagaaccaagacctaggaaagttctcatggaattgagaagagattttcttctgcctgattcctttaggacattcataatctcatatcatcctttatttccatccaagagctattaagggtttattctttgccggaccttatattgagtcctgcatttaatgtccataccttttaacactgttctcttagtacagagagagacatatactcaaacaagtatactataatatcttcattgaaaagatgttgtaaattagatttaaatgaaatgttttgggaacagagagaaggaaggaacaaattcccatttgtagggggtaagtttgaagaaacgggacagaggaggggagtatatttaaagaagtttcacagaaaaaattatggtagaattgaacatatggaaatgaacaggatttctccaggtatttaaaagagcattaatggttagaaaaaacaatataagcagaagtccacaaatatgtaaagaacctagcatgttggaaaacagtccgccatttggtttattaaaatatatgatagaatgttgcttacacttgttttgaaaggctgtaaatataataccatggagtatgattttattttgtaggtattagggaacccttagagtttgtaagcagggtaatatggtcatctgtagtctctgggaataaaactgatggtatagaagatggtgtagactaaaagcaaagagaccagttaactcaggtgcccaagcaaggaataagacagctgtattattaatattattttaagggacctgagagatcatataatagtctttatcctttatggagccctaggatgcctcaggagccacatagaaagggcaaggatgggagtatatataatgctttgggcccctaaactcctccttatgttttaaattttttccttttattttcagttgacatgtaataattatacatatttatgggatacagagtgatatttcaatacatgtatacaatgtgtaatcaaatcagagtaattagcatattcatcacctcaaacatttatcatttctttgtgttgtgaacattcaaaatcttgtagctttttgaaaatacgtggtaagttatagctagccatatttaccctacagttctgcagaacaccagaactcattcttcctatccagttgtaattttttatccattaacttgcctctgcccatcctccccttctctctacctttccctacttctaatacccacaattctactctctacttccatgagctcaaaaattttttttggctcctacatatgaatgagaacatgccatatttatctttctgtgcatgactgattttatttaacgtaatgtcctccagatttatccatgttgctgctaatgatagaaattcattcttttttatggctgaatagtattccatggtgtgtgtgtatgtgtgtgtgtgtgtgtgtgtgtgtgtgtgtaaaaaacacttttaaaatccattattctcttgatggacatttctcttgattatctatccatagatattatgaatggtgctgccgtaaacatgggggtacagataagtttttaacataatgagtttttttcctttggagaaatacccagcagtgggattgctagattgtatggtagttctgtttttagttttttgagaaacctccatactgttttccatagtgtataaaagttctcttttctcttcatcctcaacagcatttattgacttttgtctttttaatagacattttaactggggtgaaataatatgtcgttgtggtttttatttgcatttacctgaagattagtgatgttgagcattttttcatatacttggccattcgcatgtcttttgagaaatgtcaattctgttccttgcctactttttaattgaattatttttggttttgctgttgagttgtttgagttcctcgtatgttctggatattagttcctcatcagatgaatgaaactagatccctatctcatcatatacaaaaatcaacttaaagtagattaaagacttaagcataagaccctaaactataaaactactagaagaaaacataggggaaatgcttcaggacatgaacctgggcgaagactttatggcaaagacttcaaagcataggcaacagaaaagaaagtagacaaatgggactgtattaaactaaaagcttctgcacagcaaaggaaacaacacagtgaagagacaacttgcacaatgggagaaaatatttgcaaactcctacttaaactaaagaacctctgattttatctgatatatacattggccttctgaatataagttttgcttgttatatatacatattccatatataaatatatatatttgcatgtgtgtgtgtgtatactatggctaaaaagaagttggaaaaccacttagtagcctaacatttttctaagaatttctcagatgtgtaatcatatagccccttccagagtgcatgggcgctcatcatcacaaaagaaagtcagttccattgttgaaaagtttccagttgattacagagtcctcctggactgtaaattaaggagtcttattagtcttgtacccagtaaacattatgtcattaaccttacatttctatccacagaaatttccagttacagtgttttcctttgtggctggaaagagtttaaatatgtgtatgctagtttaccatatagaatcaaagggtggatggagtcacaactctgaatttttcaggaaaaagtcttaagtattaagcaaaaaacaaataaccccatttaaaaaatggacaaaagacatgagcagatatttctcaaaacatactagaggctagcaaactaatgaaaaaatgcacatcactaattattggagaaatgcaaatcaaaaccacaataagataccatctcacaacagtcacagggctattattaaaaagtcagaaaacaacagatgctgatgaggctgtggagaaaaaggaattgcttatacactgttcgtgggaatgtaaattcagccactgtggaaagcagtttagagatttttcaaagaacttaaaacagaactaccattagacccagcaaacccattaatgggtttatatccaaaaggaaacaaatctttctaccaaaaatcatgcacttgcatattcattgcagcactattcacaatagcaaagatatcaacctaggtacatgttagtggtggattggataaagaaaatatagtatatattcagtatggaatactatgcagtcataaaaagaaatgaaatcatgtcctttgcagcaacatggatggagctggaagtcattacctaagtgaattaatgcaggaacagaaaactaaatactctatattctcatttataagtttataagctaaacattgggcactcatggacataaatatactgaggacttactagaagaggagggaaggagggggcaggggttgaaaaactattaggtagtatgcttagtacttgggtgacgggattgtttgtaccccaaacctcggcattatgcaatatacccaggtaacaaacccgcacatatacatcctcaagctaaaataaaagtttaaaatgttagttgaagaattgtgtaatgggctgggtccagtggcttacacctgtaatctcagcactttgggagactgaattgggtggatcgattgaggtcacgagtttcagaccagcctggccaaaatggtgaaaccccatctctactaaaaatacaaaaattagctgggtgtggtggtgggtgtctgtaatcccagctatttgtgaagctgaggcgtgagaatcacctgaacctgggaggcggagattgctgtaactgagatcatgccactgcattccagcccgggtaatctgggtgatcgaaagagccctgtctcaaaaaaaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaaaaattagctgggcatagtggcgcacgcctgtagtcccagctgctcgggaggctgaggcaggagaatggcttgaacccgggaggcggaggttgcagtgagccgagataatgccactgcactccagcccgggggcagagcgagactccgtctcaaaaaaaaagaaaaaaaaaaaccaaaaacaaaaaaaaaagaatatacatctaataatgggaagatgtttgctttctgattccaaggatttgcggttttaaattgactctcgtttagccagcctcaaagtatttaggctagatttttaaaaaagtttgcatggtacagagattctgctttaaactattgtcagtgctattactttacagacaactttgtcttgctttttatgtctcaccagctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatggtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaagaagacaaatgtatcagggtcatacaggaaacagatggcacacccaaattagcttaagggattatatacaaagatatgactaggctgtaggagaattacaaggtacagtaacctctgaccagtagcatactggttgttaccatccctaggcctgaatgtataagggggaggagcagtttctgaaactgaaaaggagaaaatttctagagaaggccaacttgagaggagcgtaacttttggtagagggatacttccagaagaaggttatttccttctctgaaagaagccaggggaataaatacccggacatcactcactgtctgttctccttcttccctactgttggggcttcttcattgcctgaacctaactggcacagagcaaggagtctattgaggcgcttcatccaagtcagcttcccagtgcagaaagcaaggtgcaggagggcagagaggagatctaaagaggcaaatgaaaggggtacagcacacttaaattaagatttttgccaaaagttgaaaatatctttaataataagtcgttcttcctatagttttgagaaatactgatatgagcaaaagatggatgagacttcagtttttatttatttatttatttatttatttacttagagacagagtctcgctctattgcccaggctggggtgcagtggcatgattttggctaactgcaacctctgcctcctaggttcaagtgattcttgtgcctcagcctcctgaatagctgggactagaggtgcacgctgccatgaccagctagctaatttcggtatttttggtagagatgggagttttgccttgttggccaggctggtctcgaattcctggcctcaagtgatccacccatcttggcctcccaaaatgctgggatttatacgtgtgagacacagtacctggccgagacttcagttcagttttatattggtattttggaaaactccctattacatacttgctttacctgaggtttaagaatggaatgaaactgggaatgtatattagagaaaataaggtaaagtttctcagctttttaatgatcatgagcccttttgccatgttaggctgtaataatgctagagtgttaccagcatccttttaaggaatgtgtagaggtaagtaacacttagcctaagggtcctcagaatactgtttgaaaatttctgttttcaggaaaggcttactatagtgggtcttaattcctctaaggattctgatagcagccttagatagcaaatacttctaatttaaaggtattcaaaggacatttctcctgaatggtcgtctaattatacctttacatcttacaaatgaaataatcaaagcctagattttgatattcaaccaagagtttggttaaccatggacagtggcaaatccaggaataaagtcagaactgttttggtttttttgtttttgtttttgagacagagtcttgctctgtcacccaggctaaagtgtggtggtgtgatctcagctcagtgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgtgcctggccaactcagaacttttaatttcctacctcagtactttgatggccatgaaagaaatggtcagttttcttcatcattctagatactttcattcagaaaaccaagaagctctacattgacagttgtgctcgaagaaacctaggctccatcaacactgaattgcaagatgtgcagaggatcatggtggccaatatcgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatatattttttttcctagcatgattagtttttgttgagttggaacagtgtaaaggactcatccatattagaagcaatgattatttctaacatattcacaaaattaattaaattatataacttgtataaattaagggaaatgaatgagagaaaactcaacaatgtattgcagtggttttttgagtagcctctttgggagactttactgctgccagatcaatctttataaaatgccattttcatcaaagcattcctctctgaaaaacttttaaatctgggactacaagataagatccagtctgacttatttttccgtcagtcagccattgttattgagagcttgttatttgtaaggcgttgtgctctacatatggaaaataaggaagatgcaaatgtctgtcattctctagttcacaaacattcttctgtagccacaccagcttctttactatccttagtggtccttagaacagaatactgccttatgctggacctgttctgtatgtaagacctccataagaactgtctctttaaagaacctttctctgatccttatagcctgtatcacattaatctcttctgtcctttaaactcctaaagcacttagtaacataatggttttagcacatattacatgtatgtgtgtttacctaatttaccttaaatatatttattaaatacctcttaccatattaaatatatatttaatatatattaaatatatttccatataacataagtatatgtttcatatatttatattaaagtaggcaaacatatttggataattaaatatttttatataatttcatatatttttttgagacagagtcttgttctgttgcccaggctggagtgcaatggcacgatcttggctcactgcaacctccatctcctgggttcaagcgatcttcccaccttatcctcctgagtagctggggctacaggcatgtgccaccacgcctggctaatttttgtattttcttagtagagatggggttttgccatgttgttccggctggtcacaaactccagggctcaagcaatccactcacttcagcttcccaaagtgctgggattacaggcatgagccacaacacccagccctttatataattttaaaagtgtaggtaattaggtaaaattaggttaaaagtatatgtatatttacctgatatttaaatattacctaagtgtttaatgtggacatgtaagctctttaaagatagtgcttatgtattttatatctgtttcacatactccttatatatcccccacagaaatggtcacaaataggttccttaataagtatttttgaattcagccatgctatatattcattagtaagtgagttttcttttattatgaactacaaactttaacctttttttgagtagtgagcagttattcatttaccttcacactctttaaataccaaattttgagtgagtgagtgtgtaaggttttgtcatacagacttgcaattcctatatgggataaagtagactagcacaggaatttttcttgtatcactcatgcaagactctaaattccttaaaggcagggatcatgtatattttgatcactgttgtatcctcagcacttcacatggtgcctgtcacataaatatttgttaaatgacttctccaagcaatagctttgtctttatgttatcctgtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatct

SEQ ID NO: 1128 - DNA, 178747 bp, Homo sapiens
gctcccgtttgggatttgatttgcagcatctttgagcctctacgacaaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaagtggttggattttttccgtggatctatcaattcacaattcgaatttggaagaaagaaggaaaacatgacgtctccagccaaattcaaaaaggataaggagatcatagcagagtacgatactcaggtcaaaggtaagggttttgaaaaatagcacactgcaaatgctctgtggactggtgaggcgtgtatttccaccgtgatttgcaggttgttcatttctttgggtggagcagatgggggcaggctgaccccagaggtggtttcatagatgggtctgaacctccaaaggatgggcaatgccagggggccattgacactggaaaggaatttttgcagtgggctgtaggagtatctttgtggggctgaccatgattttggcagccctttccccccaagccgggcagggtggggggaggggcaggaggctcttagagaaaggcagtttgcctccggttctctgggtcaggtttccttgaaagacaactgaaatctgacaggtgtttggacatttgtttcagagattgaagaggagtccagacagaaaggcaaccttgggaaggtgtaccatttggagagccttgggagaggcggggttttttggatgcactatattaaaacatgagatttgcaatggcattggcaccaaaagtccattgccaccttgggtgtaccttgtacctgcctggtctctggtcggcctgcatacaatcagagatcagagaataaggccacccacgcccggtctccgccctcacctaaatctgaatagagttgggaggatgttagggtagccggttggtgctgattctggaaaatgggaagacataattgtttaacccttctgtgctgtggccctctgctccggaagacatgcttttaaagccccatttccctctcctgaaaaatgtgaagggtaaagcaaaatgtggactaggagaaaccaagtgacctgtcttctcatctagtcgactgacttgactcatgaataagagcccttactcagatagcgttttttaaaccagcaattcccataggaagggttcctgcctgttaaagagctgcagcatgtgtttgtgcaaggcactgtcccttcctggtcagtcactggaaagagccatgtggctccagcccattgagaccttagctggggagtggaagaggtgggtggccttgaatgttacaccacatggttggagctctgggttttcctttgtttcagagtacagagggaggggcccctcctttccctgcaccagtgcaaggagaccttttcctatcagagaggacttgggaagggccatggctcccctctaatgattgctggggggtgggggtaggcgtagagtttgaaatgggcagctcccttatctcttggaaggttggaaggtagtctgaagtcctcattgtacctacaggatcttttttatgtcattagtttggtcagtgctggaggtgccctaaggggccttctatccacttggctgcaaatattggtaggtttattacagagatgggggagttgactgattgatagcttcagttgaactgggattgagagaggtgtggttgtgagttattattgaggtcttggcctcttgtcactgttcataatccaggcctgtttttgtaaacaataggccactggcctccatgtcctgtccagatgcattgcatttgctcttggaatcccccctgcagttttaaccagatatgtctttttttttttttttttttaacacatcctattcttaaactgttgccatcgggagtgttaataactttgatcttcccagatttctctccagaagcacgccatttgactaaggtgcaaagtgactttaaatgtttaatttttggaaggttcaaggctgataggtgttaatagaaccatatctgccaatttcttattggcaaaggatttctcaagagtgtctcaaaattaaacactttggatatttacaaacattgctcattgagatgaggtaatgcagtcggctatttgggttctctcttcaaccttgccacaaacagactattttgctttgctctgatattttcccattgatactattcaggatcatagaattttataggtggctgagcatgatgtcttactccgagaaggtgcctgatgaatgcttatggaactgatttgaatagtttagtccttcattttacaactgaggagaatacagagaactgaagaggcttgtccaaggtcacacggctagatggtggcagatctgaaactagaagcagatttaccaactctcaattctctattctgtatctttactatgaaacatcatctgaccagggtggaaaaaaataaaaaattcttaaggagcccaaatctgtcaatgaataatgatagtaataatgataatgataatagattacattttggttgctcattatgttccagtccatcccaagtgctttaaatgaatggtctggtttaatccttacctcaacccaggaaatgggtattattgtcaccttccattcaccatataaggaaactgaggcttagagaggatgagaagcccttccaaggtcacacagccaaaccatggcagcttgacttcattcctttattcattaactatttattgagtgcttgctgtgtgttctggcgattggccatacagctgtgaagaagaaaaagtctctaccctcgtggagcttatattctggaagctgggctctctatggaacagcacagaattgggagacaaagggcctgcgatctggtttggctctgccccccactagctagaagccctgggtcagaattattatgagtgtcagctttttgtgtgttatatgggactcatggtgctgccagacttacttctcttacagatgccaagataaaaagaaaattgctgtaacagctatgcagtttggtttggttgttaagtgcaatttttagagtcaaagtgattcaggtttaaatcttggttctgccagtagctagcctttcacttcaggcaagttacatgacttgtctgagcctcagtttccttatttggaaaatgggtaaaataaaatacatttcctaagatagtagtgagttgttgatgagatatataaattatttagaacagtatcttgcacttgtaagtgctcaataatggtacggtctacttctctgtgagcctttcttttgctgaattgggctgactattgaggctgcattgcatattcactcccaaagtgccagctattaaatgataggaaataagtaaggaatgaaacttaagttctagcttaagatcatttagtcgtaacaaaacatcttgggtcagtcacttaaaccctctggacatcagtttctttttctgtcagtgaacaagtaaactaattattggccactgtggttcagcctgtctttgaccagagtcccaggtcctgttttttcaatcagaattgtttgagtcaaatggactctaaatgggaccctcatctcatgggactttctgggaccctacctatcccttgatttttgcctccctataaaccacctgcttgcatgtgccctgaggaactcctgaggcttcagccccaaccctaccccagagtggttttatgaggggtgtgcctccttagtcagcctgccttgtagtgtcttcttaaaaaccatcattgtttcaggtttgtgggtgcccacattccttggaaagttcatgcctctcaatgtctgacttgaaagcaataatattcttagtctttttacatagctctttccaatttacattatgctttcatatgtagttgtccgtcagtatcctcaggggattggttcaaggactacccccacttcccccaggataccaaaatctgcagatgctcaagtccctgataaataatggtgtggtatttacatataacctatgtacacacatccttctgtatactttaaatcatctctagattacttataatacctaatacagtgtaaatgctatgtaaatagttgttatactgcttttaaaatttgtattattttaaattgttgtattggtatttttattgttttttttttttcttgaatattttccattcccatttggttgaatctgcagatatggaacctgcaggtatggggagggctgatgtacattaatctctggaaattctttacaaccctggtcagattcatggtcataaactgaagcctttggcctctagcctgttagcttgttgctgggattggagcagcgaaggtggtaaggtgcagggcatggttaccagggttgtgaatctgggtggtatttgggtgaatacacatgactgtatacagtcccagctattgttctttccttatttaaggcccctttcctttaccctctctataccttgagtttttacagtctcccagaaagcttgagattgacagttcatgcaaatattccagaagaaatagtctgaaacagggtggcactctatgctgagcagtcacattttctttctcgagaacattaggggtcttgtctttttttttttttttaatgtcttaggagaacagtgtgtgtgcaccacagagctggaagcgaaattttgtaatttccatctggagcattttgatagaaaaagtgcaggcctttgcttggaacagtttaaccctttcaggacccttcaagagcaggagatgaaatttaaaactggagtcgtattgtgtatgtatatatacttgggaatgttgatggctggtatataaacaagctctttcccttgggaggtctgagcaatttttcattcatgccaacaaaggtcttctccaaagcttctttcctcacagctcccattccccaagggagctttaaatataatcagttaatcagttttaaatataatcagttaaatatagtcagtttgaaaagctgcagtaaaacatttagttggaatcctcaagcagatgctatcattttcctgcaagatgattgagggctcctgtcccttgctcaggggaaaaaacaacaacaaaaaaagctactctgcagcagtaaggtgaactcctggaagaaaatgaaactcttggaaactttcaagtaccatactctgcatcttgcaattgaaagaccctagaggaacatggtaggcaaggagccaggggatgcagtgtactgtgcaaagaagcagtagttggaaacagtgttcatgaggggtccttagctttttcaatttcaggtgttcttggggaatgagaacagaaatttcctttgaagaagcctatctggtaattgtggccacatccgttatgtatcatgcaggttgaaaacttagacaggctctgatgatttctctgctatgaggtgtccagagatggacctggctgcagtatgtaggcgccctcactattaaaatcagcaggtacccagaccctgactcccattattcactccagataaactgggctacccagtggcacctgtagagttgtccttccagaagtgagaatgcttcatgggaattgtgcttaccttatacccttgacctctgacagctacattaggaaaatatgtcatattgcagggaaaaagcagttgatatgtagatttctggtagtaataaaattagcagttttaacctggtgtcagctccagaattgactttttggggaatctgggaaagttgccttggaagttgttaggtttaaacataagtaataacagcacttaaaaacattttaaaaaattacaaaattaacacccttactgattttacaataatgtgtaggaactctcatatctcccttactctctctaattgtggtagaatacacaggaggttgaccatcttaaccattctagagtacagttcagtagcattaagtacattcacattgttgtgcagccatcactaccatccatctaaatgactcttttcatcttgcaaaactgaaactttatacccattaaacaacagctccctattccctcctgcccctgtctctggcaagcaccattgtactttgtctctatttgataactccagatactgcaggtaagtggaatcatattgtatatattttttgttactggcttatttcacttcctataatgtcctcaaagttcatccatgttgtagcatatgtccaaatttctttcttttttaaggttgaataatatttaattgtatgtatataccccattttgtttacccattcgttcattgatgaacacttgggttgtttccaccttttgcctattttgaataatgctgctgtgaacataggtgtaacataggggtgttcttttttcttttcttttttttttttttcagatggggtctcactctgtcacccaggctggattgcagtggcttgatcacggctcaccgcagccttgacctcctgggctgaagtgatcctcccacctcagcctccgaagtagctggggctataggcacatgccaccacacccagctagttttaaaattttttgtagagatgaagtctccctacattgcccaggctggttattttttttttaaaaggtacactataccaaagttttacaagcctgtatatacatttctatataatcacttgtcctgataaattttttaaatttaaggttttaatatgtgcattagcttgtatattagtatattattaattataaagttgtacaccttttaataattacatgaattactaaacttttaccatatttttaatagctttattgagatttaattgacatttaataaattgcacatatttaaggtatacaatttgataggctttgacatatataatacccatgaaaccagcacaatcaagatagtgaatgtaatcattacccccaaagtttcttcattataatgtattaataaaccagtactattggccaggcacagtggctcatatctgtaattccagcactttgggaggccaaggtgggaggattgcttgagcccaggagttcaagaccaaactgggaaacatagtgggaccccatctttgcaagaaaaaaaaacaaaaaacaaaaacctggctgggcacggtggcttacgcctgtaatcccaggattttgggaggtgggcagatcacctgaggtcaggagtttaagaccagcctggccaatatggtgaaactctgtctctactaaaaataaaaaaattagccgggtgtggtggcaggcacctgtaatcccagctatacgggaggctgaggcacaagaatcacttgaacctgggaggcagaggttgcaatgagctgagatctcaccattgcactgcagcctgggcaacaagagcgagactccatttcaaaaaaaaattatctgggtgtgatggcacatacctgtagtcctaggctctcttaggatgatgaagcaggagaattgcttgagcccaggagttcgagattgcagggagccatgattgattgcaccattgcagtctagcctaggtgatagagctaataattatgttatagaagaggcattaacttcaagataactaagtgaaagcctggtattaacaaattttaaaaagtaacaaataaataatgatctaagctacccagattagtttctggaaaatttgtttaaccaagacaatctccaagggaagtcaggctaataattgtgtctcagccattactctgcttttaggagggaaggtacaggatggagtgagaaagaaaagaaaaaaaatcatggccatgttaggagtggacaaatgacagtgtctgtttccatatagagttggcttggctgggtgtggtggcttacatctgtaatcccagcactttgagaggccgaggcagatggatcacctgaggtcaggagttcgagaccagcctggccaacatgccaaaacctcatctctacaaaaatacaaaaattagctgggcgtggtggtgggtgcctgtaatcccagctactcaggaggctgagggaggagaatcgcttgaatccaggaggcagaggttgcagtgagccgagatcatgccactgcactctagcctgggtgacagagcaagcctccatctcaaaaacaaaaaacaagcaaatgaaaaaatagatctggcctgaactagtcctagggcctcatgcctttttagaaggggtcacaaataagccagatgtcaaggagaggggctaggggctcccactggagatctactcagaatgttcttaatatggcttctttcttctaatgattgactccctattgcctgctaaatacagaccaactttctaaggtagacatgaacttcattctcaatctgactgcaacctattgtttcgaccacatttcttattttgctttaagaggactggaagcctaacttgactgcttaccattctttaaacagactactagctaacatttgctgtctgttggatgtttaccacttactaagcattatgctaaatactttatatagattattccataatccttactccaactttaggaaaaagatgttactagtatcccattttactgatgaaaaaagtgaggtgtaggacattcagttatttctccagggtctgcagctggtgaataatggaataggaaccttggttgtcgccagagtctaagttctacgtgttgctcatgaaatgcccctttttcgctgcgcagtcccgtatcttcacctattgaaatctcatcctgctgggggcagtggatcacctgaggtcgggagttcgagaccagcctgaccaacatggtgaaacgctgtctctacttacaatgtagaattagctgagggtggtggcacttgcccgtaatcccagctacttgggaggctgaggcaggagaatggctggaacccaggagttggagtttgctgtgagccgagatcgtgcccttgcactccagcctgggcaacaagagtgaaactccatctcaaaaaaaaaaaaaaaaaaaagaaaagaaagaaagaaatctcacctttctggtaaagcccaacgtttctgggattccttccttaattgctctgaccagaaataacccttctctctatttcacccacatagtgcttctcttaatagatctcatatggcattgatctcatactgccttatgtttggaatatttgtatttcattcttttttcttctaccagacttctgaatgtaggaatgttttgaagttgtgtagtgcaatgcaaagaatacaggctctggaaccagccctcagttggagtcttgtcagcatcacctccttgctgtgtgaccttgctgaagtcactcaacttctcttccaagcctccttttctgtgatgtggagataatgagacctgccttgctattaattgcagttgtgttaagagtactggctcagtgtatggcaaatattaaatgctaaataaatagcttattataaggtcccttcagataggaaacgtgtctggaagactattgtagctcaaatggtggctctcagtaaacacttattgtctgtagtactgaatgaatggatgacctaactactacaaataatcttttagaaatagtttaattgtatcttgacactgtatcttgcacaatgtcaccagagtgatttttaaaaactcattttttttttgctaacatcgtagcataaaagactgttaatattaatcacttcccacttaccctgcttacattttatactgccttacagctgaactgcctctagtttcctttctttatcatgttgtgtcatggtttgtgctgtatccatgctgtgccctctctttggaatgggtcctcttccttgaacctgtaaaacttattcatcctttaaagcagctcagatgccacccctccaggaagccttccctgctcccctgtgcgggatcccaagcaggattcctcagcatctccccttgccttctgcacagagttcctcagtacgctctcagcatctcctctgcagtgtctttgtacactcttgtattattgcactcatcatattacattgcgatctcttcatttacatctctttgtttacaactcactgagcaccttcaggaaagaatggtcttttattcatttctgcatgtccagctcctgacacatagtaagcactacaatgtttataagttgaattgaactgtcttctgagttgagtttggatgtgatagtgccatgatggcacgcttctgcatttctccccgactccagtaagaaacccatgccctatgttaatattatttgaaatttgatatagattaaactttgtgaatatatttgcattatacaaggacaagtacaaactacatagccttatggatcctcccccacgggggtgtgtttctccttaaatttattgctggcacagccctctttagaatcactgccctctttagagtcactgccctagagctatacttgctttgaccaaatttcttcagtcacatctctcaccttggaaaccaagaaaaatgttaacactgaaattcccgagagtttaaaacaaacataaggctttctgtaattgaagcaaaaacacattgtacatttgtccaggatttattcaccattttaatcaggcactaaaagtctaagtttgagaaagtttgtctgtcttgacctggagttaaaactgggttgacctgaaaaaggaactgttttgttcctttttcaaagcacggtgtggagagagctattgcctggttagaagcagctgtgagatctttggtaaatggggaaggagaggtcctaaggaacaagcaggaaaatggtcccttatggtttttcaagtcatttggtatgaaatagccttgaccttatttatacgttgtgaatgaatggttctgaacttgaaatatgtattcgtgaggaaggaaaaacagttgggacatgttcctccattttggtgtatattttaggatatcatcctttaggaagaaggcatattctctttgttttttttgtttgtttgtttgtttgtttgtttgtttttcttaaccatatcttctaaatgcattaatcagtggagaggtgacccagaaatcactgtgaaagttgggaccttatctttgctgtttgagcccagatcttgcatttagaatcatggcatggtgggcaggatctgaatactctccctggagaagatgaccctggcagccatgggtggctgggtggccagggctccacaggaggacaaagcacagaaaacaaagggacttaagagcatgagctggccatgacaagccatgccataagctttaagaaatatgtcttgtttctgaagagttggctgttgccaactcttctccaaacattgaaatcccttagaaatctgcttcctttccccattagattttgtgtgtgcgtgtgtttattattttggtaggcggtggagatactgcaccagagcttgtcagatgagtaagctgctctctgggaagacatcttgactgaggtacctattctggagcaacatttcttttgggccaatacagtactttgttacgcgttgagctacaggattctacacaggcagaatgatcctaagggaaagtgctggattgggaggcagaaagcttgggttctagtttagctttgtcattggctcccatgattttggagataactcacctaaggtctcaaaatccctagtttccctataaaatccctgtaagatgggaacaacaattcttggcccttataataatgatgatgatgatggttagcgtttatcaagtgcttcttatgtctcagctctgttttaggtgctttacgtatatgaactcatgaatttctcaacagtcctgtgaggtagctgctattattatccccattttacagatgacgcacagtgaggttaaataacttgctctgaagcacatggctagtaagtgatgaggacagattatgaacccaagctgacttaacactggtgtgaagctgaaatgaaagaattcagttgaaactatgagatgctgtacacactcagttgattgtcctcatttcctagtaacttggtacaataaagaattaatgcagtgttttaaatgtctttctgttacatacctaccgtacctccctatgccttggtattctcatctaaaatactaggggttaaacattagaaactttcctaggtccttccagctttcagggttcattatttttgcttattaatacgttgaagatcggcctggctgggtggctcaagcctgtaatcccagcactttgggaggccgaggcaggcggatcacctaaggtcaggagttcaagaccagcctggccaacatggtgaaaccccgtctctattaaaaatacaaaaattagctgggcatggtggcgggcgcctgtaatttatcttagctacttgggagcctgaggcaggagaattgcttgaacctgggatgcggaggttgcagtgagcccagatcgcaccattgcactccagcctaggtgacagagcaagactccgtctcaaaaacaaacaacaaaaaagatgttgaagatgatgatttgtcccttttaagtagacacactttgaagtacaaaaaccattatattctctgaatgacattctttccacccccagaacttgccatgcctgcatggctgctgcacacttatggagggtaggccccaggtggtaggtagtaccagagtggcagctggcctggagagcagttgaagtgatacttgttgaagtatcatgatctaataggaagatgtgcctcacagctggagaaaaatcgaggggagagagagttacttgatgggcctacaggtgaacttgtgactggatcactttaatcaggatgttttaatcaggataactattaaactttggacttccagtaagctcagagacttctagagttagaaaattccctgctgtaactggtttgtatggttttccccatccatgttggtaggtcagaaatggaatttgtgtaactgttagtattacagatatttatgttgttgtgtgcagtacttaaatttaaaagaaaaaggaagttgattgattgtccttaatgaaaattaaagaaataaggaagtgggaggctcttaatctctgacatctggtctgggacaaacctgggggaggcagtgtggttatggaactggtatagggttgatctagacatctgggttgttcgggaagtgacttcaggcccttttaggatgtggagtggcctcttgcctcttacattgctctttatgtattaggccttttgtcaactaaggatttctttgaggattgtgatgaagcatgctgtaatgtggaattgaaatgttttcatgtttatgtttgttttcctttcgcctaatgaataggctagtaatagtctgttgttttaaatgagtactattaataataatgacagctcatatttttatcattacagcatttaaaaaatatcattcatagggaggaagaaatgtagggtaatggaggaccagctatgtaatgttgaagatgtcattccacctttgggattctcagcttctcagctggaaagtggaaagatggattactagttcctagcttcatgatttttaggacatatgaacaaaaaatggctattgttaagtgagttgtcacatagagtctagatgttgattattgtcctgggggaaggatagaaaccagagaatagatagcacaggttcttcctactcccctcttctacttctggtttaaggtttcatctttttttttttctttgttttcttcttaaaggtttcatctttaaatgacattaattaggctttgtgtttttagccatttttagagtccgttgtgctgtatctcctgatctctctttttcagtgatttgtggttatgtaagttatctcagttctttgctgtcagcaattttaaatcaaacattgaagcattttgggtagatgacgtgttactttgattaatgaggttcttgatctggatattttaaggccagtaacaacacaatatggaaacacctaattctccttaaaactgcaatagtgttctcactgccaaagctgaaacctatttgtgctggttacttctttctaagagtgaatgtgtgcgtatgagctttcttttgctgttttggccagggagtgggactgccagtccagaaaggccagctcttctggattcagtagcaaaagagttaatcattaagcagagacagaaacctcccaagtttctaaccttctcttgcgttaaatctccttactcttattagaagaaaaggcatatgcacacttatgcatgcgcgtgtgcacgcacgcacacaaacaccatacacacaaatactctaacaaaacttaatgtaaaatgatctcatgtttatgagagctggaattacttgggagggatacttgtgttctgcaggcttagtgggcacgatgtgaaagcaaggctatttggcctgtggagattgaagataagagcgtgatatgtaattgagtaagaatttgaaaaattatccgataacgttaggagcagcaaagcaactgcttgtacttttttatgcttgaaactatttggagtaggagtgaggagctagcattgttttcagggcatgggaaccccctccccacctcactagccaaatatgtttgcctgggccgagagtgtcagatctctgagagatcttgacagagtatttaaatacattctgccctcggacaattcttcagtgttaatcatttcaggaaaagggctgtcagctaacctttaaaatcctttccagaatagtataccacagcccacctttccatcttgttccagtgacccaatctataaatggtcagttccttcatttgcagaacttgaaatagtttaaagaagagacttgatgaattgaactcatgtttttgctgctgtggccacaccctctatacagacatttgcttcatttgggttctcagcaacttgggaaggaggaggctattgatgaaactttcaaggcgttggcttatagctactggagtgttcttctttcctgtcccctcccctcctcacttcctccagtgttgggacactttgtattgaacaagaagatcatgagctaatttcaacctggcagccatttatttagcacctactgtatgttgtcttttttttttttttgaggcagagtcttgctctgtcactcaggctggagtgcagtgatgttatcttggctcactgcaacctccgactcccggattcaagtgattctcctgcctcagcctcctgagtagctgggattacaggcacgtgccaccacgcctggctaatttttaaatttttagtagagacagggtttcaccatgttgttcaggctggtctcgaactcctgacctcatgatccgcctgcctcagcctcccaaagtgctgggattataggcgagagccaccgtacctggcctatatgttttatactatgctaagctgtgggcatagagagatacagaaaaaagtttctgccttcaaggagctgcagtctattagaaatgtcttagtccgttttctgttgattataacacaatgcctgaaactgggtaatttgcaaagaaacaattttttttttccggttctggaggctgggaagtccaagattgagggctgaatctggtgagggccttcttgctgatgggaactctccacagagtcccaaggtggcgtaggatatcacatagagagggagctgagtgtgtaaacttgccagctcgggtccctcttcctcttcttaaaaagccactagtttcactgccaagataacccattaatctattaatccattcatgatgacatgccttcatgatccagtcacctcttgaaggccccaccatggggattaagtttcaacatgagttttggaggggacattcaaacaatagcaagaggggtgatcggattacacaagtacagtgatagggtcatagtagagagatatcgaaggctctgtggataaggaatagtctaacagtgagtaatgctgatgagactggttgatagaggaagatgatgatgttacctagtatttacagggcacaaggcagtcaaagtgccttgccatactttatctcatttaacctcagaattgtacaacacagggcaggatgatatccggcctttttttttttcttttttttaatattttattttgagataattatgcattcacatgcagttgtaagaaataatgcagagagattgcacatacctgttacttagattcctctgatggttaacatcttgcaaaactataacacagtatcataatcaggaccttgacattgatacagtcaaaattctaaacagttccatcactgcaaggatcactcatgttgtccttttctagtcctgcccctcccagttcactctttcatctcaccccactttagtccttagtccttaactgctggcaaccactaatctcttgtccatgtttataatattgtcatttcaagaatattataaaaacggaaccattagcatgtagctttttaggattggcctttttttttcactcagcacaagtgtctgaagactcattcaggttgttgtgcatatcaatagtgtatccctttttattgctgagcagtattctatggtatgaatgtatgatggttcggacatatgggttgtttcctattttaggctgttatgaatgaagctgctctgaacattcattatagatttttgtgtatacaggtattttttagaaaatagagataagccaggcatggtgatgtgtacctatagtcccagctactctggaggctgaggcaggagaatctcttgagcccaggggttcaagatgagcctgggcaacattttggagatcctgtctacaaaaaaaaaaagatggaggtagttttttgtaatggcaagattgtacattagaagatagaaaagtaggttttgcatcttactagggaagatacatgtatatttctctccctttggactgatcatttaagttgtttcaatttccttatcaagaaactggcataatatatgttctgcctacatcccagggtggttgtatagataaactgagataatatatggcctcctcccaagtaactgggattataggtgcgtgccaccacgctgggccaatttttgtattttcagtagagacggggtttcactgtgttggccaggctggtcttgaactcctgacctcaagtgatcttcccaccttggcctcccaaagtgctgggattacaggtgtgagccaccgtgcccggcctcagagtagttcttaaattgcaatctagagacaactcttttaggccatcttgctttttctaataattgatgtgtagatgttccttttatattctgtttactcattgttgacgattataggttgcaatacctgctcccagatttagtttatcatcttacttttaattgaattatttgatatataagaaattccaagtccaagcatggtggctaacacctgcaatcccagcactttgggaggccatggtgggaggatcacttgagtccaggagtttgagaccagctgaagcaacatattaagactctgtctctaccaaaaatacaaataagttagctgggcatggtgatgcactcctataatcccagctactcaggaggctgaggtgggaggatcacttgagctctagaggccaaggctgcagtgagccgtgatcatgcctctgcaccctagtctgggtgacagaaggagaccctgtctcaaaaaaaaaaaaaaaaagaaagaaattccaaatttaatatagtcaaatttactttttgttaaagaaattaattttctttactgttttgatttatttaaaagacaaacacacacaatcataaggatattcttctatattttcacctacacattttgcctttcacataacgtcttgaataaacaaggagtaaattttcgtgaacagcgtgaggtagggatctaactttattttatattccatgtggctatatttattaaagggttcatctttttccccattgatttgtaatgtctcatttgtacatacattaagtttattatacatatttgtgggcaagatgagttctccatcatgctgtagcggtgctgccgctggatgtgcatcaggggttgctgatgagggagtcaaatattttcccctttgaggtagcagcactaggctgtccccacagctccaaccagaatagctctgcttttatgttcacgatattgggtgtcccgctaagattttatttgaataactttttagatggaacaattttaaaagttaaaaactaccatttttaaacaaattacattttggatcgttttttgagatagcaagggtttcgtctctcatcttgggttggatgaaaagtgtaagacaacacagaactcagaacctagcagcgagggaagtgcctgtttttcaaagggaaaggaatgtgttattttgcagttgtcagtagttccaaatatatcaactattccacaaaataatgagtatgtagtttccgtgagagacttagaactgtctagagcctagtccttattgtctgtgatcatagaaaccatggagaaaaaaagcctacctatacgaaagtagttaaaaaaaaaaataacccacagcaatacaagaaatgacatcagccagcagatgactgaaaatgagtggtgttgataagaacttgaggaattttgagatgggagaggtgtgggccagaatgaataagaccttgatttatggactaggatttggctaagtcgatagtaggaggaaagaacagaggcagtgtgtcttccctcagtggagttcccacagcccccaccgtgcttaccgctcctgcatcacttcctacaccctaatacaatgatggttttatccaccctcacccccacccccacgctccttcccccagactacactcactaccagaaagcttgtgagttctttgagggtgggcagtgggcagcctgtcatttcaacattcccagcctcctgcaccatgtttgcatgtggtaggcacccaataaatgtgtgctgagtgagggagtagactcttgggctggagcagaggagttatagacagaggagtaagatcgaactggatagtttttgatgaccttgaagatcagccagagtctggcttcatactggggcaacaaagaacagtgggggcactctgagttgaagagtgatgaagtgtgatgaagtcatttcagagggactccctggttgctctgagttgcctggctgggggcaagaggcttgttcctgcccacacagcataccaggccttgtggtgggtgctgcaaacatgctgttaaatgtgatcaattactggagtcacctgtgagggaattgcgagtccccatttactgaacaagaaatttgagtcaggcagatgatccgaggtgatggtgacccatgatggaatggggactgcagctcaggtctgtccaactctaaagcctgctggttcttttatcttggatcttatgtttgaccacactgtaatcaggagataccactaagatgggaagatgagctgccgagatgggtgtggggcctaggggtgaagtaagagtcaggaatgcctgaggtttttagtttgggagacagggagaacgatggtggcaatggcagaaatagacatatggaagccaggaagaggtgcagcagttggtgagagaatgagcattattttagataccctgagtttgagatgacagttccattcaagcaggaatttcattaggcaagtgacaatgccacccccatccgcctttcattaaatctgtcattttcttttcttctaaattgggaatgttgcagagaaactgtgaaatagatgacacccctcttacgtgccaaatacctgacctccttttgcagcttcttacctttcactttcagaaatattctcccttgaaggggcttcgtgtttgtgtgcaggaattaatagcattttctatccctgtgccctgtagggaaagagcacagctaaacaaggagagagaaaactggagttctgagctgccttgctccgagtttggttggaggccccttatgagggtcagctgggaatgaaagaaaagtcaagtcaagccctgccagcaccctccaccacctgacctcccatgggtgactgaagagccagctaatgaacaagttcttttaaaggcagcctggggagtgtgggagaggctgagttcagcaaaacatgactaggtggtgctggtgctgtttcggggtgtggaggcagaagtggttgatctccttaatttgaataactttggaatggggagatggtgctttgatagaggatttgattggagattttgattgtaggatatgttgaaagaggggatcaggctaaagccatttataggaaattatatttcagatattggcagttgaacttaatgtattctattctcacttccaaaggctttgaatttttagtgttatttctattttgaggagagtggcctatgagtacttctcatccaatgtgttcaatccaaggagactataggagttattactctcctcctttataaattctttctgtgtaacagagattacccacagttggcttgagagttttacgccacagtttggtagaaaaaagaccactcagctggaggtcagaggcttgggtaccagtggtagctctgacccttgccatcaactatgtggccctgggtaagtctctaacctctcctggcctcaagcctcttcagatataggatgaacatataattcctacatctaggagttgctgtgttgactaaatgaagtaatgcttgtgtatcagctttgcaaattacataccccaaacaaatatatattaagattttatttgctgcaacagaagaaagtggaccatctcttggtgtttgttttgatgagacttgacctatataacacaggctcaagtatgtttgttaaagtgaatcacctgttgctttctgggccatacttgaaatgacgtgccgtgttacagtgaaccccttttgcaccgccccaagttcaggttgcccttacacaatttgggcgagatagatgaacacgcaccttcctccttcttagaaacaaaacagtgacttgggtagggtagacattaggaaagtgacttagctggtaaatatgtgattaataatggagatttggcctaagcatgagtgcgagcctctgaatacggatgggtaaatgataaatagcaagtctgccaagttgagcacattggggaacctcttgggctctgttcatgcttgaagtatgactgtgccaatactgtactcgctatttaacaaaatgaggtcataccaatcacactattttgcacgtatttgtttacacatctcttgtctgctaagctatgagctctttgagagcagggactgtttctgtttatcgttgttttctagcatctagcagagtgcttagcatataataaatgtgtattggatgaatgaatgaacgaatgaaattctttgcatttttactcggttagagagattttttgaaaggcatatatgtgggattatttgtgctgtcatctgctaatttcacagatgtcttctcaactgtagaccttcatataagggaaagacctatttacgcatagttgagttgcagctgctgctgccctggcctgatggcacagtggtgagggctgtctcaatatctgtcccatgtctctttcatagaataataccctccctcagccccttttccctgtatcttcctttcaagggttgctgtgtagttaactctgcctcaggcaatttatcttatctgtacttttctcttcctcattcctcttctcttttccagtgcttgtccagtaacctcaaggaaatctgttccaacccttctttgctgttggtgtattcctattcatgagttaaatcccaaacaaaacatactctaatcagggcagtcgaacttgaaaagagtcagtgagaaatctgaaaggaggaaaagcctggccacgaggctccaagtgaaatgaaagccataaacaccagcttcgtcaaccttgaaagcttctaaaagtgcccctaagcctccttttgaatcactaaaagttttcacttacctccctgtctttctcagataaaatttcctctttctcagccatgagtcttaaaaaacaaagcaaaacaaaacacttcacacctgcttcttattcagttttacactagtggaaagagaacgggatttagagttggaaggccaacgtgagcgtcctgctgccacttagtagctgtgtgactctgtataagcttctaggctttctgtgcctcaatttcttcaaccgttgacaatatgaccgtgtatcatcacataatacactatgatgtgaagtttatgtagatgaagaactctttcaagctcacaaagcaccagatacatgtcagatatttctaatgttacaccagtttttaatatcatgtttcatttcacatacggtacttgatatctcaattacattagaggctaagacagttttctaccagcatgagaactgaaacacgatagcatgccttttatggcgaaatgtgtttgaacttcaaacaacaaatatataaaacttattatgcaatacaccctatcagcaaattaattgaaggctgcctctagattgttaggtgtggacgacaggaactttatttcctacttcttttgtacatgccattgctgtttaacagtgttgggttcataacaggtgattagacagtcttgttgatagtttggagaaccatcttaatcatgacctagaatcattcttatttcacagcaacctgtgtcttgactaatgttaaactgactaatttgttttgaagctgagaatgagaaattggaggtccttctcatagatctgagattcctttttattcccgagttggataaattagggtaaacaaaatcaaatacttgtaaaaatactgtacaaaggaatgacatatgcatgctggttccctagcagggtaattccatcagcgctttaaaaaaaaaaaaaaaaagatgacattccttctcaaccagccaaaggagccattttccaatctcttatcttgttggggtgtgttagagaaatataccaagtgcaagaacctgtaagcctggggttcattaacctgcttaaaaccagttttacttcaaataggcgatctttagtgtcaaccgttgtacttttgtctgcagggaacaactcaagtttcgtcctgtcctcagtaagcagatgagaggtagggttgacgttagaagccaagtttttgtggagcaataaggtaaaattatgaaggaagcctatagaattccaggagagtttaaagaaaacagtagaatactttcttagcaagggtatgggtgggcttctgagtggaggaagcaggctagaccttgggatgttccagtccaaattctgtttcggaagctccctaaatgtatgcagaggttgtgtaattgtattcatcactgttgaatgtattattggtttgatttggtttcactgctcctaagttccttttgtcttatcttgcaagcatatcactgtgagtacttaaatcattaacaactcattaaaactcttgaccattttcattttctaccaagctgaagcctgggtgtggtggaaacttgtgcaggcctgcttggctgtgccgcaactgagcagctcctagcagtttggctgtcaaaaggtcactgaataaacaaattgataggaatggcggacataatctctgcagttccttgaaaagaaggaaggggctgcaggatacaggatagtgaaggatccttctcttcaacctgaaagactcttcagcaattaacaccttgactctctttttatgcaacactttttttttgtcctctcagagactctatttgtacttggtcttttcttctttcaggatttctatagcttcttttagagactcaaagtgcttccagttttgttacctcatttattctctaggggcaggaattaaggtcttgatggagatgaagtggtacatcacttactgggctgtggaggcagtctacaacaggcagttgcagcagttcttctggttacatgttgagagagagatatatatatacacatacacacacacacacacacacacacacacacacacacacacacacacattttaccttatttaggatctcccagaagataattttaactatttgtaatttctatatattttaaatagctgatttatgcctcataagtaaagaaaaaaggtttctctgcttttgacttgaattgttgaactatttgtcccttggtaaactgatcagttgccgtgcagattgagagaaagccattcaatcaatcaaaatgtttctactgcattggcatgctttgtaatggaaatgaaaatgacagcatgtttttgtcagtttaaatgaataggtttcctttagatcgatgctgaagttggtattataggtatctagcctatgaatgctaataattaattacggaaatgcctcatggaagcacttgaacttacccctgcatcttacagatatatctgcctgttggtgaagtgtatgccagcgttgacatttcttgtgagtactggcatgacccatgacacagcctctgtggtaccagagggccctacactgtcttcagagacattcagttcagtgcattttaaaaaattcattcattcaatcactaattcattcatgtactcaacacatgattatgtatgcctactatgtaccaggctctggtctggtgctagagatagagttattaacaagactgaggaagtccctgctttcatggagctgtatttgttttttttttttttttttttttttttgagacggagtctcgctctgtcgcccaggctggagtgcagtggtgcgatctcggctcactgcaacctccacctcccgggttcaagcaattctcctgcctcagcctcccaagtagctgggactacaggcgcccgccaccacgctcggctaatttttgtattttttagtagagatggggtttcaccatattggccaggctggtctcaaacacttgacctcgtgatccgcttgcctcggcctctcagagtgctgggattacaggcgtgagccaccatacccagcccagaatggtattcttaacgtatggacttaaaaggagcatttgcaaggaagagtggcagtggcagtattgtatggggagctctgattctcatttatgcaagatatgtaatgcctttctaaagaatagtgttgctacttacagctcgggcttggagataagacccactactctgcaggtccacttgaacttctttgtaagcccacttgaactaatctggaagagtttcaagctttggtaccctatttgccaacagctgggtacaaaaccacctattgggtatgattttagggctattgtcaaggtccctgaaggtggatagactgaagacatctcttctactggtagctttatctctttaaaacattcttttattgtatctcactcaaaagactagctgtttatttatactttagtatgagattccatttgtttctttacaaggttttgataagggtctaagactactagatgccagtttagtgagggagggcactctgggggaagtaagcaggtatatggggctaaaatcaaaaggttgaagcacctccagtttgacctacttaacaattttgcttagccttgaactcttggcttctctgataattagttttctaatttttttttttttttttttagacagagtcttgttctgttgtccaggctggagtgcaatggcgtgatctcagctcactgcaacctctgcctcccaggttcaaatgatttttgtgcctcagccaccccggtagctgggattacaagcgtgtgtcaccatgctcttgtaatttttgtatttttagtagagacagaggttcgccatgttgggcaggctggtcttgaactcccggcctcgagcaatccacctgcctctgcctcccaaagtgtcgggagtacagatgtaagtcatcatgcccggcctcgtttcctaattttaaaaatgaaattgttggagtagatcatcacaatcccttttagttaagtctgctcacttggtagatttgtacctaactgcccaactgcccaggctttggtgtttttccccattctgtgctttggtgaggagatcctgcgttttctttccgtttcctttgccagaaagagctccctgtggcaacatagaaaatatcaactcactgatttccccagaaagggaagagtccacagcttcagaatggtatctgccctggtgtctgcattctggtcaggcggctgcgttcagcgtctgtgctcccgggctggggtgcttatctgtagtagccagacggcctgggcgctcacagtaagttacgtttacatagtggagaggtgagcaagcagatagtctgaagcaagtagaaagaacactccagtcaaggttttccagaggaaagattttgaaccatcgtcaattaaataaaacagaatcttctcaagatcaccagaaaatacatagccagggagatcccaagtattgtggaaccaagctaattatagttacctcctatttgcttagcattttgtgcttttaaaaatgggtcttatttcatatctcatctgatcttaaatatcctgtgagctaagcaggtcagaaattatcattattattattttttgagacagagtctcactctgttgcccaggctggagtacagtggcatgatcttggcttactgcagcctccacctcctgggttcaagtgattctccttcctcagcctcccaagtagctgggattacaggtgtgtgccaccatgcccggctaatgtttgtatttttactagagatggggttttgccatgttagccaggctggtctcgaactgatctcaggtaatccaccagcctcggcctcccaaagtgctgggattacaggcataagccatctcacctggccagcaggtcagaaattagtaatcccatttaaaatatgagaaaactgaagcattaggtaggctaagtgacatggccaaagtcacacagttaatagggcaggatcagaatttagaatgcatgttttttcttttaaaaacaactttattcaggtataatttatgtgcaataaaattcactatttgaaacctatagttcaatgagttttgacaaatggtatatacttgtgtagccacaattataatcaataggttgaacatttctatcaccccaaaaagtcccttcacggtccttggctttaatcttcctctttccttccccaattccccctgtcttttgatgtctaatgcaatgctcttttcactgtcccacactcggacttgacagcccttcagccatatccttctggagagagtcctggctggcagccagcctgcctcatcatgttgagttatgagagtgaatgggaagttagtgggttgcttactccattgttagttccttccttcccttcttttaccagctccaggctatagaaaaattatgtgggttctccttcccaggagagcttgaaaaacaggacaccagctcacctgtctgctcttgcttcctggtagcctgctgctggggaggggtgggagtgagcaggaggtggtggggtggtggactaggcgacctctagaggatgctctacttctgtatcgtctgctcagtctcgatctccttagaaaccagctagctctctgctgcctagttgcagttctccaaggctttaagcagtctgaattccatatctgatgaatgaatcccaaaggtgttgaagatcccagttctgaaaaatgagcaaaccccaagttttataattgaaactttcatagcagatcgggtcctagacagatccctccctctgtaactgagttaggttttgaggggagatatcccccattatactgttcctaaatcctagattttgactgtagtgttcgggacattccggagagtcacattgtttacccaggtgctggaccagagttgctccccggcgttgctgtgtggcatccagcaaaggcaggttgggagcctgctccttttcatagccagctttgcctccataccagcaagatggaagataggtgccttcactaagcccctcaggtggccacaggatatgatccagaatggtggtctctacttttctatttgctcctatttagccacccagtttgggagtagccctgtgtattatgattatctctttcattcattttgggctatttgagtttttagggccctttcctatccgttatctcctgttctcaataagtctgatatcttctgttagagtaaaagctctatctcctctgatctaagacagctgcaaggacaggacagactcagatttcttctctgcaaaggctcctgttaaatcttgggccctatggtattgattttcttctagttatctctacaaatttttctggctttgctgaagggggaaaaaatcaccagactgcatgcttgagcttcaggtttctccttagctggcagcctcaaccagaaaaaaattctttttgagagcactgagcctcaggcactggttttgccctgtactccccagtgtctaactcttaacagctggtggccatccctggcctccatctttactttgctgcatacctcagcttgatgagtccttgatgttgattccttgaccttactgccatcttctttcccctgcaggggcctcttgaactatggggagcttagtaaacagtgggcttcctgtgttttgtctaccagcaaagctgggtacctgaatccccatgtgacagtgctgcatggctgactccagtattcttcaggagacacagtagcaggaacagagacttagttgaaagccccaagtgtgtatatctgaagtgtttgtacaaagatgggggcagagagctgctcatgtctgcaaagagggacagtcccactcttgcagaggtgacagtccacagcaatgctgtctcttccatttctcattggggttaggtttccaaaggtccatgaaggttttattcgttttcgtgccccaagagagctttccatagtaatgaaagaaatgttaagaactgcaggaaatgggtaagattatagatggccaaggaaagtggcaaggaacaaaaaaagacaatgtattttaaaggaaaactttttggagctatttcatggatgctgctggtcacctggggaaatcttggatttatttgacagttcccattttccacttaggcttcatgtatacatgggtttgggagctaggaaggggaataataccctccccaaagagctgtggctgagctcccagtccccaggaccaaattgagctgttgcagctgggaagcagattggtgcagccctccccaaaatgctcacagccctgtggttatttcctgtgtttttccccttgtatattcctctttgcagcttgtatcttccctttctacaggaaatctcagccgcctagcccatgggcctggttgggctgctgtctccttcctttattcttcatagcccttaatcacttctcattagtggactccctgggagggagggaagaagggttttgttctgatgccggcctcctggaagggctgtatcccaccaagacagatggctgcctagcctatttttaactgtctctggggaagaagattccacaacctattttgaaacctgtttcattgattgacagctttccaattaggaatttcttgctgatacctgacttaaaatttgacagctatagttgaaactcatttccttttgtttctttgaaatcatagagtttgggaaagagagggattttaattagaagtcgtctaggcctacccctaatgaagaaaataagttgaagttgaaactgaaaatgcctcctcatcctctcattgaggatcccatcagttttgggatctgcctttgaaatcacacatttgggtaccattctgtaagaatcaatttaattttcagggggaaaaaagtgttctggagctggaagtttagaacgcaagtaagtcgttaatacgacttactctattttgtttgtagtgagaaagttaaatggtgcttatagaattaccttgcctctattggcagagagtaaaaataaactgagctctcaatatacaaagacttccccagttcttttcctttcgctcatatcaatgcctgtctttaaagaaaaaaagagggttatttttctctcctccatcagtgggattctctgtattttaaatatcttttttaagactaatgtcaggtgactcaaattccactgaagtctctctttttagttgtctttctgccgctgcagacttctcttgacatgagactctgtgctgcttctcttgacagactgcatctcgatggcagaacactggtaagaagctaatgatgttggttccgtttcagtgtgtggaatcttgttatgtggtatagaagtccagcattctaggcgaataaaccgaaaggtattagactgactataaaggggtcttgggaagggatcttactcctctttgatagttggtacttgtaccttttctcaacacctgcgacattttctttttccagagatagcatcacatgtcaaggtggaacatcagatgcttggatcaaccaatgagttgtatccagacctgtgaccaaaactgaggtggcatttgggatatcattcaccttttggtctgtgcttcaggccatgagtagttagtgtatagcacatgttcacaggcattagcatctcagtcttttgaaatatggctaaaatttagtattccacctgcacttgatctacttgagaagtatttaacaggtctattttataaaatcccaaggcagccttttctgctacctgcttggattgggctgcatgaatataaactcattttgctatcagcctgagaaataggcaggtatactggaaacaccttcttatctggggcaattggactagtaattggtcagttaattccaaaagtcagttaaaacagagagtctttaaaaacgaagacaaaactgttctcaagcattttatttattttaatttttttttgagacagggtctctctattattgccccagctggtctctaactcctgggctcaagccatcctacagtctcagcctcctgagtagctgggattacaggcacatgtcatcatctagctagcattttattttaacttaaaaatatgtaaatgccagcctggccaacatggtgaaaccccgtctctactaaaaaaaaaaaaatacaaaaattagctaggtgggtggcaggtgcccgtaatcccagctactcgggaggctgaggcacgagaatctcttgaacccgggaggcgaaggttgcagtgagccgagatcacaccactacactccagtctgggcgacagagtgagaccctgtctcagaggggggaaaaaaaagtgaatgtacacatattcacaaatctttttatgtgggccagggctttttcttaaagtgtggatctttcaagtagagttcagttgactttctttcataaattatacacttaacatttgatctgtgatttccagtttaagtgaaccaagttcttaaatacatttgagaaatgaagggcagaattcttccagatttttaagctccaccactacaaccttttactgttgtcttgcccatatctaattcagcagcaattttttttagcaacttgccttcaaatttcttccaagcattcaacctctttttcatagaaatatcttttttatactcatatttcacttgtttgtattatataataatttaatatgtaattaaaataacaagtatacctagcgtgaactaactactgaccctgaagcagccaacctggctggtgggagtagatgtgagtaatacacaaccagcctccagtgtgctatgcaactcagccagtttattttgaagagaagttggtatgtcacataagctggcaagtcagttaagaaagtatcacccgtatgtttctctcctttttgcctctactgattgctatgggacttttatcttagcacctgttatcataattcctctattaaactataagcttttggatggcagggcccttttcttacttatgtgtgtatctccagtgtctcctgatatagtgtctggcctatagtaggtgctcagaagtactaactagacatatatatgtcttagttcagtgctatatatttgttggtgccaaacagctctttattgaatagatggatatatgtatgtattactgcacataatgtactcaaaatccaaatgagaacctatagagtatctattttttaggatttttgccatactggttccttgtgtttgcatgaaaaactgaaaattgactgtggagcttttaggcttgggttggaacaatatgtattttagaaagattactctcttaataataactacaactcattcttagaataataaaaatcatatcagtactaagtaatatttatcaactgcttactgtgtgccaggcagtatgctaagtgtgtatgttatcttagttcatatctacagccctgaaagaagacacaacaaggcatgttgtgttattatttccatttatagatgaggtctctttgggagccagcaaggaggtggtacaaggtctaatctttgaacagttgagaaatgggtagtttgttttcatagtgctgcttcttattttcaaggttgagggcccttctaggcgaggtgaaaggaacccttaaatctagagactgcctagagggagaaactgacacttacttttggctttctgggaaccagggtaggtcctctcttaattgaagagaattaataggatcctgtggctgggcattgggcagagtgtttgaatagctgctggccatggtaggtaatgccaaagtggcagtgaaaacaagctactgtgggacattagaccctgcctgtcacttttcttcccaggccactcacttgttggagggcccttctgaaactcctcttgctctgtagtctggatgcttgtgaacaagctgcttgcaggtgccgaaacaaacagcagtgtgggtctcagggcctgggcttggaagctgggcagagggtggaagggctccatttgggagcagtgttgatggaagtgatttttctagctgaggtgcgaggttggttctgagctgaatttaagagaaggctatggtcttttgtccttccacacttttgggacccagcagatactacaaatgcaatctttacaaacccactcactgccagaaatgaatctaaaaaagtgctagtctgtgggcctcttggtcaggaaggtgacagcagtggcaacagcagaaaaaccaatcaaacaaacaaaatgcctgtgggctggcaaacagaatttctttgcaaggttaattctgaatgtcagactctttccttttttgtaggttggaaggaggcagcagcaaagggaaagagatagcagttggaggccaccttctttagtcccccttccccaaagaagagccgtagctagtattgtggttggcattaaattgatataaagacaccctggcctggaagttaaaagttttttttctttcttttttgagacagagtcttcctctatcgcccaggctgaaatgcagtggcatgatcttggctcactgcaacctccacctcctgggttcaagcagttcttgtgcctcagcctcccgagtagctgggactacaggcatgcgccaccatgcccggctgatttttatatttttagtagagacggagtttcaccatgttggccaggctggtcttcaactcccaaccttaggtgatctgactgcctcagcctcccgaagtgctgggaattacaggcataagccattgctctcagccgaatgaaaagatttttgatgtactttttagccagagggagtttatgctgctgtgtggccagtttttccacatgtctgcaacagttacaatttttgacagatatcttgagaagattatagattttgatagaggcagtaactttattagcaagactgatttcatattagaatgaaatctctgggtctttttcggattactttatgttccttaaaaagaaagacattgggccaggcacggtggctcacgcctgtaatcccagcactttgggaggccaaggcgggcggatcacgagatcaggagttcgagaccagcctgactaacatggtgaaacctcgtctctactaaaaatacaaaaaaattagctgggcatggtggtgggcgcctgtaatcccagctactcaggaggctgaggcaggagagctgcttgaacccgggaggcagaggttgcaatgagctgagatcgcaccattgcactctagcctgggcaacagagtgagacaacgtctcaaaaaaaaaaaaaaaaaaaaaaaagacattgactggtcttggcagtctttgggttttattctgaactgtgtagagttggccaactcaggaattctagactagggagagaattttgcagtgcttttgagcatgtctgtgtaaatgtgctgtactcatcactatggaatggttctccagtttggctgtaaactcatggagctggctccttgaaatgctagcgtcctagccatgcacgcatgcaagcaagcagaatttgttcacgcctaggccatatgtggatgtcactcttcttcagtttcatatccagtttctgcttgcctgagctagaaatgaagtcatccagcactcacaaagcctctggccttagaggcttaaaaacaaaaacaaaacaaacatagcaactatcccataccaccttagtgaggtggatattattgtcctcttttcagaagtgaggaaactaaggctcagaaattaagatacgtgctcatggtcacacaggtcctaggaactgggatccaggatcccaaagtctgcctctaaagcctatgcgtttcccatagggctgctgaacctgacctttgcactttgccatttatgttacttcttccattccttgggagtaaattgaaatgggtttgggttggcgctgtggctcacacctgtaatcccaccactttgggaggctgaggtgggtggattgcttgaacccaggagttcgagagcagcctgggcaacataaggagaccccatctctacagataatttaaaaattagctggacttggtggcgcccacctgtggtcccagctacttgggaggctgaggcaggaggatcacctaagcccggaaggtcgaggctacggtgagctgtaatcatgcctctacactctggcctgggtgaaagagcaagaccctgtctcaaaaacaagctaacaaaaacccccctaaaaacaaaagaaatgggtttgagagagaagaagagagagaaacttaactgtgggtgttcgtagttaggtactcgtggaggaccacctaccatcagacgggagtggctagcccttgttttcatttatgcagacagacttccttttctacctctgctggttataccaggtacaaatagggatgctgcagtagagcagaggagctaaacgtggcttcctctgacttacataataaaataagaatctccccaatggccctttcctgtctgctggtctctgtgatgaagtgggccaccctagggacagcttcacttaagggcctccccagggttatcaggtccacaaagggtcttgggatcaaatgtacagctaaattgatgagatcaattcattaagataaagacttctacttccgaagcagtatggtgcttgggtcagtgtctcttgagaaattaatgtatagataaaatatttcatattagggagagctctgtgctgccctttcccaaagctttggttatttgatgggaggggaagtcttctcgaacctatgtcagaatattccgctttgaaagatgagggtttttcttgaggctagttttgtacctgctgtttcttttagaaatgattgctttatggatttaaaaggtgacccaaatgacttttttattattattattttttaatgctgggaggagtttgcgtgtgtgtgtgtgtgtgtgtgtgtgtgtgtgtgtgtgtgttttatctccttcaactctgaccacctggaagtcagcctaatctctgccctcgtgttgatctttaattcaacatttaattacctatcttggtatccatatgaatttgattgtttttttggctttttttgaactcataaaaggtatccaagttcctggagggcatagtgcccatctcctcccatccaccagtggacattcttttccaaaagacacatggcaagtacccctcacacctgagctgtggtggtttgggtttgtcccctttgcttttgtttgcagaacaccttttactccttttgcacttgatggttctgttgtacttgtaaggaaaatcagttgaaataaaaagatattaaattgagagacaaaaagatgttgccacactcccagttagaggcagactttagtctatattttcagatttattttgattataaagtgtagtctccccccgccaccccctgtctgcttttctttgtagttctgtaatcaggagtctgttattctctttccaatgctataattaatagtctggtctaaaatataaaaacctcaaagttattaatggaaatgtcactactcacctcatttttacagaggccgcttggcctctaagtcattgagtctttggacaaacatcatttagcattgactatgtgcaagaactgtgctgtatgctggggatttaaagacaaagaaatacagtttctgcctctgagcgtgcatcatctcactggtgaggctcacatacaaacaaacaggcagaattcagtgtaattgagaaatgttgtaattgagttatatatagggttcttattttgcacgtctctgtagagtagtagtttccatactgtgcggtatttgcctgttcacttgcctgttcctttgtgagctctcgagggccaggaacaaatatggatataaacatggaaccatgagcgaatagatgtttcttatcaatgctcggcctgtcttacgaggtgttccatagtggaaccacctgggaaacaattgattttgcattcttgtttgttagctaaatgcctgatttgctttttaggattcttttaggttaaatcatatgaaattaccattttgttgataatttcacatggttccatgtaataaaaagagatcaattttacagacttctggtttcaggtcatgcacagaggtgaagttctgcacaggtactgggcatcctatatgtatttccactaggttactatttccgagtgtgagtctctatttggaacttcagagagggagcctgtggcccagctactcctgtgtcactcagctctggagtggaattcttctaggtagtgcctgtttgtagactggacagggaataaaaccactactctgtgcccgtttataaatatttgcatttaccttggagaatgtacaagacctgggcttcatgcgtgtgtgagagaaaatagcaagtgaaaaggatgtgtacacagcagcatgaatggggtgctattcttagctgggtctctaacctagagaacaggaaacaagatgcttctgaatgtggactatggctgccctatgctagagccaagaggcttcgagtcatagggaaactcatgacagttgctagtgtccttcagaccttcctcttttgtagaaagtttcattctttgtgtgtctcagactgagatggaggaggggtgactctgttttctaagggatctagagagaaagggcagatgtagtcttgagcagtgggcttctcagctgtgctgcttcttccacggagaccatctggatctactcggttgatggagcagctcctctcattctgagtgggtttagcatttgagaaatagaggggcaccttggctgactggactaaaccttctttggcaatttataataaatgctctctgatttattgtttattctttcacattgaggttgaacctgatttgcctttgaaagttaagagcaggactaggactagaactagaaatgcctgatgtatactgtagcacacagtggagcgttgtccactttttagtcacttggtgactaccgattaattgatttgaatatatcaatgtctggcagttggaccaattactcagcttcccaatctgatggtgtggttgatagaaatgtttcctggtggcattttcccacaggattaggatggtggtggcattagccaggatctcttttgtcactgccactgttactgaatgatctgtattttgaactttcttgacttagtatagtattatacatccagcccttaccctaaatgcttattatttaatattgacaacttacaggttaatgttttaaatcttttttttttttttaaggcagagtcatgctccgtcacccaggctggagtgtgatctcagctcactgcaacctctgcctcccaggttcaagtgattctcctgcctcagcctcccgagtagctgggattacaggcgcccgccaccacgcccagctaatttttgtatttttagtagagacggggtttcaccaggttggccaggctggtctcaaacttctgacctcaggtgatccaactgcctcggcctcccaaagtgctgggattacaggtgtgagccaccacgcccggcaaaacagcatatctttaattagaacccaacacgagatggtatttcttcaaagagggcctgaaattgtggtattacctccaagcgaactttatgaaagggatcgggtctgtatataaaccatttaatttctccatttctctaaatgggaaaaaaaatttgtttttgtttcttttttactcagaacaccaagcccattcagccacctcaaaagaggttatagccagggcgcccctcttagaagaaaagacattttttttttttccttaagattggtgcatggaagcttagagcctcatttcaccacctctcctgatttgatatagatttatgagaaatgaatatagggaaaataccggctgtagacttgacaactgttaacttggtgaacagcatgttcttgtttatgttaactgtgtactttgactgttcaagatccccattacttttcacttgtcatgccacatcattgctgcaagttagcctccttagataagatacatggcagttagctatcttcacctgatggggaggaatagggtagagaaaagaatgtgaccagctgttgtcagcttctccgtggaagtggtaaccatgtcagagccaggccctggagacctggcttggaaaagaatgaagttttcctactaggaacttctgtagagccctagacctttccatcttagtgccgagttaaatgagtcacgtagccttcaggtaaagtcatttccaagggattgtgagaatgtgcccaggttggtttggactgtgtcacacttacttgtactggcttatctttgctactaatttttttgtgtgtgttattgttcttctaactattgttgatgatttgagtgatgcgaaagattttgatgatggtaactttctataagagatgtagaagcaagaggcccagagaattgatcttgcccttcatctgacacattgtgaccagtttgttgaacatgataaggcctggaattgtcacttcgaatgtcttcttaatctgggaaatttgaagaggtctgcagcagggaggctggtcagggaagtaactttgcaaaataaaatcttcatactgatgcaatcccagagaacttgcctttgggtttgtgattgcaaagtgttgaatcagtctttggtgtggatacagaatatttgaagctagttgaagtgtaggggtgttgggacaggagaaatgatgagatgaagtcttatcagaggctgaaggtcaccggatattttcctagtaaaggttcctttgatgtggaatttatccgtttagcccacctaattggagttatctggtttctgtccctgaagattctgctgttggccctggactacttaattctgtttgctcaccaaatcggtgacataagttacaagttatgagatttaatgtttagagtatggttttggattataggttccttgcattcttaagttagcagaaggaaaccaagagaagcagcatggtacaaacaaaaccccaaacaagtgctaatgtcagagagacctgggttcaaatcctagctatgccacatataagttttatcatgagagtaaattgcgtaatctcccagaacctcagtgttcttgttgctaaatgtgcacaaaataactggctatcttatagagacgttgtgaagttagagtgagtgaaggtgacatgcctagtaaggacctggcacgtagaagcacacaatcagctttaactgtttctgttattagcagtggacttagcactgtataaatctgtccctccatgcttcccacttgcccatttgtcaaatggacttgacattccttactcagtggttgacagggagccaagtgagatatctgagctgttgaggatggatgtgtatctcaagatcctggcattcagactggggctctacaagtcgcactatatttgcaagttgtagcagaactatattaaaaacatgccctgcctgtttcccctcgttggtcctcccattcagagaggggctttctggccttgtgctttaaatagtcctcagacggtaatgtggatagtagatgaacacaattcttgtgaatccatttgccttgtgcttgggagttctattcttagaccacaatcaccggaatagaaagcctccgaccccacatccgaactgaagccatgtgggcctggctaatggatttctttgggaagctgggacaaaggaccgggtctgcttctgtcattgactaggccaggtatggagcagtccattagaaaccagtctcctcccaattgtctggagtttatgagcctggcttacctgggatcattttcatgttatgatcctaattaaagttcagcctgtttactctgctccagtcaaggagttacagggggaatcaaggcagataagatgtttatgggtgaaccctgtttcattttcctcggatccacaattaaagaattaacagcacttgttatttattgagcagaaccgtgggcgggaggagggctttagtgcttgttttgctgcttctgtgagcccagggctgcgccagcagcatttcacttttaatccttagtattgttaggcctatacttccacctatagaggtggcaattgaggatcttgacttgcccaggggttcatgatcacgaaccttctactacttcataccttgaacaccatctcttctaatagatgggcaacaatatggtcatttctgtgaagatactggtgacttaaaagcattactaaatgtttattaaacacttgaatatagtaattatatatgtgagaatggattcacatctagggctcctgacagtatctgtcaagatgctggccccaaaccctgagtttgtcatgttatgtgggcatatttggttgcccaactctgaagccaaatgatgccagggagagagagcctccatgctgtgggggtgtttctaagagcagcctggtccttaattatcctactaaagacagtgtcctctgtgatctcagactcataacatccctgttaagataggagggggctgaaatcatttgttctccttcacattgaggggagactcaggcacagatgagagacagaggcagagaagttaaataattagtccaaggtcacatcaaatgatttccaactcagctgatgaatctgtctaggtctcggtctccaaatattgcagcttcccttacaatgtaatttgatctcaaacactttacgtgtcttatttttcttcctcctttttctattttggtaaataagatgttttttacacctactgccagattaatgttgggttttaatttagcccttcaagatgatcaatgacttaaccgaggaaactgctgccagaatgtagtttataatgtaccttttttcctatactcggttttctgcttctgtattttgtacattgtcagtctctgtgggttaagaactttgggactctcaagggtcatcttgacagaggagcttctgcagttgggaattgttacctttctcagagcagtgctattgggaaaaaaaaatctaagcatttttgttctcagcttcacagaggaagtgaagcacattcaagggtagcccattggcttctcgtataggaatagtatagatttggcttattttattccttgcttattataatattattattcataagcataccttttcagttaccctcatgatttactatctgtaagagcataagcttactgtttgtgtaatatttgtccctgtattttagatgggagttgctgaggtggtataaggtttggtaactgcatccggcctctcagggaaataaccaagttgttcagattcttagctgtattatgtgaagttgtttgtcagcttcattgcttactactgtgaaataagttataaagaggaacttttaataaaaataaatggattcactcaggggaggggtattcattgttggtgaaatatgtcgaggaccagatgctttttggtctcccaaagacctatcaaactgcagatcttttggctttgtaatatattcagttccacatttattcattcaagatttttgtgtcctcattatgtgccaagtactgggttggacactaggtgacagagatgaacaaatccctaatcttgggatttcacagtggatgttggaatttagtaccgtttagcttcattaggttctgcagtagtcccaagattttccaagatcatcctgtcctccagtgttctattgattcaacttcagaatatatcccagactctgtccctctttactcctcactgctgttgccctgggtccatctgccatcatctctcacctggattatctcagtagtttcccaactggtttccttgtttccattcttgcctccttctgtctactctcaatataacagctagaacaatccttttacaatggaattcagatcatgtttacccctctgttcaaattctccagtgactttccagtttttacatgatctggctcctactacctgtctcactgtgtttcctactactctcctgccctttctcctcttaataaacactgggctcatggtgtttcctttaacatgccaggcatgcttgaccctgtcctgtctcagggccctgctgttccctctgcctggaacattcttcccatagtgtctgcatggctcgctctctcactgctttggattgctgctcaaaagtcaccttatcaaaggcctttcccaaaggtttaaaaatcattctactataaagacacatgcatacatatgtttattgcagcactattcacaataacaaagacttggaaccaacccaaatgcccatcaatgatagactggataaagaaaatatggcacgtaagcaccatggaatactatgcagccataaaaaagaatgagttcatgtcctttgcagggacatggatgaagctggaaaccattattctcagcaaactaacacaggaacagaaaaccaaacaccgcatgttctcactcataagtgggagttgaacaatgagaacatacgggcacagtggggggaacatcacacaccagggcctgtcggggggtgagaggcaagggaagtgatagcattaagagaaatacctaatgtagattatgggttgatgggggcagcaaaccaccatggcacatgtgtacctatgtaacaaacctgcacattctgcacatatatcccagaacttaaagtataattaaagaaaaagaaaaagaaaaaaaaagtcaccttatcaagaccctctaggctactctgcataaaatataccccacttcatatttcctatttgatgtctgactccccctcctccttcactaaaacgtaagctccataagggaagggattttgtctgttttgttctgttgtatccctaaatacctagaaggtgctcagtaaatatttgttggttgaatgaataaatcagcctattatttaatcagtcaatgtcctctgtaaaaaggacttctcataccagtggcacatatctgtatgatggtcagtgtagggagggacatggtcagaatggctctgtctgtgtgggatagtttttcttagtataatcccagaagactcctattggggttaagccacagatttagcgttattagtaccactctttaatcataaagtcagaggatgttatgactggaagggatctgggggactgtttggtccacttttctcattattgatgtgagaataacagagcctagagaaagtaagtgaattactcacagtcataaagctgtaggggtcaatctgaaattaggcttctgacatacgattctgtagtctttcctgcatgtgttccccctggctgagacagtttgtgggctttcagagttgacaattttctctccagtctctaaacaggagcttttatctggacattctaggttagcatagatggacgatgaccctgtaatgtgtggaaagtcccaaagggtgagcactgtgaatgggaactaccccagatgtgtcaggagcaccacaggcacgctcactcttccattggcaggagatgtgtagggtggaaaggaaaccaaaatcaagaccctttgttgctccagttcttttattacatgtcacagtcgaatgtgtctccatttaaattcagattttttgatgaatggccagaccagctgcaggccctttgggccagaagccttgatctcgccaactgttcattttcttgatggacttccttatttcaggcatttgtgtgtagctggtctattgtggagttgtcagaggggtgtagagccccctctttgggacagtcagtcctccctgtgcagcatgtcctgaagctggcctgcctccatcctctttctaagtgtgtgaggtcttttgttaaacagggtaaagtgagggaggactcctaaagagagaaaaactcctccagcatttgctggaacatgtttgtgaactgagcaagatgtaattgggatggcataaaaaaaagacttacatttacttaatttcttgctgtctggtttgtgatatatggtgccccaaattgaggttagaaggagctttgatcatatgtcaaggaggtgtcatatttaattctactccctgtggcctctcttacaataccagtcatgcataaagcccgtggttttgctgcatctagttttactgaagcaaaggctctgcactttcatagtttacactgacatatttctagtttgcatctgaagtgtactctgaggatgctgacttccagatagccatttttgggttaagggaagttcaagtctcctgagtatagtagctacaccacctggagagcttcattttggtttggtgacaaaatttattttagcttagttttcttacattaggtgggcaaaataagaaaggccagaaaagtttaggacagttttctgagacactcagcaaaactatgaggcctagaattgagaactgggtattaccctgtagatgatgtcttttcaagctgggctagtggagtttctgagcagcagctgcattctccttgtacatcttcaggttttgtaggattacctttagccctctaagtgatcagatccgcctcactgtcactcatgggagcccttgatctggacaacgtggaccttgagtagctgagttcaaacaactgaggtggcaagagggatctcccccttggttcttttttttttttttttttttttttttttttttgagacagagtcttgctctgttgcccagtctggggtgcagtggtgcgatcttggctcattgcagcctccgcctcctggattcaagtgtttctcctgcctcagcctcctaagtagctgggactacaggcacccacgaccatgcctggctaatttttttatttatagtagagatggggtttcgccatgtgggccaggctgttctcgaactcctgacctcaggttatccacacgcctcagtcttccaaagtgctgggattacagacatgagccaccgtgcccggcccttatatatattttttaattgaagaggtagagaagcaatctcaaggtcaggacaacttaccctgaggttctcacttgtcagggattgtgctggattctgacttaggttctgccatcaaacacagaatgccctgatccttagaggcagaggcagctctttagcctatagggtaaataaccgggaatggaattctcaccaattcttatcttctatgctaaaagttttactttaagatttaggcctgcttttttctttctctctgtctctctctctttttttttcccccagtaacagtttaaaattggtgccttagacgcaagcaaaaagatattagcacagctttagaaataagtgtgagtccgcatgtaattttttagtttctcctctcccttcgctttttgctttcttggtagtatgctaattgtattctttttctgcatcttttttccccattctttggcagatattattacttgtcttgaaagagtaggtgaagagctgtttttaggactctttgaaagggtacagtatggatgacagtcttggctaaatgtaatcagatccaggaagctggagtcagtgtgagctggaatcagttcaaattagcaaagcactggcgctcagtggcaggaatacaagtgaccacaaagtgttaaacacatctggaaagggattctgacatcatcctgagaatctttggggaatacatatagcctgtagacccattcctctttgaccctataaagattctttaaagagtaataccctgagtggttttctggccagcttgcctgctcatttatctttgaggagatggaaggagacaatatgcctcgtggagatccacaggccctagaggtgtatggattgtgcatttggaagtgctgaagctgagagactgggtctcttggtggaccccaagggatctgcttttcctctactcattgtccctacacaacttttcctggcagctggcattgctgtttagatgggttgttctttgctgtttaagttgtttggcagtggtgtgtcaggatgcgggttttctgaatactttcccagctggttacttgagtggtggttagggaggggctgttctggggctgctctggagctgttgaggtcgggtgtctgtctggatactcacagctggtctgtcgaggagaacgctgttctcattctgctgcctttggtggtgctgtgtgtggctctttagatgtgggtggagatgagttgggggagttaatgagatctttttttagctgcttttgataaagtagtctgtactacaggattcattgtgactttttcccttaacctgtgcatacttctttgctagcctttgtgaaagagagttcaggccctcttgccctcttgctctttcgctctctcttgcccttctgccttctgccatgggatgatgcagcaagaagaccctcaccagaggcaggttccttgaccttggacttcctagcctccagaactgtaagaaattcttttctcttttcttttcttattttctttcctccctccctcacttccttcactctctctctctttctttctcttttctttctttctttttttttttttttttgaggcggagtctcgctccgtcccccaggctggagtgcagtggctagatctcggctcgctgcaagctccgcctcccgggttcacgccattctccattctccattctccagcttcagctcccgagtagctgggactacaggcgcccgccaccaggcccggctaattttttttgtatttttagcagagacggggtttcaccgtgttaaccaggatggtatcgatccttttttttttgttttaaattatgcagtctgtggcattctgttataacagcatgaaatagacaaaggctccattttcaagagcaagcccttttgtagtttctgagctaattatgactgcaaaggaagttctataggtagcctcagatctaccacctagtaaatctgctactacccagacctagaatctaggattctagatcaagtgctgggcaacatgatacctctgcaacttggcacctccctatatccctccagttggtttggcccatcaggactaatattacccctcatatcctagtctctcttgtaggcagaagccttgcctaaaccctaagctgcttagctcacattctgtcttgtcttgctttttctgttttttttttttttttttttttttttttttttttttttaggagggggttcaaatataaaatatacggaaaagaaatataatgaacctccatgtactcaacacccggattaaacagttatctcaattttgccagacttgtttcatctacttcaatctccctaaacatttacatttgtacaggaaaaactggataaatacctaattctccaccctatctcccattttaagtcatttttcagaataatgagttagtgactagtaacctccactgtagtgaccaatagttttttttcctgaatatcgtaatgagctcatagattattgtttgcatttgagcccattgtagtcactattaattgttttagatgctcatattgtctcaggttaataagtatctcttcaagttgactcccatggccttttgacgtgatcctgttggacttggatggcttccttgctttctggcaaaaaaaaaaaaaaaaggtgttccaggatctatatcctgcaccatacatggagtcagccatttctctagggggtcttgattccttttagtagagaacacagtttgggctctaggactgaattacttttgtgaacctcctctcctgcgattacagcctgcacccctgcttatagccagtagaagctcttgttgggcatcaacagatcgaaaatcaccatgtagttctgcctcactcttacaaagattcatctcttgagaattttgtgctctacccccgttgtagtctttatggttttgaaacttttgcttcagtcaccctgaattttgccagccatagacatgccataccttggattgccaaactgccctcactggagccaatttctctggttagaatagttgtcccaactcatgcttaatactctagtaagcaaggttccacctgggctcaggttaacttttctcctttgggccctgtgttctaccagcattccatttatctgaaaccctccctcacctcatcaagatcttatctggtctttaatgatttactctgctgcttcctgggttctaaagaacccagttcaggagttcctctttcagttcgagatcttattggcctgtctcgtcaggttggtgtcagcccagctaggattaagcagaatggggttgggggttgtagtgcacttttgacacagcgtgtacctggctgactacttctctgtcttttttttcctattgcaattcatgagtctcagcatcttctgaatggtgtttagtaggtcatcatgttgagttcctgctctagggagtagcatactctggctctgtatcattggcaaagggatttaaggttagatgataggctgcagttttgttaaatggaacaatatgaagagatggcattataaagaggcttggcagcagggcccatttgaatggttggttcttgattcccatgttgatataggcagatccttgacaggaattttgaatggtcccaaatgtggtaaatcgctggtacatcaagtcatcctcaaagttgtctgtgtaactgtgttgaatgcagttttgtgaatctctggtgattgtctgtatagggcttcatcatttagttattttagttgagcctgtttaacttcttcaagaagataagatatgtgaaagagatgcagacagtagggaaaaagctaggagctttgctcccccatcctctacttgggttctggaactggactcataggtgagtagtgaggagctgggctcaagcgaattaatcccggatctagctgtgctatgtgttcgctccagtccttgtgtcaaagttcactttgagccactcagagtagcgtgtagagtggtcattcaggactgtgctaacttacacttcattgtatcaaatgggagatccagtaatttatagtctattatttctggagtctggagatgactctgtataagctttgctgaagcagattttattacattagaagagaacctacctggctgcatccaacaccagaagcttttagatgctaagtaaggtggtcatagtaaaggtaacagaatgactctggaacccattaccccacccaagaaggggagtaatgaattccgggttgccctcttttcatttccctttgattttgagtaataaattccctccttacttcccagctgaacaaattgggagtctgtattccctagaaagactgttcacatacccatcagactaaattaggtgaaatctctttggccttaatgaatgttgaaggattttaaagggctaatggaaattcttctagaagtaacaattcccattctattggtgaggcagttctaaagaaagtccctgaacctcttaggttattttgtacagcaaaagaaccagcattgggttttctttgctaatagatgacagggagaatgtagacacttggaatccatggagaatccctaagttgcattttagccttcatgttatgtctcctttcctaacctttttaccagagctgatcacaggaaacagcatgatagatttgcatgacctagctccctgccttctcctgccattcttttagaaagtggtgagtggctgcctgccaggtaaaatctgggtgacaaaatccaaagttagattcagagttataagcatagcccccacccaagttgcttccaaagaaaagaaaggaagagtgttgtgtaaaatcttgcttctttgcctttaaattgggtacttattgagttaccacattagaatcgtgcattgtgctagttgttgtactcctgttgattgattaatttcattctacattcatggaacaccaacaatgtgcctggtactatgctgagtacctgagataaaaagataaacaggagttggtccttaccacttagagctcacagtctactactgtgagagtgtgggaaggtgtgataagagctatagtggtcttgccacataatttgcatttgtatcttaaagccagtggggaaccatggaaatattttaagcaggggagtgacatgattcatttgcattttactttttttttttcttttatgagacagagtcttgctctgtcgcccaggcttgagtgcagtagtgtgatcatagctcactgtaacctcagactcctgggctgaagtgatcctcttgcctcagcctgttaagtagcagggactacaattgtgcaccactacacactgctatttttttttttttttttttttttgagatggggtctcactcttgtttcccaggatggagtgcagtagtgtgatcatggcttgctgcagcctcacctacctgggttcaagcgatccttgtgcctcagcctcccaaggtgctgcgattacaggtgtgagccactatatttggtctcatttgtatttttgaaagatcactggtggcagtgaagataccagtgggttggagggagggagactagaggcaataacagtttagataatagatatttactgagcccctgctaagtgccaggcaccgatccaggtgctgggaacctagggggtgagtgaataagacagtctctgccctcatggagcttacattctaatagtggtagagtagtgtggtggtaggaaagcagactatatatatatatatatatatatatatatatactatatatatacatgcaacaaatgatattttttcagatggtgataagtaatttgaaaaaataaataaatagagctatgggagttagagtgtttgggcattgggatgggtactaatgggaatgggcagtgaaggcctctctgaggaggtgatatttgagctgaggcagctatgagaagacctaggcaagagtggtcctgatgggtggaacggcaagtgcagggacctaagatgtgaacaggcttggcacggtgcgtaagcaccgtaaagatggtcagagtagctggagcatggtggagcccagaggagcaagtaatagtcagttgagggtggagcacattctaagccatgggaaggaatctggattaattccagtggagtaagaagcactgtgattaattaaatcaggggtcagcaaactacagcccatgggtcaaatctgtcctgctgcctatttttatgaataagccatattggaacagtcatacccatgggtttgtatatcgtccatggctatttttaatgttacaagagcagagttgagtagtttcaacagagaacatatggcccagaagcctaaaatatttactatctggcctttataggaagagtttactatccctgaattaaatgatctaatttaagttttgaggagacactctggctactgttgagataattaatggtaggagacaagagtatatctgaatagttcagataagaaataactagatgttgagccaccagaaagcaaagatcacaccgtttttgttctgtttaaaaacacctaggtatgctttatactcattaaatattgttgaatgaatgatgagatgctgaataagggagtgccagtgaatatgaaggggaagtgaggttttgagaaatatttaggaggtaaaaaatcagtgcagcttattgttgacaaggtgaatagaaataggagtaggacagaaggaggactgtagatgcccttcaggcttctggttcagggatcttggtgcatggttggtgttccatgaacctagaatgaaattgatcaatcaacaggctattaactgagacaggagaagtggagatacaaagagcatacactgccaggaagaaggaattaatctttggacatgagactcccgggacatccaggtagagatgtctaaaaggtagttggaaagacagagctcggtggcatgatgcgtagacttatggtaaccagaattctggagtcgttagctagtgtgggctctcctaagaagggtgtgtgatgagaaggtcagggttggatttcataaggcattcatttccattacattttggatccagagaggaggcaaaggtaaactagctgtgtggacagtttgcatcagtcagtcagtcagatcatcccatgaccatggcatattttttctgcagaagctgataggctcagatgaagccttgccttatctgttcctctggctgccaacctctttctcttagttgggttgactggggcagtggtggaggtttcttcccagactctctgctaaggttggaacatttgtggccttttaattctgtaggtgattcatatttgcatttatctttttttttttttttaaaagagacagggtctcatcctgtcacccaggctggagtgtgatggcatgatcatagctcactgcagcctcgaccttctgggctcgagtgatcctcccacctcagcctcccaagtaactgggaccacaggtgcgtgccaccaagcccagctaattttttattttttgtagagacagggtctccctatgttccccaggctgatctcaaactcctgggctcaagtgttcctctcactttggctttccaaagtactgggattacaggagtgagccaacatgtttgcatttatctagttgaggctatgggtaggtagaagtgtctagttgttcttggtgttttgttagagcaagaactctctgacccaagggttaggtaagtggctaagttttattaaacattgttaaatattaataaatttattaaatattattaaatattattaaatttattaaatattgtgggttcttttaacccacaaagctagataaacccattagaagtcctgaacaatagcttcccctttcctttttgtctggggaaggggaaccacagaaatacttaataaaaaagcacttgtgctgaaaatggtcttaaaactggatgcaaatctcccctttacagaagttcattatgaaaacccaaggatgaaatcaacattgtaaagggagtagggaaggaggaccactctctatcccgctcttccacccccctcatatttttttcagcatactgtcacacctctgttgtttgtacatttttagaagacactttttgaacacattttaaccccgtcttacatataatattcaaatattagggtcccatgttttatgagtttctccttttctaaagaaacagttgagtaatagttttgctactcctctaacctaaattattcctgtcatgaggttagtgacttctgacaggcagaggtaagtagtttaaagcctgattacctagtcccaaagtggacgaaatggagccttgaaccaaataaataggtagtaaaggtaaatttaaaatatgaaaaaaaatttttttgaaaggcatatgttgacgagtattatttccactcctgtctggtccaccctgtagaacccctgctccttattgtgggtgtcactcttaatagttccttatatatctgtgcagtgtttctttatgtaagtaaaaggagatatgaatatatgttcttacccctccacgttcttttacatgaaaggtaaatcattatctaacctgttgtgtactattttgtccttaacagtatgtcttggggatctttccttgttggtacagagaaagctttctcattcgtatatcagagctgcatagtattccattgtgtggatggctgcctcctactttattgaatcagttccttacaaatgtgcacttgagttgtttccagtatttgctattacaagcaatacttcagtgaacaaaggcagctttttaaagggtcgcacagcactgcatatgctacttaaaatgagattattattcttcattcttagaatgccagttggttttgttggttgataaattcccaattactcgtattcatgagtgcaacattgatgatgaatgtgacatcccttcataacttaagaatcattagtatgactgccccatggaggcatactgttctatctcaggtttatttcaataataaaacctttggaaattttaataatgaaacctacttaagaccctttgcttaagaagtctgaatcactgatcactgcaattactgccatggcagctgtagagcaatttaacaggataatagtgaataagataaattacacttcagattcttaatggattgatgtgcagaagtatgcaagggaagatgggggtgggagaggagcgcctttaaaatttcagcacacagtaataaaatagggaactgggccattgtagccgttactactaggagttagtaatctcgtacaaacctctggggctctgtggtgggtagaatgtcctgtttattatagacaacaaattgggttaattctcttgtttgtgtgcctctgtggagtgggtggaaattctaggtgacttgctaattgtcttatttggaatactcccgtttctactaaagaattagtatctttggtataaaaataaggaggcagaccagttttacaaatagctgctggccaggagaataacagtttctgccaggtgagcagttaaaaaaaaggcagactggaaaaataactgtggaatggtgtttcttatttacaaggctaacataaagtctccctgtgtgttggggatgggggaggggacggattggctaagaagtaagtacggtgcttgctttgtatgtccctcgatttgtgtttaggggagaatagtgaggatgtggtcatacgggtaggcgtggggcccgaggaaggggtccaaggaagcaaatccaggagacttggctgcagttctacccttatggacattccttggcacttggtcacactgtggacacctcaatatctgctgggtattgatcttgtataccttcattctcagtacaaaacccttagcacccattatctcattcttccccaccaaagcccttggagatgaagagcaggagaatgaagtcttttctctcttaatgtttaatcagcattaacacacctttaagtgccattggatttagagcagtgttgttattaaagcaaactaaattgtcttgaagtgtagaaagcacttttagaaaaagaagcaaggttaggctgagagaacaagacagatgaagttactcctctgagctggaaaagatcttgtgtcaaaggaggaagcctcagagataatctgggccagaagattctgtgttcaaatcctggttctgcctcttggtcaagttatataacctccgatttataattatttaaatctgtaaagtaaagagagtgatatctaccatgcagtgtttttgtttttttttttttttgaaatgattaaatgagataatagaaataaagttggccctcaataggtggtagctgatactattaatattattaacagagggtcttctaaagaatctcatgatagttttggagcaaaggaaggcactctcttttacatgaggagattggtacttctggcagtaaatcgagggctgcctttagggttgggaagcatattgacagtattggaggaaggtgttagttgccatggcaacttgggaattcatttggagagagagttgtgactggaggttatctctgtaagagactgactggtggagattaaaaaaaaaaaaagcttgtctggcaggaatgaaatcttgcttgctgtatatctgcaggaaataccaagagatgtgctctagagaaagttccaaacatgagtcagaatgatgtgcaggccttctttggtaatgggtggttgtgtcttagtgggcctaaatgctgccaccagttgattgcttttgttcgcatgtattactttggtaaaaaaataaatgtatgaatgggatttcagtgaacagggttttatcgtgggtttttttttttttttttgtcttctgaaaacatgacgtcaaattgttggatattttcctacagttggtttagtccccaagaaggttttagtaaaagagcatgaatacagagcgtaactgaatcatttaccttgttcctaaggtaaatgacataaggaatacaagtatttccttttgattgggcaattaagactttttttttttcctataaaggttctcctgatagtgccacttgattactgattttgaaaagcctcttggtatgatgtacttaatgtccattgttagtttgtctgcttgtttagtacatctgctgttatctgttaccttctgattgcagccttgcctggaaacagggctggaccaaatgaaccccttaaaacagcaagattctggagtcgctgtttaattttttacaggcttccagtgcttactcacatctatttccttccttccctttcaagttaggggtaccatttgacttgcattggccagcaaaatgtggccatacatggcaattctgggcagaagcagttgccagtatgggacagttcagtgctctcttttcttgccttggtgatggtgaaagtttgtgagcaggtggaacctctgtcaatctgagctcttgaactacaatgatggaaagattgcccctccctgacccttgttggacacacagcataaaaaataaatgagcttttgtgaggttaagccactgaaattttgggggttagttgttcatgcagcagaacccagcccattcttactgccttaatagtcatttaatacatatgtattgagtatttaactttgtgctgggcactgttaggttggggatataacagtgaacaacacagaagtctcttctctaatggagattacatctatgagggagacataataaataaactaagataattaaatattgagataagtgctataaaagaaaataaacaagatcatgtgatagaaaaatctccaaagaacaaagaggctatgagaaggaaatgggaatcccccaggactcatattaatgacttttaatatttccctatatgtcttaagactctggatacttctagagtagtttcttatgccttggaaaggggataacactgaaggcaagaaagcaatgtgttgtattacttggtagcatgtgacaaaattaaataactagtgtactccaaaataaatgacaaccgagaatgatattagtttgctctgcatctttagaaactcattagtgtcctgctgggtttagtggaagatgaaatctgagctttgtttatgtgctgtgttaagcccctccccgagggcatccatcttcagcattcagactttccagagatctagttgcttagtaggtactgatccagtttaattgtattaaccagactctcacactggggagaagtggaatgcaaattgatgcataatgcttatatcttgcataatataattttggaaggaaatagaatgatgacatatttccttaaatcttaaatgctctccagtgaaaactttgagaatggttataacttttctggaagaaacatagggatagagctcaggtctgatcattgaggaacattaggttcagtgccagttggcaatgatgatttactttgtgtgaccgtaagaaatctcttggtacgagggtgggcagcacctattctgccttgataggaagaaatgagaaaagtgttacttgggagttgtaatggggaaaggagagctttatctgcttttcttttcttccttttctttggggcaaaccaaagcaatgagaataggagaaggtcaggagaggaggcatgtctaaatgacagttataaggaagaatcaattcattcaaaaactttgggcactggaagagtatgggctgtttaattctatgtccaaactgggaaacatgcttttgctactgcaatgaagggaattcagagtgatgtgcatggtgacatttgcccctcatccatcaagccagtcttatgatcatccctggaggaagattgagaatctctaaactggggctcagatttttctttctgtctcgaatattttagtcatctcatgttggcacatactctaaaaatctgatctgggtgaaactccagggaagtaggaaaaattgatcaaagtaagaacagcattgaagacacacacatccttgcaaatatatgggtttattgatacagtgtaaatttccgtgccaggacacatgccaacagtttaatgatgtgtatatagcaaagtcccttgttaaccccattcagaaactctaaaatgagttgcaaggctgaaagtattgaagccaaaggccaaaaacaatgatcatgttacctaggatctcatgaataattcagctgagtttaatgctttttccatggtgaaactaaaaagctgaaatatttggcataatgtagacaaattgtaccccgcttccttttgggaggatggttggtcatgaggaatgtaaggaagggtggagaaaaataaggaatcttttcatatttgttttaaccaaatatatggaatctctcaacattccacctctaaagaagtaaaaatataaaaattcaagttggggatttaaagatgttctctttgaatgttcattaatagctgaagatttgggcttgagaggcacttagaaaattgctcctaaagtcctagaaagacggtcacagaaataccaagagagaaggaatgcttgatattcttggtgataggaatcaccaagaatagtgtattggtctgtttcagaaaaataatagtaattagagatgaacaaaagagcatgtggatatttttgaaagttgtgtgcaaattgaattactgtaaatctaatcataatttcaaggcattagaaaagcattataacaaaacctgccagaagattagaattatttttcataaagtgaacgtgtttttttctctccagcttaatttttaaacctaggttttggtatattgatttaacttaaattgagacctctgccattcaggggataaagctctggacattctacatccttagacttcagttcttgcctcttaaataggtaaactctcctatttctttctacttttctcctaaaaataatgagaagataagcaagttaatagaatctaagaatgtttgagctggaaggtgcttagagatcatctagtgcaggtcactcatttgactgaaactaagacctaaagaggttatgtgactcttcagagtctccagttataaaagagaaggcaaattattatgaatagggcaaacataactcaaagaaggcattctttttattaaaaaatatgggaaaggaaacagacctggctggcatggcccattgttttcattctctatgtttctttttttttttctttgagatggagtcttgctcttgttgcccaggctggagtgcaatggtgcgatctcggctcactgcaccctccgcctcctggtttcaagcgattctcttgcctcagcctcttgagtagctaggattacaggcatgtgccaccacgcccggctaatgttgtatttttagtagagatggagtttctccatgttggtcaggctggtcttggactcctgacctcaggtgatcctcccgcctctgcctcccaaactgctgggattacaggcatgagccaccacgcccgaccttctgtattttttattgcttaaaatatgatgagatgcctggacattcagctgccatcttgtgatgtgaagtgctgtgttaactcactgaagaaaaatagatggagccctgcatccttaatgacaatcatcaagctgccttaccagctatgcttgtccctcctccaggtttcttcattggaggtcttcttctggatatcatggacaatataattccataaggaataatccaaaattgggacaaaattttggtaatctgtttgaagtcagtggagagctaacaaagcagcaggatattatggagccaagatcttggagaacaaggaaattcgagagtgacattgggacaaactttcccctagaggcatatcttctgattcttaaagaggcagctgagaggctagaaatctttccagcaaaacttactttttttttttttttttttttgagacggagtcttgctctgtcgcccaggctggagtgcagtggcgcaatcttggctcactgcaagctccgcctcccgggttcacgccattctcctgcctcagcctcccaagtagctgggactacaggcgcccaccaccactccgggctaattttttgtatttttagtagagacggggtttcaccgtgttagccaggatggtctcgatctcctgacctcgtgatccgcctgcctctgcctcccaaagtgctgggattacaggcgtgagccaccgagcccggccactttcaaacattcatggtgctagaggctcaaaatttaggacctgccaaggagagtgggccgtggcaaatatctttggctttgggttgctattctgaggtgctgaactttaggatcgagtatgaacggaaaattgactagccctcatagagactgaggcccagcttcataccctctcattccctgactgggttaaggatcttgattggatggccagttttcttagctccatctcagaagcaaaggacgatcctcttggtgaagtcttaaattatttctctaatttctatattttttcatataaaatgtccagtatgcagttaaaaacagccaggcatatgaggtaacataacaaaataatttgaaactaagagacgtaataaataatagaaacagatccacagagtatccagataatggagtcatcaggtatggatttaaaaataacttttcaaaatatgtttaagggtaagataaaaacaagatatattattttggcagagaactggaaattcaaaactggataaagtgacaaatataaaactaaaaatataataaatgaaagtaagaatttagtggatgggttttatgcagagtgaatagaaaagagtgatggatgaattctcaatagaaaaaaaggaatccagaaaaaaatggatttatatcttcaaaataaggaaaataacatacaaataaaattctctacagtgtgaaaatatcctttaaaatgaaggtgacaagttcttccatgcaaatatgatttgggaaaattttaacaaaagggcttatgatgaacatggactatatatatatatatatatatatatatatatatatatttttttttttttttttttaaattatactttaagttctagagtacatatgcacaatgtgcaggtttgttacatatgtatacatgtgccatgttggtgtgctgcacccattaactcttcatttacaataagtatatctcctaatactatccctcccacctccccccaccccatgacaggcccctgtgtgtgatgttccccatcctgtgtccaagtgttctcattgttcagttcccacctatgaatgagaacatgccgtgtttggttttttttttccttgcgatagtttgctcagaatgatggtttcatccatgtccctacaaaggacttgaactcatccttttttatggctgtatagtattcaaacatggaatatattttaagatagatataagactaaagcaaaggtaaggaaaggatggaagaataacgtgtgtaaatgatatatgttctgaaaaatagaaataaagccaataaaaatgggagcagaatggaggaaggcagataaaaaggggagaatagaatcagactgtcacaaagttaataaataattgggagtcaaagaattcattattgaaagctgacaaaccagatagtaggagagtaagaacaaaagggggctaaggacattataaaaagtattagtgtaaagataaccactagaacaaaaatgcggactcccctaaatagaaaaacaggcaaagaaaacaaatcacagagtgaatttaacataatagaaacagtaaaaataatataaaataatatgacaggcttaagactaaatatatcagtaatataaatatataaatgagctgaaaatcacctaataaaaggaaaatattttcagattgactttcaagcaaaaccaattcattgctctgtagaagagacatacctaaaacaaaaggattcagaaaggataaaactagtaggatgacttaaaggcatacaaagatgctcttagcagtgttaattataagacccaaataactaccaaaatgctcttcagaagtagaatgaataaacaaagtgtggtgtattcatacagtggaatactacgtatataatgagagtatgaatatgaattttacaaaacaacatggatgaatctcatagtaaggagtgaaagaggcatgaaacaagagtgcatcctatatgattccatttatatgaaattttaaaagaggcaggaccaatctatggtgatagtaatccgtatcatggtcacccttatggaagggtaatgactggaagggaagccaaaggggctttcagagcactagcgatgctctattttttatctgggtgctggttgcatgattttgttaactttgtgaaaattctttaagctggatacttaagagttgtgttcctttctgtatctacgttacattttaataaaaggtttacatttaaaaatataaactatttacaagcagaagatgaggcttggggtaaagtcccatggaatagctggacttagagtcatcagagagaatgatttttaattccaatttctatgaacactgcctctaggctctaaaggccattttcttttctttatgacacttcaaggttgctccctagatttgtttttgccatctccaaattaaaaatagagtctagaaaaacagggtagagaatgcagaagtacagccgaatacacaaaggcatttggcatagagtaaaccatggtatttcaaattggtgggatgggagagaggaatggatttttcaataactggttttgagacaactgggtagccatttgggaaaaaattaaattggatccctgtcttcctccttatatggaagtaaattttatattgattaaaatatacatgtacaaaatgaaaccataaaaatattaaaagaaaatatagaggtatatatttttaaaccatggaatataatgtaagcctgactgaaaattcaggagctatgtaagaaaagattgacaaattttaaaagttctacatggttaaaaataatatcataaaaccaaaagatgaactgggaaaaatatttgcaacacatgagaaggggctaatttcctttataaagtgttcacacagtcaacaaaaagtcaaaaaagatcagtaatccaaagaaaaaatgagtaaagaacatgaactgttgtttaaaacagactaactaaataacttactaacacccgcaaagacttattgcaacatggaaacctatgaacataggaaatgaatgatgccaggtcttattcataatagaggaatacaaattaaattgcaagtacagtatgtagtcatttttcacatattagataaaaaacatttgctcatacattgcattctgagtacagagtagcaagaagtctcctatattgttgaatgggcagtattagaaataatttaaaatgtatataccctttgacttactggtttccttctaccactttattctgtagatacacccacatctacattcattacagcattgtttatggcagcaaaaaattggaaacaatggcaggtaccaccaaaaaaagagactggttgaataaacaaaagcatagctatgcagtggaatgctatgcagctggtagaaagaaggggcagattgatatgtactaatatgaaaaatctccaagacacactgttaaatgaaaaaaatgtggcacacgtgccacgttttaaaaagggaaggggcatatacacagatgcttgtttacacagttagtatttcttgaaggatatataagaaaatggtttcctcagaggtatagacctttggggaagggtagggatgagagggaaacttacttgtcattgtttactgttttgtattgagaatgtttcccccaggtgaatgactgttatacctatttaggaaaacagacgaaaccaataaaaccaaactatttctatacagtgattattagcagagatgccattggcattttagatgcattttgggactgttccacacatttaggacattacattcctttccctttgcactaaatgccagtagcacttccctagacactgacaaacaaaaagtgcccctgtagatttctgaaaaggccagggtgtggattggggtggtggtgttgtttgagtctaaaagaatgtaacttctcttcagggtttcccagtttccaggttatgttggcctggcagggagggtcttgaccgacacggatggttatggacctttacttagtgaaaaactcaaatgaacttcctttctagaactcatggttttcattcagtgacactggactttgccctggagcagtgactggtcagggagctgtatctaagtgggagttgcacctgtgtgggcaaaagtgtggcactcagattttcgtaacaatgggcaagatttcaggaagcaggattttggttcccttactttaaaatgcatggagaatggctgggtttggtggcccatgcctgtaatcccagcactttgggaggccgaggtgggcagatcacctgaggccaggagttcaagaccagcctggccaacatggcaaaactccatctctactaaaaatacaaagcctagcatggtggaacatgcctgtagtcccagctacttgggagggtgcggcacgagaatcacttgagcccaggaggcaggggttgcagcaagccgagatcacaccactgcactccagcctgggcaacagaccgagactccatctcaaaaaaaaaaaaaaaaaaaaaaaaattaaaaaaagcatagaggactggttgtatcctaatagcactggtccatttttctgtggtgtgcattttagcttttttcctaacaaaaaaatcttaccacatgattctctgccaacagattttcctgagctggaaggaacagatgtttctgttggaaatgggcatctgtttctcccctcgctgtggcgtgtgcttcctatgagcccaggcccaggtaacagtgaattatcattagaaggctctctcgtaagactcatggggaagaacctataagaccctagtcttccaggaggccagaaggagagtagaatggagggtgagcttcagagcactgaggactgcaaaggggaacagagctgctgtcctgtctgcttggcagtgaccagcagctgcttctggccctcctgaaacaggaggcgagttactgagacagtagagaaaccctgagtctttagaactgtattatctacctgggccttataacctggacatgcccaggggtaaaatatatccaagtagaaatcttccttctcagaacatacccagaaataatgattctctattttgagtactttcttgtgcagtatactaaccaggtgcctactgctataaattaatttttttatttttcgtttttctcttttttgatggagtctcgctccgtcacccaggctggagtgcagtggcacgatctcggctctctgcagtctcaacctcctgggttcaagcgattctcctgcctcagcttcctgagtagctgggactgcaggcatgcgccaccatgcccagctaatttttgcatttttggtagaggtggggtttcaccatgtttgccaggctggtcttgaactcctgagctcagctcctccactcacctcagcctcccaaagagctgggattacaggcgtgagccactgtgcccagcaatttttttctttagtctaagtgtgcacattaatgcataggaaatccccatctttccccaaccccctagtttttcttttcctctttttaaaaactggattttcattcattctttccctttccgcctcccatcccctgccctccccaaggcgtgttgtaggtacccccagaccattgcgttaaagcgttcaggatagtgctctgctgattttaaaaaaacatttaaaataacatttcctgctttttctaattagaaaagcaacatgcttatcatagacagtttggaaaatacagaaaagcaaagtgaagaaaataattatcaaggaaaacgatatgcctttcttttaagccatcattttctctccatctttgcagccacaaagtcctttgttccactttttacgtcttagagtagctgggggttggcacacagatggttggaagtccttggatctcactgtgttataagagtacagaaatacagcaggcagctctttggctttgttttgaagccctgaagaatgggagaatgctctgcatcactggagaacatttgactgcattcatctcccaacaagagtggttgctgggaggaatgagcagaaggagtggtgtgtaccagactgtacaggagtctttcctccctaggcctggtcagcttttgcccttggacaggggaagaggatatctggggatttatattttctatcagaatttgagccttgtcaccttggctgtccctctgtgtccttgggtttttaaaatggaacctctttgttgtaaaatattagttgtacagttgaatttttcagagtagaattgggatccagagtgagaaactttctccctgaaggggctccctggacttttgctcttggcgagttgctggcagatactgacactagaaataagtgtcagagaggtctgatatcacttcagtttcagactgaccccagagcaacccttgaggacagcagtgtgtaagctcaaaaaagattgttctaattttgatgaccctcagagttaaggcttctaggggaactcttcattttcgtaaaaatccgtctgtgggtggtcactgtgttgagagatgagaatttatgggttgaagttgtttttatgatttcagactaagtgcttctacaacgggatattgggcttgggagtgtagacgttgtgggaccaggagctttgcagacttcccttgttcccaatttcttggattttttttttctatcccttcattcagttgattctgatgtcctagtattttttcctagatcccagatcaagagatacttttattcctaattctccctctgaaaattctatgtctttcagaacaagataggggaaaagagaaatgagcttattaaaaactatgatatcacaaggtcaggagttcaagaccagcctaactaacatggtgaaaccccgtctctactaaaaatacaaaaattatctgggtgtggtggcatgtgcctgtaatcccagctactcaggaggctgagacaggagaatcgcttgaacccgggaggcgtaggttgcagtgagccgagattgtatcactgcactccagcctgggtgacaaagcaagactcagtctcaaaaacaaaaacaaaaacaaactactatgggctggacatggtggctcatgcctgtaatcccagcactttgggaggccaaggcaggaggatcacttgagcctaggagttgaagaccaacctggacaatgtagtgagaccttatctctactaaaaataaaaaataaaaaattcaccgggtgtgatggtgtgttcctgtagtccctgctaatcccagaggctggagtgggatgattgccttaccccaggagttcaagcttgcagtgagctatgatcatgccgctgcactccagcctgggtgacgcagcaagaccctgtctaaaacaaacaaacaaaaaactagggtggttaaaaaaaaatcttggtgaacaacctctcttgtggattgtaatttctcaaagaaaaatatgatgtaaagattctttcttttactctcccttccgggtgtctcatcaaaaagcgtatattcctgagctttgctggcaatcgtattattttttctctccacctcagtccctgtaactttcctctttgtccattctggagttgtggaggtgataaatgggtccaaaaatgctgttaagagtgatctttaggtgggcacaggttctttatgatatatccctaatcaagagcctttacaggttctccccaaagtctctttgtgcaggaatgggagcctgctgtgttttagactggatggggctctgaccaagtattttttgtctttccccgcagggcatagtagtaggtgctcagtaaagatttgttggattgaagtggtttgaattaaatatgatttgtatgtaattttatattcaaataaagtctgttcctggtctgagttacttttcaaattatatattgttactctgaagattgtcatttcctgaattttattttctttgttccttttcacccacttgcttccattgttccaaatttagtcgtgttggaaatcagactaggtaggtgtggaaataattgtcaaatcaaattgttcagtcaggggaaggtggggggtagatggctaaagacatcagaatcttttgtctgggttttagggtcagaaaatggaaactggcagagcaaaaaggtcaaaaagtatcaggaataccctgctttgctttaaatctctatttgccttagagcagtcatctgtagtgtggtgaccacaggctttctaatgtctatgggtttaaccccctagagagcaattcctttggggtgaggagactggaggggatattcttcccttccaggggtcttctcattgccttctttttaattttttaaatttaaattttttttttttttttgagacagagtctcactctgtcaccaggctggagtgcagtggcgcgatctctgctcactgcaacctccgcctctcccgggttcaagtgattctcctgcctcagcctcccaagtagctgagactataggcacgcatcgccatgcccagctaatttttgtatttttagtagagacggggcttcaccacatttgccaggatggtctcgatctcttgacctcgtgatccaccagcctgggcctcccaaagtgctgggattacaagtgtgagccaccatgccaggccccattgccttctaatagcccttttctcttaccctttagctcttggcgcttgacttcctatgtccatccccaatatccctactccgtgaaagtgaggtgaaaatgccatcatctttctgcctgtcctgcttttaatcatcttccaaggcagcagcaagtgcaattctagtccctttcaaccccgtccatgtgggtgttagactgattgtttagcttctttatgaagatgcacattagccattcagaaacttaatctcataatgatttgtgtgtgttggtaaaaaagaaaagccatgatctctgactggtatactcagatgttccctttggtcactgatggcaggatttcagaagcgaaggaccatttaatttaattttgcagatggcaggaggtaagcaggaaagcttggtcacaatatgccccctcctgggagagtggcttcagtaaattcaggttgccgagagccttagatgtgagaaatttaaccctctgccttctttccacttcccctcccttatataaaacttggttgttgtttttgtgtgtggggttggggggtggggtagggggtggagttgaggaagggtgggaaggtggagtgaagaaaattgcctgggttgaaaagccagtgactgatgtgagattaccttgtagtgatgttgctttgggcatatggattatgaccagatacagattaacccgttcctctataattgttttatggcctcatccttctgaaattgcctccttgtggcctgaaatcctttctggggttttccttaggctgggaactctgcttgcagatgagaaataaacctacctctctccagggcatgagttccacagtgaaactgaggagtagatggatgaggaatcttcttttattttgtttttagggtggtgcccttcccacagggaagcaagctgcggattctgaatttgttaattgcacagcagctgagtatttgctgcctagtcctgttgaagttccaggattggatatccaagctgttggcttttaggatacatccccaaatggtcatctatcactcttttttttttttttttttgagacggagttttgctcctgttgcccaggctggagtgcaatggcgtgaccttggctcacggcaacctctgcctcctgggttcaagagattctcctgcgtcagcctcctgagtagctgggattacaggcatgtgccaccacacccggctaatttttgtatttttagtagagacgagatttctccatgttgttcaggccatctatcactctttacggccaatagtcacacccaaaattttggtgactttcacagtctggctattggataaatttggtttcggatcttgccaaaatgaggcaaaattgtttttcttcatgcttcagagccatgctgctctataaggaagtctatattaaataggtaaagacatatttcttaataaatcagtctagatgatggtattcagaagcttgacaaaattatcttcctaaaacttgtttgttcctgctttgctaaaggttaatagaaataactcatggataagtagtgaactttttaaagttgctgtttttgtcttaaatccctcctgtctttgctcttttcccttcctttgtggtggctgccaatcctaccttgcagataacttctccctcatgaaaacagaggaggatctgatattattaatttatcctggtagtttgaccattgtaatgctgtccgtgaacatttgcatttcagttgtttatctatgagtagaaggccctctggctgggagtggtggctcttgcctgtaatcccagcactttgggatgctgagacggacagatcacttgaggtcaggagttctagaccaacctggacaacttggtgaaaaatactaaaaatgcaaaaataaaaaaatttaaaaaattagccggcatggtggcgcacgcttgtaatcccagctacttgggaagctgaggcatgagaattgcttgaaccagggagtcagggtttgcagtgagccaagatcatgccactgcactccagcctgggtgacagagtgagactgtctcaaaaaaaaaaaagagaagaaaatagagtagaagaccctttttttcttttagccactaccaagtaggtgaagatatacttatatgttttacaattattcattcatttattcattcattcatctgtgcaacaggtatttttgatgatcatgtatcagacactactctagatgctttatttcagtcaatacaataaagatctctgtgagttaacatttcagttggggaagagggagacaaacaataaacatgatgaatatataaattgctagtatttagaaggtaataagtacagtaaggagcatcaagaatgctgggtagttgtgaggggagttgctttttaaaattttttcttctttcttcttctacctttttttttttttttttttttaaagagacaaggtctctctctctcttgcccaggttggagtgcagtggcaccatgatagctcattgcagcctccaactcctgggctcaagggatccttctgcctcagcctcctgaagtacttgggaccacagtcacataccactatgcctggctaattttttaatttttaatttttattttttagagacagggtctcattttgttgcccaggctggtctcaaactcctggcttcaagcaatcctcccacctcagcttcctaaagtactgggattacaggtgtgagctacctgtgcctggcccaggttgcattttaaaataaggggtagggagcttttagatgaggcctcatggaataggtcacatttgtgcaaaaatttaaaggaggtaagagtgtaagccacgtggatattgggggaagggcatttcaggcagaggaaacagccagtttaaaggccttaaggtggagccctaaggctcaagtgtgcttggtgtatttgaggaatggcaagaaggccactgtggctgaagcagagtgctctggtgggaatgaggcggaaaaggactaggagatgaggtcagagaggagagggtgagaggtttttaggaggaagggaggagatgcctgattacatcataccatgttaggctgttggcttttattctgtaaatatctatatctacatcaattatatctctcaggacttacaactttccatctttatcgtcttctgaactccataagatctttctaagaattgaggggaaagttgattataagggagaatatacaaaacctggcatcgaagccttactagagacctggaacctactctttttgggacttggtaaattgatgagattccatgcgcccccaccccccattctctggcatacagaacaggaatacttatatagcttactctcaacccaacctttcccttcgtctgcttcaagaatctcaaatacttacgatttttggcatatttgacattattttagttaatttctgaacatgttttcccactgttaaccctcttaccccagacagcattttgaaacacttttttcttttttttcttttttttggcagggtctctctgtcaccaggctggagtgcagtggtgtgatcatggcttactgcagccttgacctcctgggctcaggcaatcctcccacctcagcctcccaaatagctgggaccacagacatgcaccaccacacctggctattttttttttttttttttttttgtagagacaaggtctccttattttgcccaggctggtctcgaacccctggactcaagtgatgctcctgcctcagcttcccaaaagtgctgggattacaggcataagccaccgtgctcggccctgaaatgcttttctctaccacctaatactttccagttctggaaatgaactttctgacagcatctcattaaatgaaataatagaagtgaaagcactttgaaactcagaaagtccaggaagaaatcggctggttgtctccactctcttcattacccacctgcatgctagcggatgtacatagccagaggatcactttggaggcatttcatttcattggcgggcgagggggcagttcttttggcctagttgaatattaggcatatctggatctagtctagccccgacctccttacaagtctttgtgctacaaagtccagcgttggtgtggtttttcaaggaaggatatagaatggtttattttggatgagaatttcattttgtgtacctgattttgtattttttttttcctcttaagacaaggtttcactatgttgccccagctggtctccagctccaaggctcaagcaattctcccgtcagcctcctgaatagctgggattacaggaacgtaccattgcgcccagcccttgttttgtttttgaaagctgtcgtgttactgcttaaagtctccaaactgttattgagaacactgaccagagccctgtccatagaccagtgtttttccaagtgcagattgcaactcctttgcagagtaggttgtggagccattttagctgactactcaccagctttcttcaaaatgtaaatggaataggatagaaaaataatgaaaaattgtaaagtgaattggatgcaaaaagggtaaatattgttgtgtcagacttttttgggtgagtgtgcatgtgttcacatactggatcacattataacatgtattgctcattatgggttgtggtcagaaaaaattcagaaaacgctgtctcagactgtcccaaagttgtatttgcttattatggaactgatgaggatagaagatgagtggctcagaaggttgtatcttggtgagataaaagaagacatcaaatgacagttttagttagaaaaataatcccaattgagtttgttactcttctatgaaggtggaagattctgtgccagaacattatgctcttcaggtcaacaggaactaagcttgttgtttctctctgcacaaagaattgtgcaatttccagcgggaactcccctctggaggtggagagggaaggggaaggaagagtggagatagaggcaattaggaagaaatctttactgtgagccttagctgacccaggatctgcacatagttaactctgaggctttgttggaatccgccaaagattcattgttaaagacagggaaagcacaactcatttccatttattttagttcaacatttatgccagctctgcgctaggtgctgggatataacaatgaataagacatggtcttggacttaacggtgctcctaacctggcagggaagacagatgtaaattgctaattattgtacattgtactgagtgtcataatacagtgtaaaatgctccagtttatgaattagaggaactatgctttcagccttttattctgagaaatgtgccatttaataataaagaactgggatacgggttttttttttctaaaatttggggaagactactttgttgaaaaggaaaatgaaatttccaagggaatcaggttcatccagtcaagctattgtgttattttgtgtcttttcctctaaaagtattctaatgtcaaaaaattttttaaatcaagttgacataatacacacctgcccagggaacctggagacctgtaaaataatttaaaaccattttttttatcatatctttaaaaaatactggcaaacatagtaataagaatttgagactgggtgcggtggctcatgcctgtaatctcagcactttgggaggctgagttgggcagatcgcttgaggtcaggagtttgagaccagcctggccaacatagcgaaatcctgtctctactaaaatacttataatcctagctactccagaggctgaggcatgggaatcgcttgagcccaggaggtggaggttgcagccagctgagatcacaccactgcactctagcctgggtgacaaagcaagactctgtctcaaaaaacaaacaaacaaacaaaaaaaacttgaacccgggaggcggtgcttgcggtgagcagagatcgcaccactgcactccagcctgggcgacagagtgagactccgtctcaaaaaaaaaacaaaaaaaaaaaaacttgagtgcttttctttgttggaacctgtaacactttgcttttacattctcattgatttttaaaattactaataactttttgagacatgtaaaatcatgacaaattctacagaagttctatcaaagcaagtcatgtagtgtgttcagggtccagaacctgagttcaccagctccaggctgattcacttttgtcagctgcatccaacctaagcctggaaccagattgaatcaaatgctaagttttaatgtctttcatttggttcttttatttagttcagtgtttcttactgctagctgacttggctctgaattttgttcctgcctcaagcaaattctgaatatgcccatctatggatttgaacagtaggatgttttttcagaggtgtgaaatgatcaggcagcttgataactttagacatactgtacgttatgaagcattttcttgcttcttgttgtctttttctggtggattgagtcaatgcagttggtagaatcttttccacttatgttattgaggcatgtggttgaaaagtggcctttaaatggtgtgaggtgggtaggcaggggataaattcttaccacagtttctaggatgaggaaagtgaaactcagaggcccaaatcttctgactcacacagtgattctggggctgtctgtaatatctaaacgatgagactgatctacttgcaaggtcagggcatgtggtcattttcttgctagcctttggatcaccaggctgtcagcattttgagggggagtatttgcatcttgctttatttggaagattcagcttgagggagtcattattagaagattcttagaacacttgagccctctgaaaatgaaaagtctcacatttcccttctactttggctctctgttggaggggaacacttatgtcattaaaaacattgtactttgcttatctaattcccactctgtgttcacattaatagcttcccattgctcttaggaacaattccatacttcttcagactatttgcaatactcaccagagcttgacccctgcttctttcaacagtctcatctttttttcctcttctcatttaaattctatgcttcagttaccctgaatttcttcgattatttcggttccttgcatgcagcttcttttctgttgcctctgggcctttgaacatgctgttggctggagtacttttcctgccttcttcccataggtaattccaatcctttacgtctagctcctctgcgagcctcttgctgagccctagaccaatttctgtatactcctacagcatcgtctttttccccgataatgggctttttacattgcaattacttcttatggtagtctgtcttctctggtagactagattcctttggaaggcaggcccaagaagctggtttaaattactggagtctgactaaaaagacttttatattagactggtatttcccaacatttaaaaatttatgaacttgggcagggcatggtggctcacgcccataatcccagcactttgggaggctgaggcgggtagatcacttgagaccaggagttcaagaccaacctggccaacatggtgtaaccccatctctactaaaaatacaaaaattagccgggcatggtggcacaccattgtaattccagctactcgggaggctgaggctcactagaattgcttgaacccaggaggcagaggccgcagtgagccgagatcatgccactgtactccagcctgggcaaccaagtgagactctgtctcaaaaaaaaaaaaatgaacttctttcagagtaatataattttgtgaaccccctcaggaatttaaaaaataatgtcattacttttatagactattataaagcaaatttatgtaaaatattttcttttacatcaacattattaaattattatacagcttattttaatatacactttaaaatttaatagcgtccattttatataaagatgttttctcatttaataggtgatatacactaatttatttaaatgaattatgtaagcgtgtgatttgtttaaaatttataataaaatatagtgcttagtttgagaccaaatatacattaaaaatatagttggaaatttaattacttgctaacacattttttaaaaataagagaaacctgcattcttgacctaatgtttggaatttttgcatttcacactctagaatgactgcttcttacatgtaatttttaagttttgtttctacatggtagcggttaccacagagagtttcaactgcatatctacaagggagtaacaccttgtagctatggaatgcctttcctctaacagttacaaagccaatttggatatggttatctctatatcttatgtctttaatattggattttgaaatactaaagatttaatcaggtaaatgtaacctagtgatctggtgaaaatcatctagatgtgaattggatgccttggtactgttttttatgcttctagttgacaattgggttttatcaatgtcttagacttcttgttgttggtttttttgtttgttcgtttgttgttgttgttttttttgagatggagtctcactctgtcgcccaggctggatacaatggtgcaatctctgctcactgcaacctttgcgtcctgggttcaagtgattgtcatgcctcagactcccgagtagctggaattacaggtgcctacaccacacctggctaatttttgtattgttttgtagagatggggtttcgccatgttggccaggctggtctggaactcctgacttcaagtggtcctcccccttcggcctcccaaagtgctgggattataggcttgagccaccatgcccagccaacttcttgtttttaatccacagtccactatgactgtacattttatgatatatgacaaagaataagagcagtgaaaaactgtagaatgctcataccatcttggcctaagtggtggttgcaaaaccaccatggcctagataatgatgtttattagctcatcacccctaatcgttgtgcatactcacttgatatatctgaggctctaaactgcccaattataaagggataattgggaagacaataaggttgttgattttttaaaaaaggaaacgaaggagttgccatgattgcggttagcagtgtgaagaccctggaagacctgcttgaacttctggggtgttcacagtctattgcttggtcaggagccttagaaaacttagacatatgtgttaggagaccaggttttgaaacttgctcagggttgcataaacttctacattaagttccatgatgccagattagtagtccacatttgcatagtagacatgctgttgctgttccttttcttatcacgaaaagagcagaagatgcagattatacctgagacagaaagatacaggggagatactgagcttgttgcctacctttgggcgcctctcatgccttgtatttcacattgagcctcacttatcagtgacacagggaatggtccttttgctctccaccttccccatggctgcctggaggcaggggaggcagattgtgccacttgctgacattgtgttgctgtggattagttggagggacagggacaggaaactttcctggtggtgcatgtgtcactggggctcacacgggtacttttaaatcttcttctcactggcctctgtgattctgtgaacctggttattacatgttcaaaaagtgtcagcttatttgaaagggatattcttattttgtatttaaacattatgaaagatcatcacacttttttttggagacagagtgttgctctgtcacccaggctggagtgcagcggtgtgatctcggctcagtgcaatctttgccttgtgggctcaagcagttctcatggcttggcttcctgagtagctgggcttacaggtgcaccaccatgcctggctactttttgtatttctagtagagatggggttctgccatgttggccaggctggtcttgaactcctggcctcaagtgatctgcctgcctcagcctcccaaagtactgggattacaggtgtgagccaccacacctggcccatcacactttttgggtttcaggatgccaacagatcctggattctggcatctggattatggtagcaatattgaaaaaaatattatagtggggagtaaaatttaggaaaaccttgcaaatttttattcttactcaggagctttgtcttcatactccatggtcagccctgggcaattaaaacttttgttccagtaaaggtttcattctaaagaggtttcattaattatgaaaaattccccgtgggcattacattgtgaatccttttgtagctatcataaataatgaaggaaaaacacttgtcaaaatatagcagaggtgactagataatgcatctctcctttgatttttgatgggtttccttttttaatttttaaaggaataactcttgcttatttttttaaaaaagtaaatactcgttataaaaaattcaagcaaaactgaaaagtaaaaagaagccagcaataaattgttccaaatcccatcacccaaaaaacagctcttgattcattcattcaatgtgcctttattgagtgcttactctatgtgaggcactgtggcatcggggatcagcagggaacaaagtgaagtccctaccatcatggaacttacactctagtgggaggagaaaatgataaacacctaaatagatttacaagtggcatgaagaaaaattaaaatgaggtaagagcatagagagtgtcggggcactttcagatggagtggtcacaaaggctgctgtgagcagagagctcaatgaagtgagagagctaaccacgtgactgtggggaagtgtgcttctagcgaagggaagcatatgcaaaggccctgaggtgggtgtttgcttgccatgttctatgaccagagaggccagtgtagctgggggccagtgagtaagggtgaactgggccatgtaaggttttggaaagccgttagcttttctccactgggaagccattgaaagatgatgagcagggctgcagtgtggagagtagactgcagggaagcaagggaggaggcagcaagaccagttaggagctaccacagcaattcagaacaaaatgaggctgagttgcactgttcaaaaggtggaagggataggaagggttgaattctagactcattttgaaggtagagctgataggatttgctcatgaattggattgggaatttgtaagagaagagtcaataataactctgaagatttgtggcctggcaggtgaatggtggtaccgttactggggtagggaacgtgctggggtgtggtcaggatggggtgtcaagagttcaggttcaggcatgttaagttctaggtacctgttagatggctatgagggaatggtaagtcagttggaggctggagttgactgagagatctagactgtagatacagatttgggaatcaccagacatagaatggaatgggatctgataggaagcaaggagagatagaaaacagatcctatgactgaatcatgcatggggcatttcagcatttagatgttggaaaaggagagggcccaacaaaggagacagaatgtgtgtctgtagcatatcaagagagtgtggtgttctcaggccagtgatggtggtggtggagtctcaagagttggcaatatttagccatgtgcaggtcattaccacccaccacaagagtggtagaagcaagagcctggttacagtggccttaagagaaaaagggaagaaagaaggtggaggcagggagtacggacaccattttgagtcttaatgtaaagagaagccacgatgaaaaggtaggtgggttgggagaagggaagagatcaaggaaaatatgcgtttgtttgtttaataagatgggagaaaatacagtgtgtttgactgctgctggtaatgggccagtagagatggaaaatgatgatacggaaaataagagtgtataattttaggaggaaagggcttgagtaagcaagaaggggtgggttctggtttgcaggtagaaagataaacctaggttagaggctgagacagggcaggcaggtaggaggggaaggctctggatttggtaatggtgcgtatggactttctcttccagtgttaacatttggtacacataaacagaagggtggctggtgagggtgaaataattttataagaatggcattataccgtatgtactataaaaataaaaataactgcatttctttttacttgaatttaacagaagaaaagaaaactgaaatgaaagtgaaagagctgctgtacttttttctctaccaaagataatagttcctaaaagttttctctaaggttaaaaaaagattatgaaaactgttaggaggctaaagtcactattaatatttttaaagacatttttagttatatcttcactttagatgattgtctggaagaattaggtaattcgtgtttttaaacttccttgcactactcttcctatctctcaatttttatagcttatctttttttttgttgtttctttttttgccttggcaattttctaacatttacattccaacttgcatgctcccattttttggtcttggtgccatatgtagccacttgttctttgatcgtggctttcctgttcctgtggtttttgttttgattgatctactgggtgcaagatttctgtttctcaagacgagttcgtgggtgcttcataggctgagatctttcaagttgcagaggaagagagatgtctgaaccttttttacacttgagtgatgactcagcttctcctaatattcttggatcacagttgctctctatcagaattttttaagacatggctacattatcttcaggccttgaatattgctatggagaagtctgagaccaatctgggtttctgctgtattttgttagcaatccattgattcttaaataactctttctttatccttgaagggcaaaaatttaaacattataagtctttgttgatttttctgtgttcatttcatgatatattatgggccttttctattcacagatttagttctctggatatttttttctgttttatttattgtcttcctctgcatttattgtgagtctcttaagccttttttttacacaccattaattagatatttaaaaactttttattataaaaaatttcaaatatatacagtagagagactagtgttatggattctcatgtacccatcatgctactttgataatcatcagctcagggccaattttgtttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgccagttttgttttatctgtatccctcacccattcccactctcctccattactttgaaacaatagcagatataatttatctttgaatatttcaatatttaagagataaggaggtttttttttttttttttgagacggagtctcgctctgtcgcccaggctggagtgcagtggtgccatctcagctcactgcaagctccgcctcccaggttcacgccattctcctgcctcagcctcctgagtagctgggactacaggcgcccgccaccacgcccagctactttttttgtattttttttttagtagagacggggtttcactgtgttagccaggatggtctcgatctcctgacctcgtggtccgcctgccttggcctcccaaagtcctgggattataggcgtgagccaccgcgcccagctggactgttttttttttttggtgttttgttttgtttttttaaacttaaccactaataagtttcatctagtctgtttataatctttttactaaatatataacaacattgccttgtggtgtttagatcagcaacttctttgctccaaaggtacagtgaatgatgacggttgctgggcctcaaaataaggaagacgaaactaagagaacaggccacaggactctccctgatgttgaatggcagcaccttagattgggcaacagtaacatgagttgcatacataggaagtgcccactggttcctgggtgttctctgaatttctagtgctcacgtgaactgtggagggcaaaggaggaggatacggaatgtacagtttcttttacagcaagaagtgaaacttaggccctttctgatttaataataacccatgaagaaggagctgagtggtttgaagactgttctagttctgcctttggtggccatgtggtttattccacagcttttcaaactgcaggttgagaccttttactaaatcatgaaagcaaattagtgagccacaaccagcatttaaaaagttatagaaaatatcagagttcatgactaaggataaatgttgtttcatgacacttttcagttgtgtgtgtatgtgtgtgtgcatgtgtgttggattgccaaagtttgaagccactagttttgttcaattcctatcactttctgtaccttctttatcgaaaagttaaaggatcaaagaacctatgggatagattttatgtattatcagaaatgtatataagtcgggcacggtgggtcatgcctgtaatcccagcactttgggaggccaaggcaggtggatcaccagaggtcaggagtttgagaccagcctgaccaacatggtgaaactttgtctctatacaaaaaaattggcccggcgtggtggcaggtgcctgtaatcccagctacttggaaggctgaggcaagagaattgcttgaggctgggaggcagaggttgcagtgggctgagattgctctattgcactccagcctgggcaacagagcgagactccatctcaaaaaaaaaaaaaaaaaaaaaagaagaagaaatgtatgtagtgcttacagtataatgtaccaggaattattctaataactttacaaatattaactcataaaaactctgtgaggtagatactgttattaacaaaattttacagaatagggacattcttgcatagagagataagtaatttgcccaaggtcacacatagctagtaggtggtggagctggcattttgagcccaggcagtccagttccagggtcagaattttctctgcggcctctccagtggatagcatctctagatgatggcatggactttttcctgctattgccttcaagaagaaatggtaaaaaggtggttccccctctttcccaacacatacacctaaacattcagagttaagacagtgagaatgaggattcttaatttggtgaaggtgaaggaattcggggattctttttgttaaccaatcaacattgccagcctagcactaaaagattccactatgacagacaaccacatgaggccgtatctcagcattagaaacaaatggatgggggagagtggttaagagcactgattttaagaattaaacacatctaggttcaaatcctgttgtgatctgttactgtctgagtgagcttaggcagttaactgatctctctgaacctcagtggtccctcgttgtgaaatgggaggaatcgtggttgccttttaatggaggcttactaggcatcaggcatgtagcaagcactttatattctccatctcttttattcttcataacaatccagtggagtggctgctattacaaactccattttgtagataatgaaaacaacttagagagattaagtgtcttgttcagggagacacaggtaccaggtggcagaactacaattaaaattcaagtttttctgaatgcggtctatcctcttaatcactcagctttgctgtgaactaatctccctggggtgttttgaggattaagtgagatacctttatacttgaatagtgactcaataggagcctacttggcacataataagcacttaatgaatgggatatgtgattactagtaaatatataagatgtgtctgcctataacttttgtggggacagtttacctttccataaaaaaaaactgtggtcaactaaatcagttcttataacaaaccagtcacttcacatgtatattgagttgttgaaaaataaatggttatctattctgaaggatctgctgggcagattctttcattggaataagttttgtcaaggacgggactgtctacccaacatccagaacagtacctgtcacaaggtaggtgtcttagtctagagtccttgaaaatataaattagagggagaggcaaaagcgtacacttcatttgcaagagtcatcccagggaagcaggaatggggagaaagggaaggagggagaacataacaagagattgcttataagttgactatagcttcatgagaggatgattgcttggtcttgtgggacatcttcatgtaactatgtgaagctactgcatctctgaacagtccactggggcaaggagggaaaatatttcattcgtcagtttctatctcctgtaggtcaaagtttgattcttgaagcctccacttctctgtacttgttgttgacatgactgctgattgaataggtcactccaagtctcatgcttcagtagcaggagagaaagcctgggtgggattgagagtcacgccgcaggggtagaaggcaatgcactgtcaggctggtgcatcaacaacatatgaaggcccaggaacagccattgcaataggaactgggcagactgtttcagccagcagcaaggtagttgtgttcatctggggtggtgcataaactgaatctggcagagcaggccctcaataatgatagacttctcattgccaaggttaatgagctctttgccttgctgtcttatttaaatactccatagttattgacacttttgtacatctctcttcattcttaatctactttcctatctctccttgctttgctttccacctaaatggggatatcctaagcctacatctttttaattctacatgctgtctatggacagctgcattcactttgctggttaacttcctaactgccatctataatatttgctgatggctcccaagtgtctatttctagacttgacctctcctgagaacagaaggagaatacaactgccttttccagtaggatgcttcgtaggcatttcacgggccaactgaacttcttggtcttctttaatcatttttgtttgtccttctcactggtaacgaataggtgcttggtccctgcttgttgaactaaacttgaaacaatgtgccagtacttatgctaagctgggtcctgcacaaaatgaagtgaactctccagagccagctctacaggaacgtagggtctggattttaatattgatctggtttgttttcaactcgattgtgttggagccttgagcacatacagtgtgcctttgtcctctaagagagtggacatgtttgaactgacatttggtcttttcaggaattgtttggtaggaaatttcttggatttttactctccttgagctttgactcttcttgggctgtcctgcttttcaagactctcattttgctttgtccagagtttacagagccctttagaactgtgtttgtatctgttctgctcatcaggcatgcaggaccctctctgctggccctggcctgcttatttaccccttctcttcatactcttctgtgtgaaccttcaagtcacaaggcttctcacagcctcctgagcttcatctgcccattttagcctctttgactttgctttgctaactacaacccttcatctgtcatccccctcgcttctgtttaaatccccccctacccaaggtctcaagaggtccatgctagattttactgatttcttcctctcttaatgtagtctgggaccattattttggcacttaggatgccagtcttatactcttaaatatttttgcatttagtcctccttttctccaattcaattgtaagctccttgagagtaagagactgtcttacattttcttgtgtaaatatcttacattttcatgtgtgttccaatgattcatcacccagatcttcccacagagttggtgttagataaatatttgctgggtttgttggttgattatcgtggtccttgggaactgacttgcagcttgtcactagcaatgaatcaggagcatcagactagctgacatttcccagaggagctgctggtcttcacatcctgcatctttagtttgtggtacaagttaattctaaattttggaccttgagaattctgtttcttaaacatctcaggcaagacctaggagctaaaattactactttggcatttgatgtggcagctttttcatttgggatccttttgtctttaacttgcttttgagtcacttgaaagaactaaggcagcctgccagagtagtcacgatgatattgaaatatccctctcattggctttatgagattgccttctgtgcattcacttggggctggaaagttaatggatgactgaacgtcttttggaaacttgtagggccatttttcttcttctctttcccactagctggtttctctttgttaccaaaggtgcatgcattgtttttaggtagtgtggagttaatgtaaggggaggagtgtttctttctttcatagctttggaataatctaccgcacagggcagacagttttgaagatggccatgtttaaagtccatcagagaaaactacagtcaaaaggaaagccagggaggccagagttccagtcacaactgcccccactacccccttcctcccaccaagattactgtcttacctttgaacccaaggatgtctcttatggctccagtttgctgactactgtgaagggaaggatggtttggaatcatactatagagtcatgggctctaaagtacgtgttattgctaatgattggtgttggtatgtgcagggattttccactcatggaattctcctactcattttgacctctctaccattcagcttgtattgctcattaatgttcactccatttcttcatttagacagcataggactccatccagcagacttccttcactgtgatcttgcttcaactccatttattacattcatcatgacacaaacttttaccagctccatttctggctgcttgagatccaaactactctattggcctttggagctattcctcctcttgcacctttatctttgaccaagcctcagtgccaccttttgttccagtaaggacatcttcctccctaccccacagagaggccacgctcaaacattcctatctcttggtgtacgttttctcttactctgggatatcctctcctcacccttcatttactgaaatcctactcttcctcagaatactacttcagatttctgtttccttccctttctctctctctttctcctctcctgccttccctccacaaacttggaggcctactataatgctaggtgttgttctgggtcccacaagtacattagtcaactgaacagacaaatttattctttttttttatttttattttttgagatggagtctctccctgtcacccaggctggagtgcaatggtgtgatctcagctcactgtaacctctgcctcctgggttcaagcgattctcctgcctcaccctcccaagtagctagaattacaggtgtgtgccaccatgcctggctaattttttgtatctttagtagtgatggggttttaccatgttggccaggctagtctcaaactcctgacctcgtgatctgcctgcctcggcctcacaaagtgctgggattacaggtgtgagccactgtgctcgaccaaatttcttcttttcaagaagtttagactacctccagaagcctgactatagtaatgggattccccactgatcttcctgagctttcaacactttcattgtagtatttattcttaatttcatgtccttatagtatacaataacataatttctgtactatataattatatatcttgtgcaattatgtaatatgaattgttatgtgaaattttgaaatgtatatttggatcatgtcttcacaattagattgtaatttcttgagaacagggaacttcatacttcagaaatcctcagtttatccattacagcccctttgcaagggaccaaaaatccaaggcaaagtggtttttttgtttgtttcttttttatatatcttttattttatttattttatctttttgagatgaggtcttgctatgttgaccaggctggtctcagacttccggcttcaagcagtcctcccatctgggcctcccaaagtgctaggattacaggtgtgagccaccatgcctggcctaggcaaagtgttttaagcgaaaattgaatgaattgacttgtgtcactgaaaggtccagggatagggctggcttctcatcgtgacttcattcagatactcatgtttccttctccccatctctcagctctgcttctctgggccaactccattctcaaatgggctttccactcacggtagcaagatggcagtggcagtgtcacactctctttgtccccaggtcttccatctcccagccaaggcctggatttgagaaagcacactatctttggagagggcaggggtgggatcagttttactgaaagcatgtggaccgagagtggggaaaacatggatataaggaatgaaaaacaattatttcagaaacataatagctatttgttggttggttgtgccttatgtatttagttttttgagacagggtgttgctctgtcacccaggctggagtatagtggcacaatcacggctcactgtggccttgacctcctgggctcaagcaagcctcccacctcagcctcccaagtagctgggactaaaggcatgcaccacccccccagctaacttaaaaaaaaattttgtagagctgggattttgccatgttgcccaggctcatctggaactcctgagctctagtaatcggcccaccttggcttcccaaagtcccgggattacaggggtgagccactgtgcctggcctgttttgtgccttacttaatagagtaaagtaatgcagaaaaagactatcagtcacactctttgaggaagaatatttgctgtttcctagtttactgaaagtatcttgatggccttttcttggaaactgactactcataggtaagtaatgtcagtcactgaggatgtgttatagcacatataacacattgagggtggtgctgtgtctctctctctgctctgtgcgcatactcatttgtttatattattatttaaccttgtttgttactgtttttttcttctttcttctccactaccctgctaactttgaggaagaactttttgtctgtattcccagagcacccggaaggcactcaaatagatgtttgcaatgagagtaagtaaaagtaggaaaggacattgggaactcagcgacttggatttcagtcttggatctgcaactaaatagctgtgtgatcttggtcaatcccctttgctgctctgagctttggttctcacatctgtccagcaaggatttttgagtcctccctttactaagttcatagaaaggcaaactagcagagtagagagcaagacttggcagggcattctggtattttgtttcctgaggaacagttttgagaggggctgattactgttgtgataagaagtcttggtaagagatatggagggtagcgcctgaaagcctcaattgtattcttatgtaacattctctggaaaggtactaggaattaatattcctgagatggctgaggtgacttcatgtgtttgtgaaggggctaaaagcaggtgaggcagattgggtggaaaaagactggcagtcagaccaggttcccaatggggagcgcgggctgatctgctccacgtgctggcaacagagcctgtgggagatgcagctcctgccccctgggtgctggcacatcaaggagaaaggaaggacatgcctgtgtgactctcctgaaagattacatctgtctcctggcctgcccttcctcccccattttctccttagaaatgtggtattcatgacttaatcagagaaaattcctgaagaagaagatgaattttgaaaggaggaaagaaagggatctctggattgaaagcaataggctgaacacccccactccctcaccccctgtactctgctgactggtgaattccctggatgttctctgaagtgagggcagttttcagaggactgtgtcatctgcattggcaggtgttgtaatttggagtctacatgattgtcagcgtggcagggccctgcctgtttttgttaaatgatcagtatcctattagggctagtttttcttccagttgcatgcttattgagacccttcagcatctttctaaaaaggaaataagcctctttctaaatactaggacgagtatagttagtgtctcagctgtggccaagcatgggcaaggaggcagcatttcccaggggaagcttcatgggtgtgtctggtgatgctggatttgaattcacatataaaaacactccctggcaggtctttatctgacatcgtttggaaatggtgatctgccagtggagttcaatgtcatggccaagcctacggcccagaggggcagcttccaagatttgctttaggaatagtcaatgcagaatgtgtttaattcatacacacggggaaatggaaaccaagaatccgttcctccttttggctcctgtttgttgggttattttccccttcactggcagatggtgctcaacagaatatgctatgtggtggggttaaattttttaatctgtttttttcagtgagatataattcacatactgtaaaattcactcttttaaagtgtacaattcaattttttaaacatattcacaaggttgagcaacaatcatcactatcttaatttcaaaacagggaggtttaaatttgtcttgaatctctgcatgaaatatcaaccagaggtcaactctgattctcaggaaccttttaaaaaaattgggttcctcttgcaagggaagctgcaatttttattcaagtgtcatttttaaaaaaacataataagaaaaaatgatagaggacattggatttttcttagccctgttatgtgatttctttccgctattgatgatttttaaatcttagatcttcaggttggggcttattaccacagctttgttataataaagaatatttaaagcagaaacaataagactttttgtgttctcttgtcctttctcttctttgtcaagccatgcctctttagacagagcttagacctgtcttttcctcctttgtcaccatcacctagcacagtgcctccatacaggaaaggctcagtaagatttgctgaataaatgggctctactgggcgctcaggggaggctgtttggatgtatatatcactccaggtgactcatggcgaccttagtactttggctttgtgaatagccagggaattcttttgtacccctaagatatagctgcttctagaaagtgagagcttgacttctttccatgtatttctagggaaggaactggcaaggaccccaccatctccatagctcccaagtattctcatccaactgtaaaccagatgtgtaaagtcttcttgagttggtatcgtgaagcatggtgtaagtggtatgagtggtgtgagtctttgagtgtgtacacatgatgtgcacatgcatgatcgcctaagcacatgagggaactgtgaggagttcctctatgtttttaaattgcctctttcttctttctgcccttttgtttgttgataggccaggattcagaggggccttcagcctgggcacatggcccaggagtgctggtattcagtggcccattgtttcctgccccttgtgtgcatgaacggggactggggccagcatagctgccttcttggggaccattgtttgtctttgtaggagcagcagcagcagcgcctaaggcagcacatttttccctggatagaacaactgttctgtcttggagctgtacgcctaagagtgagagtagttagaatttcccttaatgcctgtatggattctttgaagatggtaacaagggaggcatcttcttctttctgcttcctttcttctttttccttcttcattctctttcttctttctttttctcctccttttccttctccttctccacctcctgttcttccttccttttccttcttcctcttcctcttcttctttttggccagttgtgagggaggggagatgctcatggtgtcatatcacaaataaaccacactagcaggtggtatctattaacagagcctcttttttttcctggatcaggggtggggatattgctttcttactgtctctgtcctctgggcttcctggtagacctcagggtgtactcacaggacaagaaaagcacttccccctaagctgtcctgtagagtagatctaggaagtggggaagggatccagtgtggttgtggacagattgaaacagagctagctggtgagtcggtgggcaagtccaaacttgtcttaggggcctgaatcaaccctcagctggaaagtggaaaaggcgatgttccaggagttaagagtcatggtcactgtgatttacacagagatactttcagagactccaaactggtgttctatttctcttgtttttgtttctctgacctactattaacctctttgacaagtcagacaaaccttaatttagctccagctcctgttgcataattgttgaccctttggtaaattacttaaagagtcttacttcagttttctccttagtgtaatcaggataattgtggataccttacagactacctgtgagaattaaatgagatgatacatagaaaggcctataaaatgtattcaataaacacatgctcccatcccttcagggttccagagggagtacctgtgatgcagcatatactctgctgccctcattgaggcacctgcaaaatcaggctggaattccttgctggctggatgtgcttgggggtttcttatattaaatcacatatctcagaggcctcctattaagtacttgttccttggacaggctaactctggagtggcctacttctggaacttcatgggactttgccttgtcctctctttttttggcagagggtgggtgtcatccaactaactattcctttgtattcccctggtgagtgagattactgaggtaaattcttaagtgcattacaggggactcagagggacctgacagccttactgcccatccatatcccctgtacatctgttactgattcagtacctggaaagcctttccaccctaaaaacgccttggttcttttttttgttgtttgtttgagacggagtcttgctctgtcgcccaggctggagtgcagtggtgcgatctctgctcagtgcaagctccacctcccgggttcacgccattctcgcacctcagcctccccagtagctgggaccacaggcacctgccaccatgcctggctaatttttttttgtatttttagtagagacagggtttcaccatgttagccatgatggtctcgatctcctgaccttgtgatccgcccgcctcggcctcccaaagtgctgggattacaggcgtgagccaccgcgcctggcacttggttcttactgaacggatggaatttaagtaatattagtaagcattctgaatgccctctcaatgtacagtctgcccacccaatgtctattactatcagcttttcactaatatattgaagggggacagatgcctacaggaatagtctcaacaagggctgttccctttaagagacccagaaatccctggcaagaaccagatgcctgacataacctctgcagatctttacccccaatacccttgtaatcagactccgtaaaacacagaacaagagagctttgatgagtgatgaggtaggcagcttttctgcacagccttctgtctgcttgaaacaatcctccggagctcagtttcagttcaggtgaggttactgcagggctggttggcattggtggttgacagggagagagatgaggatgaagagggtgagaattgcgcttacagatcacctgagatcatctgcaaaggacatactgatatttgtaaaaacagaaacaaaaatgtagatggggacagattgtggagcctcgactactttaaggcaaagctaaacgcaccatttacccatcctcattgcttcaagaacatttcagcatcatagttctgatcctgatttgcctctgatttatctgcagctcacgtgaaaactctagaccccctctccccataatgatgcattacatagcattacatagcatagacagaaagcattgttgcaactgtactatttgggaatgaatttggggcacacataaggaaaggcataatataggtgctccttttctgtgggattggagtcactgtcacatcctaatgcatttggagctgagcaggcttgcagagggaaaagatgaaagaaatggctccattctgactcagatggggattgggacataacttcagcaggatacacactgcaagccttctctgagctgaaaatcagtctggctttgtcatactgcttcctatgagtgccaggtctcttgtcagtaacaaatgcagtgctgcatttgaggcagatctgtttgcatctatagctgcctttgcagcagttccagagagagtgtttgctagctccatacaaggaccctgaccagccagaaatctgcatgctagagcttaaccagaagtatttctagctatgacactatagaggcactacagcatctatgaagattaagcaacacagatatgagtgatatttgttagtgaaaaaaatctctttccaagtcttcttaaaaaatgattttcattctgtgatgttggaaactgtgaaatctgattgacagtgaatggtttgcctgcccagaagttcttgtgcttcttttgttttgattgctaccatttgaccttgggagattttcttcctatctccgttaaaatatcctgaccttcatcctacttcatgaagatggtaaacaacattttgaaatgatggggaaaaatgcaaaaagtaggagcatggtctctaaagtcagtctcttggggtttgaatcccagcttcaccacttaaaagtttgacttcttcaagactctgttttctcatttttaaaatggggatgaggtagtacctgcctcataggatggttggggtgataattcatttgggccctctgccagaagacaacccagattctggctctgtgccactagaaacatagtaatataaatggtagataggaatgttattatttttaataagcagcttctcataagtgattcagcagattcctggttcacaatgttctttaatggtgtaaaaagggttggcatttttggaggtgcctcacatcctatggccagtttagactttaggcttttttgttcagggctttcaatttcccagggcacggggaataagtaagtggaaggtgggtgaatattggcatgcatggtggtttatttagggctgtctttctgactgtcttctcttgtttttgttgtagagatccgtgctcagctcacagagcagatgaaatgcctggaccagcagtgtgagcttcgggtgcaactgttgcaggacctccaggacttcttccgaaagaaggcagagattgagatggactactcccgcaacctggagaagctggcagaacgcttcctggccaagacatgcagcaccaaggaccagcaattcaagtaggggctctgtggctattactctctgagaccttggaatatggggtccagggtggaggggggcagggtatgccacttagatccagctgaattcaggagcccctggcttcagattggttgaaagccctcaaggacttctcattttccagatcagtcttaagtgcaattcaacatttcgtagagatgagagtagatgatgaaccatgctaataataacagcaaacttgtttatagctctgttgccaggcatgctactaagggctttacatatatgttagtttgcttaatcccaacaactccatatgatggttattgttattatccccaatttatagatgaggaaactgaggcataaaaaggttaaggggcttaactcagggtctatcttaatctctgtctctctctctctctctctctctctctctctctctctctctctctcacacacacacacacacactcacactcacacacccctagtaaatagtagagctggaattgggctgcagggtctatatttttaaccatttcaccaaactgtctttaattagaagaaataaatgatgttgaggccattatatctaaatccctgtctaggtagctgctaaggtctatttcttctacatttagtttattttatacagctggcccattcacttggttcccagtgccattgccctagtttagatcatcatcttttttgcctgaatgattgcagtatttactatatcttctatagcagagattttcaaccctggctgcatattagaattccctggagaactttaaaaaaaatacagaaatctgggccccactccagaccaattaaatgagaatctctgggagtgaggcctgggtaacagggtggtgtaaaagcttcccaggtgattctaatgaacagccagcattgaggatcacagtccacagcaggggtgtccaatcttttggtctccctgggccacattggaagaagaagaattgtcttgggccacccataaaatatgctaatacaatagctgatgagcttaaaaaaaattgcaaaaaaacctcataatattttaagaaagtttacaaatttccgttgggttgcattcaaagccatcctggcccccatgcagcccacaggccgtaggttggacaagcttggtctacagtttctctccattccaatctgcctgctccattgtgatcggagttaatcttcctggaacacactggcgatcagagaatttctttctgcaaaactttcaatgtctctccattgtctatgttctttttattatgattattattatttttagagataaggtcttgctctgtcacccaggctgaagtacaatagcgtgatcttggctccctgcagcctcaaactcttgggctctagtgatcctcctgcctcagcctacctcctgagtagctgggactgcaggtgtgcaccatcatacccagctatttttattttattttaattgttgtagagacagggtttcgctatgttgcccagtttggtctcaaactcctggccttaagtgatcctcccacctcatccttccaaagtgctggaattacaggtgtgagccaccacacccagcccatctatgtttttgatatcaaattgtagtttctcagtgtcagcttcatctgtactgttagaaatgcagtatctcaggtcctactccagtcctactataacaagatcccacaacatagcatgtgatttgtgtgcacattgacatttgggaaatgctgttccattcacaaaggtgcacactttttggcttggtctttaagcccctctacatctggaaagcctcaaacaggtttccaaccttatttcttgtttctgttccactatacccgagccaaacagaacattcactccagtgagtcactggcatcctgttacttgaggttatgtggtcagtctttccatctttgcatgtctaagtcatgcccatgtcttaagacccatctcaggtgctccctgttccaggaaactttcctgattctcccagaaggaagaaagttctccatcttctgaattcttacagcattttatttgttcttctcttagggcattcagcactatctaccttctgttatcttctctgagtggactgtataagtttgtttgatcttctggtgtcccacagtgcctagtataatatgtggtgtatagtagatgctcactaaatattgtggaataaataaatgaatgaatgaatttgaaattagtgccaagtgtatcttattttccccattttctatttttgtttattgccttaataatacaggacacaaattatcctttaaaagccagctctgtgcaatgaagatggggttaaggttgaggagaacatgacatctcaaaataagccagaatgaaaatttcctccagatgtttttttcctcagagtttcttatctttcccaagtcttattctctttatgataagagaatcatctgataaaaaaatgttattttagtatgtgataaatgaagacttaggggaggaatcatttgctttagaaaatgattcaaagttggatttattctgttggtaatctcatcctaaatttaaaatagcatttgatttttagtactgtatcatattctcagcttatggacgtatttgttacaaattaaggttcagatgtgttaatctccaagtcatcttgtgtccggaattggtgggttcttggtctcactgacttcaagaatgaggccgcggaccctcgcggtgagtgttacagctcttaaggtggtgtgtctggagtctgtcccttctgatgttcagatgtgttcggagtttcttccttctggtgggttcgtggtctcactggctcaggagtgaagctgcagaccttcacggtgagtgttacagctcttaaggcagcgcgtctggagttgttcgttcctcccggtgggcttgtggtctcgctgggctcaggagtgaagctgcagatctttgcagtgagtgttacagctcataaaagcagcatggacccaaaaagtgagcactagcaagatttattgcaaaaagcaaaagaacaaaccttccaccgtgtggaaggggacccgagcgggttgccaatgttggctcgggcagcctgcttttagtctcttatctggccccacccacatcctgctgattggtagagccgagtggcctgttttgtcagggtgctgattggtgcatttacaatccctgagatagatacaaaggttctccacctccccatcagattagttagatacagagttttgacacacaggttctctaaggccccaccagagcagctagatacagagtgtcgattggtgcattcaccaaccttgagctaaacacagggtgctgattggtgtgtttacaaaccttgagctagatacagagtgctgattggtgtatttacaatctctgagctagacataaaggttctccacatcctcaccagagcagctagatacagagtgtcgattggtgcactcacaaatcttgagctaaacacagggtgctgattggtgtatttacaaaccttgagctagattcagagtgccgattggtgtatttacagtccttgagctagacataaaggttctccatgtcctcaccagagcagctagatacagagtgtcgattggtgcacttacaaaccttgagctaaacacagggtgctgattggtgtgtttacaaaccttgagctagatatggagtgccgattggtgtatttacaatccttgagctagacataaaggttctccacgtcctcactagagcagctagatacagagtgtcgattggtgcactcacaaaccttgagctaaacacagggtgctgattggtgtatttacaatccctgagctacatataaagactttccacgtccccaccagactcaggagcccagttggcttcatctagtggatcccgcaccggggctgcaggtggagctgcctgccagtcctgcgctgtgcgctcgcattcctcagcccttgggtggtcgatgggactgggcgccatggagcagggggtggtgctcgtcggggaggctccggccgcacaggagcccatggagtgggtgggaggctcagacatggcgggctgcaggtcccgagccctgccccgcgggaaggcagctaaggcccagcgagaaatcgagcacagcgccgatgggccggcactgctgggggactcagtacaccctccgcagccactggcccgggtgctaagtcccccattgcccggggccagcagggctggccggctgctccgagtgcggggcccaccaagcccaagcccacccggaactccagctggcccgcaagcgccgcacgcagccccggttcccgctcgtgcctctccctccacacctccctgcaagctgagggagtgggctccagccttggccagcccagaaaggggctcccacagtgcaggggggaggctgaagggctcctcaaatgccaccaaagtgggagcccaggcaggggaggtgccgagagcaagcgagggctctgaggactgccagcatgctgtcacctctcaatctgaattgttctaattaagatcacatactaggaatagggtgatttctccaagtttagaagaattgatttattttctgataaagatggtgcttggcaacattttttcctcaaataaccagtgagtatttattgattgaccagttctgtgcttgtacaaggcattggaaaatacaagagaagtttagggagtcattatgtggttggagagaagattttgaatacaggaagcaattagagcataaagcagtaatgatctcattaattggtgttatgtacaacatagatctgatgagaggtcagagatggttaaaggttctggaatagtctggaaagttgtcatgaagcaggtgggacctaggcttgagaggtagatttgtgtggcagaggagagaacagcaagtgcaggtgagaggaagcaggaatatttggtgatgagagggtgtaggggctagtgtgggatccagctttattaaagggaaggttcctaacacattcatctaactgatttccattgcacattccttgaactcctttgtgccttggagtgtagcagggaacaaactgctacacttagcacttagcacttagatgaagaaatgggcatttaacaaatcacacaattagatatgtaatttaaagttggggtaagtgttgtggaaggaaagtatttaatacaaggtggcacaagaacctggaagagggcaacttttccactttatagctggtttactccaatagcttcctgcctgatcatattctgggtaacaatcagtctacttattcaacaaattacttttaaatacctactgagtactgtgctctgtgttgattcctataggaactaacataaacttaggaattcctgtttaagcggagcatggtgacttatgcctgtaaccccagcactttgagagggtaagataggaggatctcctgaggccaggagtttgagaccagcctaggcaacatagcaagaacccatctctacaaaaaataaaaaattagctcagcatggtgatgcacgcctgtagtcctaacttctcaggaggtgggaagatcgcttcactccaggagttggagcctacagtgagctatgactgcaccgctgcacaccagcctgggtgacagagtgagaccctgtgtctaaaaaaaaaaaaaaatccctggttaacagggaaaagagctatgtaaatagtataatgtgaaaagagctttagtagagatatgagaacacagctattttcaagagcagtggaaaataaggttaaataagtagagtagaccccaaatgatagccctttgatagcaagcagagaagttcagattgggtgtggcagcattttagtgggtcctctgggttcttaggtggggagagagacacgaggaaaacagaaggccaggatgaaggttttggagtaatctacacacaaagtaagagcaaaaaaaaaaaaaaaaaaaaaaaagtggggggagtggaaaggaagtaggaatatattcagaaggtattcaagaaactaaataggactggataactgactggataaagcatagaaccataatggtcagaggtgacccagtgtctctaccctggtgacctagaagaattgtggcattcacgatagaagtgggggtgttgagggaagatctgttttgaatggtgatcctactttgaacattttgggtgtagagcagtacgaggccatcaggtatccaggtggagatggcatactgctgaggtaagaggttatgactggggatagctagcagaatcttcggagtaaaagtgattgtgggagagatgaaagtatatgaattcagggaagagaaagaggagaacaaagagctaaatccaggaccccaggcttagacaataaaagttttgcattggtagtaaaagttactatgaggagaagcaaaagctacctgaagagagagagaatagttttgttttttaaggcacagggtagaaggtaaggtgggaaagtggcgtctgatggaactagaagtgttttaagtagaagatctgtaagagcaatttcttattgatactctctcatgtataaggtattgtgagagatgcaaagatgactaaaacaagccccaaacccaaatgttttcaatctcttagggtgaaacatatgaaattgctggttttttttgtaaggcaaaatggcaatttcatatggtacagcctggtagaagaggagatagaacatatgtacaaatgcatttaatacaggcaaggtggtgagaaactcaataagagaggctcaggcaacatcctactttcatgcataatttattcctaaaagtgtatacagaagtcaaatggttgaatgtctaactacagttttatgtggggtaggtaggttctattattataaataagtgtatatgtgaaattccaaattatccctcacctgatatatttttagcattgtataccttgtctttagttctgtttgtttttccaccattaaactcatggcctgcctgctcaagttcagtgaatacctaaagagtccacgtagctgatgagttctgcccttatcttagtagtacagtgatgagacctctacttctcaatgcctcaatgcaacattagtaacagcacttttgtttttccatttccactcatttttgtgttgcaaaagataaccaagtgttaaaatgtgtgcacagcacaagcattgctgtgcagagacaaccatcctgctgaaacagaattggtacctggcagtcagcagcactaagacaagcttgaaacatttgctggcaactgaaaatttgacattggcataggaaaggcatcttaggcatgtctgatttggtaaagatataagtttggctgatgtaatagaccccaagtaataatggcatacacaagatagaggttgatttctctctgatgtcatagtctaggtgttagccatccagggctgtcaggcttcttattccatcccgagagtgttatccttttctgtatgacccaagatggctcactgccaccatgttctcattccagccagcaggaaaaggcaacaggacgaggggcaggtatggccttattttttaaaggtgcactctggaagtggcacacacagctcttcaactcatatctgactggccagaacttagtcacatggttatgctgaactgcaagggaggctgggaagtgtagttattgttctgggtgactataaagtagagtttctcttaatatagaagaaggggaaatattgggggacaatcagcagcatctgccatggtgtatgaaaggacaagtgtaggaaagaccatggccacccatccatacagagtgccacaggtgcacaaagaagagagatttcttctgattggaggactggagagggctttagggaggtcaagttcaatggatgggagataaaaaaattaaagtgccaatgctaggcattgatcctttaagcttaatacagttgagacaatggagaagttgtagaaagaaggtgaaaagatgggaaaggaagcattttagatagagcagtattagaaaaggctaacagaagtgagaacaaaggctgatggataacttatctgttttgctgaagaacagtaattataaatgtgatagtgaaataaacctggaaaagataggggccagaagattaaagaggtctatgaatgccaggcgacagggttcgggctttattctgtaagcatgggggaccattgatagtttttgagcaaggaacataattatggctgtgctttcgaagggtaactatggcaacgatgcatatgatcaattggagcagagagactggaaggaggaggacctgttaagaaaggagtccagtggtgaggttaatgtgggctgaaactgaggtcatacccttggaaatagacaagatggggccaagtgtgaggacaagaatcaatggaattcaaagaagctgggacagagaaagtgctcttggtttcctgggtctctggagtgacaatagtactgtattttcattcagtcggtgaactgtagccttgattttgctgactctaggactggtcccagaatagttcattctctgcccagaacatctcagtgggcactcatcacctcccccggagctgtagcagctgttgggctagcaatgccatgaatttgtcttcctgtactgccaggagagcagctgccagcagcaactctgaacagacccatctcagggacgtggaaactattcaacttgggatgcagcaggttggccagggctgaattcagtccacatggattcatctcacccttttccaggccactttcttaccctggctgggtttcagccactcatactgcgttaggttgggtattttcttacagttctaagtgattgcatttagggatggacgctgctgaactgctttcttcatcttttggacacctcctcccctggaagccattacgctgtcagcctttggctttgcttcctactctgctctgctcctgctcaccttttgtcctctcccacattgcgctcagtgcagatatcctcattaaagcctgtacagttctgactccatggcagcctgaccctctggttccatccctctccttctttctccttcccccagagaatgagagatgctgcagatagaactgtagcgattatttgaccctatgttattctgctttgtttaagacaggtaacatggctttccccatccctgtgaattgtgggaagaccctgctaatgtctgaaattctgtcagcctggtttgattaagagcagtggtaaagtattatgcgagggtaggaagcctttctagggaagatgttcttgcattttctttggctccttgaagagcataaatgtattcctatgcgttgctgagcctttgattgtctcttttaagtggaatctgtgttaatatggcccagcaggactctaattgataatgcattggctgtttgtttgttttttttttaaatagacttgctgtaaattacctttcagtcatagctcacttggttttgatctcctgcttttaatagctcattttttaggtagcttttttttttctgttgagtttttagagcaatacttctacatttctgtcctgctgtgttccttgcagagaccttctgctattttataacccactgtcagtatcttttcagcgtttctcccagcttctttctctcctcaacacatatttgttgactattttagaggttttgttctaaactcttagaggacagagatccaaagaaataaaaggagtagttctttcccatatgaaattataatctagtcagggagaaattaaattcaaatacaagaatacaaatcttcaacataaggctatatgtagtaagtactaagtatatgctgcagaagagatgaggctcagttgatgtagacaggaaacttcagtaaggaaatgagatttgaacaaagctttaaagaaaatggctcttgagagggaggggaagatactctaggaaaaaggggcacagctagaagaaagaacaaagcacttttgaggtacagtgagtagactggtttagctgggagaataagtggatgtggaagaagtggacaaaggtagatgggtttgtattgtggagggccttgacccttgattagggatttggctctatgcaatagacactggaaaccactgatggtttaaataagtatgaattctgattaaggaagattaacctagtggtagtttgctaaatgacaagaaacatgagaccaaggaaaccagttgctgcagtagatcataaggatctaaattaggttgggatggtaggaatgaaaagaaggggaatttatccttctgtccatttagcaaatatatatcttcttaccatgtgccagacacatgccagatacccacccctgtactcctagagcttacagtctagagacagacggaaagcacctggtgcaggaagaatctacaggaattgctgactgatgggattcaggtttcaagtgagcttggaagccataaaagaaagaggtctgtaaagtgtctttttgacttgggtgattgataaattaatggtatctttaaaagaaatagagaggggcttttttgttttttttttgttgttgttgttgttgttgttgttgttgttgttgttgtttgggtttttttttagatggagtttcgctcttgttgcccaggctggagtgcaatggcacgatctcagctcactgcatcctctgcctcccaggttcaagctattctcttgcctcagcctcccgagtagctgggattacaggcatgcgccacgacgccaggctaattttgtatttttagtagagacggggcttctccatgttggtcaggttggtcttgagctcctgacctcaggtgatccgcacaccttggcctcccaaagtgctgggattacaggcataagcctctgtgcccagctgaaatctagtgttttttaacagaagttaggagaaagaattgtttttgaaggagtaaaatatgagaaatttggttttggattttaagtttaaggtgttggaagagtattgaagctaaaatttctagtagttgacaaaatgaatggctgtatgcagggctaaagagattttttggctgttggtagagatttgcacacgtgcacagaggggatggttgaaactgtggaaatatttgtgatttccaatagtaagagtttagaagaacaaaggggaaacttcctttgtatcatctgtgatactcagattacagagtgtataaaggaatttaaatgatatatttatttgtgtatcattgagtatacattttgggaacctaattatgtatcaggaattgggtttagtactggagatagagaagaataagacaatctcctattttcactaatattaaattagcagaatatcaaggaggtagacatagaaagtaaactttcttgtttggctggttatcagttgtgtcactattggaagtgatgtgagggagcagggcctaggtatcttaagaatttggtagacattcaacctgcaatactcctttcagtgggaggttagttacacaattaattaaagaaaaattattgtagagtctgtgttctcggcttcaggcccagtatttgaatgtgcgccatctctgtagttacatcactactgcggatgggttcctcccctggagttgagttcaaagtcattcaccagtctcacaggatagcattgggttgaaaagcatagagtcagttggccatggaaaatgttatagttgtggttgcaaatcggaaaagggtggaagaccagaaggttcctcattgacttatggagtgaccttgagaaggaaagtaccaggaaacatgaagctcccgggagggaaaacccctgacttcctgggaccagtgcatcactcactcattttggacatatttgggagctgtttgttccctcaggaaagattttgcccagatgtagcatctggtgttgcaagggttggcttcccttctccatggctcaagatgcctttgttcagaaattaacagaaggttctttggtgtgttttgcatgggcccagttcatgtagaaccttaggtcattgttgagtcctttttggaggaagagttgggaggacttctcacacatgggtaaagcagaatggaagagacgcaagaaggccatttgggaatcagcaagacagggtgatccagtctttggaagagagaaagaattcagttaaaagttctttgggaagctttgtgactttgtgtgggaaaaaccagagctttgagccagaaaaacttgggtctgaatcttgtctcttctactcctagcttgtgaccttaagcaagtcacttaacccctgttagcctcaatttcttacctgtgaaatgttgacagtaatacttaccttgaaggatccttctaaggatatatataatgtatatacagcactagctaatgtttgtgacttaatggatgctcaataaatggtagctgatataattatcaggaaaagtcaatcctgatagttaagatcagccacagaagagtcagccctgatagttaagatcacaagttctgggaaccagatttcctgggttcacaatcctggatttctcccacttacttgctgtgtgattttagatgaaaggttttaatcacctcagtatcctcgtttgcaaaatgaagataatattcataactaccttatggagttgttatgctggttaagtgaattaataatatgtgaaacacttaggacagcttggcacatagtaaatgtaaatagtagcaactattatccctatcctcaggatttgggcctgagcacagctgtactgggtaaaacactggtatattagatacactagtcattccttgtgcagagttaagtattcctaagcctggctgggtaatatgtcagtttccattttcttcagacccctgtgggccctcatgaatgacaaattcatcccctaccctgatttttatggtatagctacattgggcaggacataggcaattatgtgactctgtgtaattgcatggtcagtccctataaaaactcagcaattgtatgttttgttctgtaaggtgtcatatagttcaaccttggtgggttacttttagatccaggctcataatcatgaagaggaagacatttgtcatacaaccactctctgattttctcgtcctcttggagttaatagttagccctattgccaaattgctgagtttctataaagatatactgttgagacccacaggtcccaattttgacttgggcaaataaaagaaggccagtcctattcagcctcctgcagtatctaccatcgaggccagcaggccagtgcagtacaaaccttagtcatgaacataacagtatgtggtttactgggttgtttgtctcatgaggccaaacagaagctcccaagcttctgcataaatggctttatatcttccttttagggtagggaatgataagagggcaggttagaagcaaaatatgcttttatgagcaattgggaggatgttggagactcctgagagtttcctgtgtctcctaggatttgccactggaatgtcagcaggccatacctcaggcgttcagctccatggagcaaagacagtagtgatcacgttccttgacaacagtgctagtgtgcggggagcttttagttttccttttctctgctcctgtaagccccataataattctgtagcagacacaggaagcaatgtgtctaactactactaggcaatgtgttcttgggatttttaattctcaggaattcgcagccaattaaatgaatttactttgatccagttctcttttcaaggcaaaagctgtgtcatcttattgggagctgactgtgttaagtgggaagggtttacaagataagaagaaaagacagtctctgccatacgtgtttttataattgaaatgggggaaatcgggcaggctgagagagaataataagaacacatgtgcacaggaatttaaaaatagcaccccatttaaagcaggttccagtagtcaccaggaaaagaagaaaggtggagtactcaggagggacttgtacttggttcagtcagggaaaggtaaaagatagtatagttatgttctcaattagatttgttccctggttaattgaagtaaagactttaatatctaattcctacactgcacagaagtatcacacattgaaaagaaacagtgtgacatgggaaggactcactgttaacgaaagatttagagagaatgaaaaaaaaagtaggatttgggtttttcagagttgaaataggttcatcttttctgctagctcctccttttatacatctccactgtcgttgctccttgggttttaaattcagggagaatcaatgagcacagttctgcgtcttaatatatttagggtgcagctggttaaagagccaggattagaaaatgaatcgaacaaactaggattatcttcaacagtaggatgctgagctgtgtttgctgattcctgcttaagcagtcgggacagggcatccttgcatgaaattcagacatccctccctggcagcctctgtggtaaagtagaggttgcagaacaagtctggcagctctcagcccgaacccttgtaaacaacagatgttcataactaagttctagggtgggggtaggggttattgttgatgcttgaaattctttgaatttataggcagcatctcagggatttagcaaaaggaggaagttatacagaattgatttctgcagtgtacaggtagaaatgatgcctcatggatttccttgaagacaaagcacaggctattgtgtggactctaaaacagagcaaggtgaacccaggaaggcaggcacagttaagaaagggttggcttcttacgtgtattgacttcctcccctccttctcctctctcactcctttttatacattgactggatttgtcagtcttgttcttgctcctgttttctccggtaatgggtggaaatgtgtgtcctttcttaccacagagtcctagatacatgtgcatacaaatacacagtgtattaggccattttttgtgatgctgtaaataaatacctgaggctgggtaatttctaaagaaaaaaggtttgattggctcatggttctgcaggctgtacaggaggcatggtgctggtgtctgcttctggtgaggcctcaggaagcttacaatcatggcagaaggcaccggggagccagcatgtcacatggtgagagtgggagtgagagtcgggggaggtcccagacttttgaacaaccagatctctcgtgaactaagtgagcatgaactcacttatcaccacagagatggtgctaaaccattcatgaaggatctacccccatgacgcagtcacctcccaccaggccccacctccaacatttggaatcacatttcaacatgagatttggggggggacagacatccaaaccatatcacataggaggaaaaacacacaggaagagcacacaggtgcacttcccttagtgccttctgaaggacgcaactcaggtttttatgatatactgattaacgggttattgttatgggctttgtcttggattttaacctgatactttctcagtgttggttttgctagatgttcattacttcattaaacagaggtgccgggtgcggtggctcacgcctgtaatcccagcactttgggaggccgaggcgggcggatcacgaggtcaggagatcgagaccatcctggctaatacggcgaaaccccatctctactaaaaatacaaaaaattatccgggtgtggtggcgggtgcctgtagtcccacctactcaggaggctgaggcaggagaatggtgtgaacccaggaggcggagctttcagtgagtcgagatcgcgccactgcactccagcctgggtgacagagcgagactccgtctcaaaaaaaaacaacaacaaaaaacagaggtgagtgatgagaatatggcttatgaagacttcagtgctgcctcttcttgatccccatcccctagtccccaagcacacataccaagtttccagccagatgataagtgcttaggaaaccttctactttacagcatagttcagggaagccataatagaaaaaatataatacatctttggtaggcttccttggcaccaaattgacgaagactttagaaaggttcttatcgtacatcagatgaaaaaaagcgatttaccagatctgggaatgtttttgagccactctagcaaaaaacaactggcttgaaaatctttgataaaatcgcttattcttttggaagctaagaacatctttgtacaattttttgttgttgttgttttttgttttttgagatggagtctctcactctgttgcccaggctggggtgcaatgatgccatttcggctcactgcaacctctgcctcccaggttcaagagattctcgtgcctcagcctcccaagtacctgggattacaggtgcgcaccaccatgcctggctactttttatatttttagtagagatggggtttttccacgttggccaggctggtctcgaactcctgacctcaggtgatctgcccacctcgacctcccaaactgctgggattacaggcgtgagccactgcgcccggcccatctttgtactattattccttctggaaaagaagtccacttctggctgttttgtccatttgtacgaatttggtgaacaccaatcctggtatgtgaggttcacttaatctttcagcaaacatttattgaacatttattctgtgccaagagttgtacaaggaattaaatatacatagaagaataagctaccattctagcccatgggagttattacttaatgtgaaatattttaagtttgtttatatacatttgtatgtgctctgataaggcgtagacttccaggttgaggagacagaattgttgggttatgagtcaccctgttagtcacctttattatatgtgaatcagtaataaacacttgacttcattctcatcgctaatgaccaataggttctctgcaggtttggggtcacaaagaggtgtaggatcctgttctttccctcaggaagctcatggtgtcatgtggaagacagagagtttatgggaaaaagataacacaaaataatatacacttactgccaaaggagagatgggagaaatgatttcatttttcttcagaatgcaatctgtaaacagttttaaaattttgccataatgttagacttacagaaaaattgcaggaatagcacaaagaatttttgtatactaccattttatccagattgccccaaaatgttaacatattactacatttgctttatacttcacccttttcatactcaattctcacacacatattttgtttttctgaaacacttgagagtaaattgcagacatgatgaccttttatccatacatactttagggtgtatttactaaaaataaggatgttcttttgcataatcgtagtgcagtcatcgaaatcaggacatacagattgatacaatactattatctaatcaatagacattcagattttaccagttgttctaaaaatggccttttttggcaaacgaaagtccaagattatgcaattcattcaattgtcttatctctttactttcctttaatgtgggatgatttccaagtctttatatttcaagacattgacgttggccccgttattttgtagaatatcccttaatttgatatttctggcaatttctgataatttccttattattagattcaagtcacacacttttggcaggaataccataaaatgtaatgtcacgttcttctcagtgcatcatatcaggaagcacttgctgatgatttgtgccataactgatgatgttaaatttgatcatttggttacagttgtgtctgctaggtttctccaccatgaagttgttctataagctttgtaattaatgtatatattgtggagagatactttgagaccatgtaaatatcagcttacccttcaactcttatactcactagttttagcatccattataatttcttgcttgaatcactttctattatgatggttaccaaatagtcatttttccagttttcatcattccttctacatttatcagttgcaattctactgtaaggaagagcttttccatcacccccactttttggtctggttgttggtttatatcagtgtggacttgtggattattattttattcaacaggttataatcctttaccatctttattttaatgttcatattgttctatatttggccaatggagtcccttcaagctggcttctgtgtcttattgatatgtccccatcgttctttgagcacttccttacttggtggcacaacaagatgttccaggcttaacttgtactttccttgcctttactgtggagttgaccattttttcagagagcctcggttgcttttagtgggaaatggtatttagaagccatggatgctaaatatgctctttgtaactgaagtaccattatttatagtccctttcagcagacagaggtagtagatatatgtatgtacacatagacacatacacacacacacccatgtacttctataaatagctatttctttatctgtctgtatatttatatatattaaagcctatgagatcatatcagtatctttcattccaatccaataccacatgttttatttaattttctcccctttcctgttctctgaacagtgagaaacctggttcctattatccataacacacattttcacttaattgctcagtcctagagtgtacagaaagttgtttcagaattactaacccaggctgggcgcgatggctcacacctgtaatcccagtactttgggaggccgaggcgggccgatcatgaggtcaggagatcaagaccatcctggctaacacggtgaaaccctgtctcttctaaaaaatacaaaaaaaaaaaattagccgggcatggtggcaggcgcctgtggtcccagctactggggaggctgaggcaggagaatggggtgaacctgggaggtggagcttgcagtgagccgagatcgtgccactgcactccagcctgggtgacagaccgagactccatatcaaaaaaaaaaaaaaaaaaaaaagaattactaacccatgcctctgaaaaagaagactactgactagattttaatactggtttagagttctttttgttattagccttgagggccaagacacaatgttcaaaagttagctgactagttctttctttcctatcttagtctgttttatgtcgccataacagaatacctgagtccaggtaatttataaagaaaagaagcttatttggctcacgactgtggtggcttgagagtataagaatgtggcatcagcatctgctcagctcttggtgggggccatgtgctgcctgacaacatggcggagaagctgaaaggctagggaatgagtgaaaagaaagcaaacactaggaagaagcttgctttacaacaactcactctctcaggaactaatccagtcccacaagagtgagaactcatttccatgagaatattaatcttattcatgaaggattcttcccatgacccagacaacccccagtggtccagcctctcaataccacttgcaattgcaatcaaatttcaacatgagttttggagggaacaaaccagattcaaaccatagcatccctcaatctccagaccttcaatgtagttatattatttgtttgaaatataatttggtttatttatttgtttgtatttaatgttttcctctccggaatggggtcttgacatttctcactgccaaaccttttctcttgactaaaaaagatggcgcagattcaggagaagtgagagacccatgtatccatagattaagtcagggctttagcagaagtcagtgatggggacataggccagacatgcactgagaacaaaccaaccattttcccctacttctggaccagccctgtctctaagcaagccatcttatggattgagacccttgccagtttctcctaagcctgctcctaggttctccttgccattctccctgatcacctcttttgcatttagtgaaccaagaatccagcatcagcatcagcatcagcatcagcatcagcatctgctcagctgtaggccatgattgtctgtactgtttaccagcagctcatgtaatatgcttgatgtaagaccttaggataatgttgatctggcctttcagacatgaagccccggggcactgcacattgacacccaaacttgcaaacttttacgtccttttgcgagactgtttgctagtgccctgttctgaaatccttgaaatttctcctcctggactttcttcagttacatgctttggcctctctaatagctcttttgcatcaattctgatgacctggccattttctcctgtctgtctgggaatggcttccagaatcccctttctctgccccatttaaccctcttcctccatctcccacacactcattttatttctctttcctccagacacatataacctggtcagtgctgctgattccagctgttctgaatcttgtgtacagcttaagttcaaaaacagatgggcccaaagtatcctagatgctgtgccaatttccactgcatgaaaacaaattactgaaaagcatcaggaaattttagaatagttttggggtttgattctctatcttctcaatggtccttcctccccaactcttccatttctcttcaccgtccctgtccccccattataccttgccactttccatctcttcttcatattcctcacttagcaaaggctggtttttaaaacctttattctcatttttactctttctatgtactgataggtttaaccatcaggatgggactgtgttgataatcaagctatggctgttggttgtttttctagacgtttatacccttttaaaatcttccatctaggactagggaccttatgtcctatgtccttttcatatagagaaggtaaggctggggcctctgtgtctgtgggtacatttgtaggtcaaataattcaccagcttgcaaataaagtagatattcttctattgactttatcactggggggtgcacaattgtgccagtgccattgtctgcccttgtcgggagtgagtagacactccctgtagacagggagtgtgttccttggaaagcagtgacattggacccacaccattgctttcagaatcctcattctgggaatttgccaactgctttctcccagtgttctgtaggacattgtttagctttggcattcctagtcaccctaaaaataagaggaaaacaatcatcgtagttggaccacttatcttacaggtatataaggaagacactggggtcatttacagagcatggggagaaagctgttggcatggtacagtggttattgggtgcccactgtgaacagacattgtaggaactgtcttcaagagaagcccttgagggataggcttctagaagttcaggtacatgctggatttatctatgcaaattataatgtttccccgcttccctccctccctccctccctccttctcttctttagaagagaatcctcagattctcaaaaagtatcaagcagagtcctatggatggtaactgaaagaaaaaaagaaaaaaacgattctcaaagggatctggaatacgtaattatctcccataatttaagaccattactctggagcagtgactttaaaacattttgatcatgaatctccatattttatactacaagctggaatatacttatatacacataaatagctgagaacaatactttcacagaacaatacttatgtttgctttgtgtgatgtactctgagattttctactttgttctgttattcttttttttgttgagatggggtctcactctttcacccgggctggagtgtaatggcgccatcttggctcactgcaacctctgcctcctgagctcaagtgatcctcccacctcagcctcccgagtagctaggaccacaggtgcacaccaccatgcccagctagttttttgtatttttggtagagacaaggttttaccgtgttgcccaagctggtctcaaactcctgacctcaagtgatctgcctgcctcagcctcccaaagtgctgggaatgcaggtgtgaggcactgcatccaggctacttttttctgttattctcttctactgttgcctacttaattttttgagaaatgctagttggtgacctatacgttgattttttttaaacctcactaatgggttgaatcccacagtttgtaaaacattgctttaagagcattgttttttaaattttttggtgtgcataaaattacctgacatgctgatttgaaaggcagattcctgggcatcagtccacgagttgtaatctctggcagacgagcataagaatccacattttaaacaagcattccaggtgattctgatgcaaggtgatttggggtcttgaagcctcacacttacagaaactgctctcttttgcatttatgaacctggctgttgaaggcttcagatcacatgcttggggatggtagatactagtggggatcatctgactccagactgggaatcttctcgttacaggatgaccccaatcacttaggtttacttctggatcttgataattccttgatagtcctcttttactgatgtctcttatggcccttaagaaggcagagaaggggttaactgaggccacagaatagagagagtgaaggaactgaagggtcattttacagagtgactggggtgtggcccagtcctccagtaggtgcccagagccagtccaaaattagaatggggtgggattcaaaactgcttttcctattcacttgcctttcatgtgtaaccacatgcagtgtgtcaacatgctttcaggcgccgttaggcagcagcagttttgctccctctgggttcatggacccttggtattcctgttatgtgttgtcttagaatagctctgcgctctggggctctgagcattgtccattaactctttcagcaccagccctttgagatgctaagggcttttgaatgaaatgtaataaccaccacaatgaaataagaaaacggttactagtcaggagacctggattcttgccctgctccaccactgtctgtgtgatctcaggctccctgagcctcagtttcctcactcagacaatgacaggcttggtctagactctagaccatcttgaaagtcccttctagctctgaaattccatgattctctttttgtacactctggccttttctctttgcacatgattctttcgtttaaagtctcagctacattaggcacagaagattcactgagtttgggaatttccagagaatcagatgataaattaatagcaataaaatgtattcctggccaggtgaggtggctcataattgtgagcctggcactttgggaggctgaggcgggaggattgcttgagcccaggagtttgaggctacagtgaaccatggtcatgcccgtgtactccaacctgggcaacagagcaagaccccatctctgcaaaaaaaaagtatgggccgggtgcggtggttcacacctgtaatcccagcactttgggaggccaatgtggacagatcacctgaggtcaggagttggagaccagcctgaccaacatggagaaaccctgtctctactaaaaaacacaaaattagccgagcgtggtggcacatgcctgtaatcccagctactcaggaggctgaggcaggagaatcgcttgaacccaggaggcggaggttgcggtgagccgagatcgcaccattgcactctagcctggacaacaagagtgaaactccgtctcaaaaaaaaaaaaaaaaggaagtgttcctatttagtatactaatgaagtagggaatttatgaaacaagtttattataaaaggaattttgagatgtatttgtcttttcagacatgattctagtcactttgtttcgtgggtatgaattcattgtgtgggctgttgagtaatgatagttgtcataattataagaaaagatgttgatactgatatatagttgtagaacactttcatgtttataaagtttgtttaagggcatcaccttgtttgattggatcttcacaaaagtcatgtgtgttaggcagggcaggtctgctgtccctgcttatcccatttatttatttatttattttttatttatttatttttttaaaagataaacagttattcatttttgtttaagacatcaggagtactaataaagaaccaactggtaaactgctgataattccatataatatatctagcactacaactacactgaatcatgctttttttttttttttaatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcaggatttatagtcatttgggtatatacccagtaatgggatggctgggtcaaatggtatttctagttctagatccctgaggaatcgccacactgacttccacaatggttgaactagtttacagtcccaccaacagtgtaaaagtgtttgtatttctccacatcctctccagcacctgttgtttcctgactttttaatgattgccattctaactggtgtgagatgatatctcaatagtggttttgatttgcatttctctgatggccagtgatgatgagcattttttcatgtgttttttggctgcataaatgtcttcttttgagaagtgtctgttcatgtccttcacccactttttgatggggttgtttgttttttttcttgtaaatttgtttgagttcattgtagattctggatattagccctttgtcagatgagtaggttgcaaaaattttctcccatgttgtagtttgcctgttcactctgatggtagtttcttttgctgtgcagaagctctttagttttatgagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcattatttctgagggctctgttctgttccattgatctatatctctgttttggtaccagtaccatgctgttttggttactgtagccttgtagtatagtttgaagtcaggtagtgtgatgcctccagctttgttcttttgccttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttatatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgctctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattttgatgttagggtgtcaattttggatctttcctgctttctcttgtggggatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactacgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgtgggtttaaagtctgttttatcagagactaggattgcaaccccttcctttttttgttttccatttgcttggtagatcttcctccatccttttattttcagcctatgtgtgtctctgcacgtgagaagggtttcttgaatacagcacactgatgggtcttgactctttatccatttgccagtctgtgtcttttaattggagcatttagcccatttacatttaaggttaatattgttatgtgtgaatttgatcctgtcattatgatgttagctggctattttgttcattagttgatgcagtttcttcctagcatcgatggtgtttacaattgggcatgtttttgcagtggctggtactggttgttcctttccacgtttagcacttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatttgctgttagtctgatgggcttccctttgagggtaacccgacctttctctctggctgcccttaacattttttccttcatttcaactttggtgaatctgacaattatgtgtcttggagttgctcttctcgaggagtgtctttgtggcgttctctgtatttcctgaatctgaacgttggcctgccttgctagattggggaagttctcctggataatatcctgcagagtgttttccaacttggttccattctccgcctcactttcaggtacaccaatcagacgtagatttggtcttttcacatagtcccatatttattggaggctttgctcatttctttttattctttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagttttcaacttctttgcctttggtttgaatgtgctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgaggttttctctacttttggtctttgatgatggtgatgtacagatgggttttcggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctcagatggaaatgcagaaatcacccgtcttctgtgtcgctcacgctggagctgtagaccggagctgttcctattcggccatcttggctcctcccccctacactgaatcatttattttgagccagggcttgaagcagacaatccaagcatccttctaaactatcctcagtcttgtcaacagctgttatcttcagcttcttcaaggtatcactgagattatccatgttgctccccgagggtgaggaaccggcggggcgaggcgaaggtctctggtgcaggcggcgcggctctgtgtcctccctctacctccgtctctatttatttattttttaagagacaggtcctatgttacccaggctggtcatttacaggcacaatcattgtgcactatggcctcaagctcctgggctcaagcgatcttcccacctcagcttcccgagtagccaggagtacaggcacgtgtcaccatacctggcttccatttactttttaaaacaggtgaagagattttgagacccagaatgcatttgtgacttgcccaaagttacctggctagtaagtggcagagctaagcctagactctgtgtcttaagcatagttcaaggcgctttccacagagtgtagatggagtttcacattgttcatccagattccttaaggacctgaactcgctaatttgatctactaacctggaaattgactagggcttctcttataccactcagccctttaaagttttgccagtaaagtatcaacatggttaataatatgctgtaatttagagtacacaagccaatggacatacaaatttggtcattcagtagccacccagagagtgagcacagatacacactggagcagctgatttggcaagattggtggaggctgaacatattaactagtcattaaatgaatcatggtctttctgtcctcaacatttacaggattgctttggctctggcatctgttgttagtcaatactgattaaggacccacctattcttggtgataggtgttcattaaacattctaaatataccctgtcctcaagagaattccttactgggcctgggggttgttcctcctgcacccccacacaaaaagagacttccttctaataaaggcaagataaatatccaaataacacatgagaactgataatgacacatgcagccaatctgatgactgtgtagacttcattccatttagatctatagtttcacagaatcaagaattttattttttttccctccttttcattgttgttatgagccatgtaaggggactcattgtcccagggacgggtgtttgggagggggagatctttatggataccctttcttctcagtggcttattgctatttggcatactacagtacaatttgctagccaggaggagtttctggctgtagatcaaacttctccgctcatgcctggtgccagagagatgcttgctcttaagggggtggttactgctttgataagtgtgtggatttctgagtgacgtcattccactttggcacagacaggtatttatttctctagaatgaactaccaggggtgagccagactgtctgcctcagtcatttcccaaggtttcatttattttaaaaatctgctaacacatctgtgtgtatttttttttctctgtatgtttgtcatgtgctataattacttatagggcttctggtgacatcttaattaactagagaagaaaaaatcaaagatataattgtagagttgttcacaggtttttctatggactttgtggatccaactgtcaacatgatattgatggttacgaattctttttaagctgagaaacgtataaattttatgttcctcggtcattgatcacacctttgttctgtcttttacccttgctatggtgttttagtttaactgagtgaatgagtcagctcaggcctttgatgtgatcacagcctattttggggggctttcagggagcatatttaatacctaagtgcatttctaggcccttagttctatggattatattggggtggcattgtagcatgtagattgtaccaagagggtttaacagcctctttattcattcctccctatagttctgggaatgctagtgctaacacatgggatgtaaacaaagggaaggtcccaggtctacagaagctatagagagagctggtgggcaggcagattttctaagtcagccaaatcagggttttgcagtgggttcatccaagccaatgtacacacaagccacaagaccaggataagatgtgggttgtggctgatgcacagtttaggagcaggaaagccatgtcttggatccaggaagtctgcaaacatgggagaagcaggtcagaaaaaagaatgttgatccttttattcctagaatagtggctagcccataataggaggctcaattaatatttgttaaatgaatgaatgaaataagaagacatcagggactcagagaaggagcctggacaataagatatcagaaactaggcaagaaatgtggatggcagagattcaaatcttgtgtagacccccgtgtctggtcttatgggatccatagatctatcttaagagatatgaagaccctccatttgcctcctttctgctgtgagcaccgtgccataggggtggttgaaaggaaggcagaatctctcacttaacataaattgatggagacatttccagttagtgtctacgatagcttaaatttgggggccattcctagttctctgacctaacccacaagaaccttggtcctataatcattcaggaaatcgtgattaagcacttaatagatgtcagacatggtgctagtccagttctctacttcaaagcagattcctaaggtccggctcttgggcatgctgttctctcaagggtgtggttctgctccatggaactaatccagagccacaagaatcttattttcatacagtccttcccccaaacctgattataggggacaatttaggctattttgagaaggtgggtctaccactgcttgaatcctttctaatcatctgtctaggctaccgaagacaatttgtggtactcacttgtccctgaaaatttgaaagttcatttctccatatgtagactatattatttttgcctttggcacttttctctgtctctgaactctcctcctctgatctcattgctggcaacgctgaagccaaagctgtgataagcccagagaagtgtgcccgccccctgcctgcccgtctgtctttgaaagataccttcaggctgccgctgtactactgggtcacaaaaccagcatccaccattacaggcagaatcgttttcaagtcatttcctaccttggtgatttttaccccctccttcttttaacaccttccccagcaaatccaatccatcctctggcttatctgggtcagcaagggtctgattttatgcatgacactgtcagaccataaatccactgcagctttgcctctctatccagcctgcctgcttctgtcagcatcagcaaaatgcataatagagaaaataagccagaaaggctaataacactcatctgaataaaataatctctttggctgcctcagttcatttcattttaatcaaggtgccaggagggaatttaggttaaaaaatccaacctccttcttgtcacaagttccctgtccaaccatcacttaaatgattccttttatcatgcatgtacctttttttattcaccacatacttgtatgttcaataacatatattgaatgatgtatttaactctttaagttttgtctatcatcacagataggtctgtttttaaaagcgagaaattatattctgcttagatgtattgatagttgccatctctctatgcagattggcaggtttgataggaattctgagacaggggatgggagcttagtataagttgctgaagcatctagggtttgggcaatctgtgctccctttggattcctttctgtcaacctcagcacacagttcccagtgtggaatgcaggactgattgttctaccttgtcccttagggaaaggacagtgggagattaaaatctgctctcctgttggtatctctctcacgtcttcccagagccttacggctgctttgttaattgcctgttgctgctgtcttactcaaaccattatttgctgaaggctgtgcattttcagcaggcagcaatcttggccctggcccagagccgggtgagaagcatgttggaaattgatgaaagctgagtcctagtttgtttggaaataaaaataataatatttcttcacatttgtatagtgctgaactattggcatagttcttttgcatccatcatttcatttgatccacacaacagccctgagaggtgagcaacttagagactattggcccaaaaggaaacacacctcgttatagcaatgcagaagctcaagctatattccagcaatgccagcctcatgccatgcattccatctgcacagccatgaacgtagcaattattaattaaatggcaccttaggtcaggagagcgtctaggattttacagccatactttgaagatctttgaggagtgagatgtataccaatagggcacgtgtccattttatagatgagatgataaaaaccaaacagaggtgatatggaaaagaaccataatagagaggccaacttggacctttatagacttggctcttcaccatggatattttagagaaatccctttaagcgcttgttgctaagtttgttgaacgtccataaatagtccaagttgagggagaaaagctgggctaatgtcttcgaagctaatgattcagctatgcaggtttatctctttcagtgcatttacagtgataatgtctcctgcagatgtacaggcagcatgtgactttccgggtctcctttcgactccagagtcattccctctcaggtatagtatgatgttttcttgatcttcctcctgaaaaacattttaagtaagaaaaatactcctaggtattttgtctgctttttagggattagtgtttgaggaggtttgcagctgctcagcacattcctaagggatgcagaccctttcctttaaaggcccaagtattatacaacctaaggctctgggggtggggaaagtaaagagactgtgcaaacaaatgatagatggaaaagatataaagacaaatttcaatctcctaaccaaacgaagttcccttggcttcagcggtcccaaataaaatgaggctgcaaagcttctggagcaggaaaccactctagcagagccttaatatgctccctatgaaatcacgtctcgttgccgtgcttattttccagcctgaagtgtgtttcatctttgttcgtgttggctgggaaaattgtctgtatatttgtgatcccctcctcccactttctctctaccttacttgctctaccactacccaaaaataaataaatgaattaattgaaacacctcagttgaaaggaagaatatgtctgagaaagcttacagactcaaaggaccagaaatattgtgtgaaaagctgcattaatagtaggagaggctgagaactcctggaagaaacagccaacaggatctagtgctggttttttaagcatagactccttttttaaaataaaaatcttgcatagagcctcaatatatgaaacagatcaaagcagtatttttattggtataaatctgcttttaaagtacaaatttatagagtacttattatactgtcagtcaatgagaacaatgaggctgtttttatgaactaaaaatattgagatcaggattatgaatcagttatagttttatattcatttcagcatctggttttggtttaggtagtccaatatcaagaaaattctgattagcatagataagttattgtaatcttgagctttaaattgatttagatggaaaaaagaagatatttttgttttaaagttgagtcactatcatcacctagcagctattccccttcataaatattaattggataagccccaacatgtataataggcatcgcaacaactgatgatgagatggtatgatattaagcatgttgattttcgctacccaaccacggtctcacatgaacccagcctaggcccttgagccttctatggcatgtgattgaaccttgctgctgtgtgtcaagttataggctcacctgtacagctttattggaggaggcacacacaggcttgaatgaaaaaataaacctatgcaaagctacatgtattctaattaatagcatattgttcagaagttccaaggcatacagtgattctttcttccagggtttacataaaacaatgctagcagcctgcgagacattgcagtggtatctaatgcagggaaactgggtcctgggtctcttgctcatgtcagtgagggttgctcatttgaatggatgtgtcaccgttttttaaattgaaatgtgattttctgctaattccagagtatctcagaacacagtttaaaagctcctgctctctgaaaccaatactaatactgtaactatcgcacaaaatgctgtaaggatggaaataaatacatgtgaaaagtacttatagcaccttgcaagttcttttttcttttttttcttttgttttgagatggagtcttgctctcacccaggctggagtgcagtggcatgatctcagctcactgcaacctctgcctccggggttcaagtgattctcctgcctcagcctcccaagtagctgggattacaggtgtgcaccatccacactgaggtaattttgtatttttagtagagatggggttttgccatgctggccaggctggtcttgaactcttggtctcaagtgatccacctgccttggcctcccaaagtgctgggattgcaggcgtgagccacaccttacaagttctcaataaaacttattagcattaagtggtaaggcattttattttaaaagatttctacttccagccatcctgtttattgacccatctttgttcagtcatcttttcttttgaggacaccttggggatatgtgctctgcatcctttcccatggtgttaggttgattttgcctcctctgcttcctcttttgatctgcggtctacctttctgagctagctggccttttgtttgtaccaccattaaagttctactttactataggtctttctttgtctcccttactatattgcagcatttgcacttttataaccactaaagcacctaacaccatgccttgttcatttaagatacaaatgtgtgtacatttgtggaattgaattgtggcattatttgtgtgtatgtaaagtgctatagggaaagaaccagtatagatcccccccaatccatcttcttccttaagaaatagattgaaaccaattgtcaatgtaaagtctcatgagatctgcccctttaaaaagcatgcttactgaggacatgggtatcttgccgagagacaccacttgattaaaatgtaaattaggttatttagaattttgtaactgaaatctaattggaatcattttgaaagttttcttgcaatggagacatcagatgctatggaatgcatgtgttcaaatatcttaccattttgaatttaggattgtttccagttcacttttttttccccagatactaaacattttgaaaggagtaaattaattatgtgtctctcttcctctcagctggtatatttttgatttccatagaaatctttcagtttccctaaaaaggtaagtgttgtcacagtgattggcacgcttaagagttagtgattttggctacagaagagtgatgcctggggcagggggtgagtggtacccggatacaggtttagaacagtttcaatttggactctaatattaattggtttgaagtaacttcttggttgggttagacagatatttgatttgtctgatgtgttctgaagtccaagtaagtatggcatgattatttgttaatagttactactatagaattggaaaagccttctaagttgaacttcatggtttacaaatcacaagtgcctggtctttagtgctgaatggaggcagtactgactcaataaccaagctactctcaactcactttccttgtagtaggagtctgactggagcggagaagagaggaaagggggaaagaaacagatagttattatttgcagtgaatgagagtactcgctttgcagttataggcttggtttgaattctggaattgccactttttagctatatgaccttgggcaaagtgtttaaaaatttttagtctacttttcctcatcttccaaatgtggttaataacacccacctcatcaggtagttgtggggtttaagtcaaacaacatgtataaagggcccagatatgtgtacagtatcccttgataaatagtactgcaaattattcctacttttgtttctctccttaaagaaatccaacttccaaatgtagaactttctgttgcttaagttaatgctgagttggtaatcaataattcttttggatcacaatgttttcattagaaatgagcatctagggccgggcgcggtggctcactcctataatcccagcactttgggaggccaaggtgggtggatcacttgaggtcgggagttcaagatcagcatggtcaacatggtgaaaacccatctctactaaaaatacaaaagttagctgggcgtggtggcaggtgcctataatcccagctactagggaggctgaggcaggagaatctcttgaaagcgggaggcggaggttgcagtgagccaagattgtgccactgtactccagcctgggtgacagagtgagactttgtctcaaaaaaaaaaaaaaaaaaaaaaaaaagggaatgagcaccttggtttagcactttactgctccactcaagctgtagacattttaggaacacatgttcaggtatggtttgtgttcttgattgtatgggacatgagatcatggctcaataaatgaaatcaaaacttccttagatgtgttctgtggaactccagagttttcagtaacattttaatggcatatgtctccaaatttgcctttattaaatcctacaatggatacatttgtggggattttgtagtgctgtagtgatttttgtgtctagacaaaatctctaactttggtttctaaccctagggacaaaccaaatgacttagtggctaaaatgatggacttcagaatcaccttagacctggtctagccagacaatgcagaactgttgttctagtccctggcgccctcttacttgttgtgttagtcttactcgctgtagacaagtgacaacctctctgagcttcagttttctaatcagttgaagggggataatggtagttctttccttaaaatgaaatgatagagcttagatgagatgagataatacgtataaagcattcaccaagttcttagaacatagtaggtgcctaacagataatcctgtttctccttgtacatcccctcttccctccctctccttcttgtccttattttctccttttttctccactgagtttttagaaaaggagaaaactagagaggtgagcttcaggaaaaatatctttatttctggattggctttgattgctgtgattttaggacacggactatagttgtagatgttgccctggctgcgtatcaacaatgacttcttttccttgatgtttcttcacaggaaggatcagaatgttctctctccagtcaactgctggaatctcctcttaaaccaggtgaagcgggaaagcagggaccataccaccctgagtgacatctacctgaataatatcattcctcgatttgtacaagtcagcgaggactcaggaagactctttaaaaaggtacagagatatttcttcacagaggttcttgggtggagcaatgacacaatttttaaaatcctattagatattatgttgattacctgggtgacaaaattatctgtacaccagacccccatgacatgcaatttacccatgtaacaaacttgcacatataccccccttgaacctaaaataaaagttggaaagaaaaaataaaagaaagaatatcttattggcccacttcataggctttccactagtcattccctaccacatacttgtggagaaaaaaattatttgaattggcattcctttcttcctttctgagctgaattaatagtagccttgggaaaggaaccatttgcaaggtataaacccagggctggtactataattcataatctgcatctattaacaaaaactgtgttttgggaagttttcttaaagtgatttttgaagctgttgagcttaaggggccaacactgtcattttatgttttcctattctagttcatttagcaaactcatatacgtttatgtttttagtttagttttcttcccagggtcttatcttggccaaggtagactcaaaagtgtggttattcttatcgtggtatgtctttgtctttgggtctctgaatgctttcggaactcaattgttatcgtacttccttgggtataggttgaacaatttgacaaaggaaaactcaaaataatcatgataatcttaaggacccaattcaccttacctgtcaacgatggaaccagcctcttgaaaatccaggaagctcttttctaagctgtctcagcttgagctcaaagtggaatcatttattcatgaggttgggttacagacagcggtgaaggccccaaccattgtatatgatatgtcatgtctaccattcaagcattgacatccccggaagactttccagaaggcaaataatcttcctaaaagttataggtagaaaaagattatagagggctatttagaattcatcagtttccaggtgacaaaatccattattaaaatttgaaagtatgagagaaaagactggtaaacaggactgtagtcgatacagtcaaagctcttgatcagctttccagttctcaggaatttttccagatttcactagatctggaattaataccccattttttttctgtaattaccagcctgatcaaataactgatttggaatcttccatctacctaattgcatccgtgaaggtgctttccctgtgtcttagagacagaatattgagggtacaatcatctgacgacgaaaagaaggcagagaaagataactcctcccagagctcactggctattattagtagcccggctgtgctgtggttggggccacacctcattttggagtgagggtacttctcaccatctcctccatggtttccagcatcagcttcagcttggttgtcattaatttgaattattctgcaatacttggtgatgcatgtgtgtgactaaaattaaaacctatttaggtgaaattttgacagctcgtctctatgaccttgacagccacttagactatctcaagaaggaaagggcttgactgatagtttcctcctccgttttctttgttcatccgagaaaacaacttttataagatctgttcacctagctagacttcactcagtctctcagctccctttttaccaagccttagaaggttagagaaaaaccaggctagataatttaatagcctctccagatctcagagatgcttatactgaaggcagccagatagcaaagtcacgagtgttcctggctcttcaagtgccctatgcatatttcaccaaaggtaggtacatggcatgtatacaaggtgtggggcatatgacatccatgaagaaaattcgtctgtgaatgatattcctagccatgggctcagggttgacttccttaagccgtgtattactatgctagagcgtgaggaagaacttatttctcataggactgtttatatattacatttcactgaagaaaagtatgcctattataatttaatagctatatgcattttcacaaactgaattcacacttgtgtaaccagcacccagatcaagaaacagaacatttctgtaccctagaaaccccctcatattcccttctagtcatctccccaccctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcataggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctggacaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgctctccagcctgggcaacagaatgagaccctgatagtttgaggatgcagtgagctgtaatcatgccactgcactccagcctgggcaacagagagagaccctgatggtttgaggatgcagtgagctgtaatcatgccactgcactccagcctgggcaacagagggagaccctgactcctaaaaaaaaaaaaattgattcattctcttttggctgggtaaagagcctctctgctttctagtaatgggcaaacaaacattcttcataccacaccccagttttttaacctcttttgtttagagtgtccttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattttaatcccacagataaggacaaacaaaagtggatataggtgtggagagggctagcttaagcaaatgaagaccagatttcttgaagaatgaaggattatttcaggtgctgatatctacaatgtcagcaataaagaaataccaaattgggatccaaatacataaaatagatatgttttaccagtaaatttggttccagtggcaaaaggacccatttctctggggacataggcttagaaaagataccttaatttgtggtatggctgtacacacctgtgctttatgtgaatttgggtctgtttgtcactagcaaaagtcaacatttttaaaaatctttttttaatctataaaacttaatgattcactgcaaaaattatgataatagaagtcattatattttgaacctctatgtgccaggtatcgtgttaagcactttatatgtattatctcctttaatccttaccgtaattttataaagtagttactattgtcatcatcgctgttttatgaaggaagaaactatggcttaaagagattaagcaggccaggcacagtggctcaagcctgtaatcccagccctttgggaggttgaggtgggaggatcgcttgaagcaaggagttcaagaccagcctgggcaacatagcaagactctgtctctacctccctcccccacttaaaaaaaattagctaggcatggtggtacacacctgtaggcctagctacccaggaggctgagacgggaaggatcacttgagcccagaaatttgaggctgcagtgatctataatcatgccactgtactctagcctgagtaacagagccagaccctgtctgtttaaaaaaaaaaaacaaaaaacaaaaaacaaaaaacaaaacagagggctgggagcggtggctcacgcctgtaatcgcagcgctttgggaggccaaggtgggcagatcacctgaggtcaggagttcaagaccagcttggccaacatggtgaaaccccgtctctacaaaaacacaaaaattagccaggcaagatggccagtgcctgtaatcccagctactcaagagattgaagcaggagaatctcttgaacccgggaagtggaggttgcagtgagcacagatcatgctgttgcacttcagtctaggcaacagagcaagacttcgtctcagaaaaaaagaagagagagagagagattaagaaaaacgaaatgaagctaacgtttaactccagtcacctggctctagaatccaacattttcatctacatactgtattaggattctctaagtatgttgtacagagaagagaaaatcctggattttctctgtttcattgaattcagatatttcacttagttatagaattaacctaatttttcttttgcacataaaccttcaaagggtatggagatgttgaacatcaacattggattgtttttcctacctggggttggggcaagcagctggaagttgggaatgaaatagggcagcatgtttacactcctcaggggcaaaatatctctgccccctgtaagagggaaacaaggactcattaaatgtgagaattggccccaaatctggctcacagctaatttagctaatttagggatgtcagggtggctgcacaattggcccctctatgctattgaacccccttaagggaggctccttgctagccctctggtttgtggtaatgtctgctgggacatattttacattttgcatgaagccatgttggagattcctttagctaaatataacatctggagaaagtagcctcctgttcacagcttaaaaacagactgactttgtctaggacgagagggaaaattgagcccgtttggtgctcctgacatctcctttcatgtaatgaaagctcagtctgtctaacctctgttggaaccagggtttgggcaaatattattgctgccaccttcatttgtttaatgcggtggcttcaaaaaccatgggcaaaaactgccaagtttgactcccatctccctgtggtctccatgaggggcatgttctaaagaagcccaccaagaacagaaataatttttcccacttgcttagtttaaactgaaataaacttgggtgtgctttttcctacaggagagaggataatcctgttttctctttttacttagctggaacacactaaaagtacctctgactttgctttctcaaatcactgtttctagcccttcacagctgctcacacttaagcttggaagctggtcagttcagacagtgctaaggctcagttgcatccttgtttttacagcactgcagtgaactgtactcctgttttgctgttaggactcttaagtttctatggcaaaaatttaggttaaattgaaaaagccaagtcagattccctatagaccagtagctttcaactttgcctgggcatgaaagttacttggggagttttaaaaaaatctttgtgaccttgaataaacaaaggtttcttagaatataaaaagcatgaaccataaaattttataaaggataagtcagacttcatcaagtcttggacttttgttcctagaaagactttatttacaaaatgaaagacaagacgcagactgggagaaaatatttgtaatatgtatctgacatggacttatatcagattatagaataaagaactctgagaactcagtaataagacaaactacccaaatttttaaaaatggaaacaggttttaataaacatttcactaataaaaatatacaaatggctaatcaacacatgaaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatgacattaaatttgtacttgtcatatgacccagtaattccaggtatttataggcatctacccaagagaaataaaagcatatgtctaaacaaagacttgcacctgaatattcataaagcttttgtgataggctgagtaatgcctccctcaaaaaaaaaaaaaaaaaaaaagaggtccatattctaacctttggaacctgtgaatgttaccttatgcatgtaatactttgcagatatgactaatttaaggatcttgtgatggggatattatgcttaattagctgggtgggctgtaaatgcaatcacaagtgtcctcataagaaggagattacagataaaagagaggaaggtcatgtgatagaagcagagggaaacagagtcatagagagaggatgctatgccactggctttgaatatggaggaagtggccatgagccagtgaatacagctctagatgctggaaaaggcaaggaaacggattcttcctgagagcctccggagcagaagcagccctgctgactcactggtttcagcccagtgaaattggttttggagttctgacctccagaactctaagagaacaaatgtatgttgttttaagccaccatgtttgcagtaatttgttacagctgccttaggtactttattcataatagcccaaactggaaacaacccaaatgtccatcaacagatgagtggaaaaacatattgtagtgtatccatatatcaatactactcagcaataagaagggaaatgctgatacaatataaatgagctcaaaaaacattatgctgataaaaagaagccaagcacaatgagtacattctgtatgattctgtttctataaaattttagaaaaaacaaatctgatctatagtgatagagaatagatcattgattgccttggggccaggatggggatgaaggattgactgctaagggacacaagggagtttgtagggtttttatagcctacattatataacattttaaacaatgctttataacatttttataatgttacataatcttgaccatggtggtacattagacagactttatcatattatacacttaaaatgtgtacattttattatgtaaattatgcctcaataaagttgatctaatttaaaaaatacccatgccaagaccctaccccagcatgatttagtcagaatctctggagtagggcctgggtgattgttgcctacagctagggctgagaatcactgctgcactgttttccatcttggggaaactgcagagcacagagaatatctgatgccccaagatcctgtctatctgtatgtgagccatgtttgcctctgcaacagacagtgttaaagcatctaggctagtttctctaggcaacccattgtggtttcctactttattcttggagggtgatgaagggtgaagttagcttcagataaataaatctggtgacaaagggtgaatctggcttccttcacactgcaggaagtggggaatgcaagaagagtgctgaggaaggaatgtaagaggctcagttaatacttttctccagggtcttggagatgttaaacgtgtccttttgccattagtgaatcagtcacaagagaattgccacaacagtcagatttcttttggcactaaggaaatgaatctggtagttaaaaaggataaatgagatttaaaactaaaagcagtgcatgttacctatctgtttggtatccgtttggactgagataggatttcctatggcgtgtcttgagtccagctgtttggcatgtgtgagaagagtggatgatgaaactgtgagaaggcattttgggtggtgtgatggtcataaataagaagaggagaagtggtgacccacaatgctggtatagttgaatgtccctggtaagtgctgtggattgaatgaatggaggaaaagaatggttttccaaaggttgtgtccctgtgctctgcccccttaagaaagggtttaactctttgggagaaggagtagatgagtgatttaaccctccctcccttccccgtctaccatatccctcctgctcgtctgaactcagtatctgtgattggactgaatttcctccacattatagcatggtcactaacagcgtttgcacagtgctttacagacagctgttccagttgcccagtttatcttgttggtagcaaaaatctgttctaattaattgagctttattctctcatatctgatgaaaagatcctctttggagaaaagaatagaatgtgaagctgagcttatttgagtaggggatggaaggctgccagctacttcaaaggtatctctgctgataaggggcgtcaggtttgctgccaaagccaacaccgaggggagctttgcagctcgtgctgttgggggtgttttagctttggtttctgtgacactgggtcagcagcatctgtgtgctctcccttgaggctgctctctgggtggtccaggcttttatttagacttaggaaggtgcagctcaaagggaatgtgtgcatcaaagatgtctgtagtcttttgcttaggttagtttgtgtgtttgcctttttggtgttttagttcttaggtatctgccttttctaaaagagctcaaggtgctatatttagaactttcaaaagtataatagtacttcgatttgtataaatcaaaggattattaagggaatctgaagacgaggaatggaatatgggaaatggaatatgggaaagagaggtgcagtagacaaaaaataaaagtgtccatatgcaaccttgtattggaatactaccctaaattaggagattatacagtcaataagtattttagtgaatactgcatgcacagcattatgctgctaggtgcttaaaagagcttgaaaatcaaattgaggagtaagatttgcctcccaagggagcttggggtttttggtttatttaggtctctcaaaactttctgtgggatgattatgatgacaaagtaataatagtaacctttcgtaaaattcacactgtgaatacctcccactgtagtaggccctagatgtgtattttctctgaacctttcatctatttttgcaaagtttttttcctaaactatttatgaaagtataaaatacttagagaaagtacacatattataaagtgtacagctcaatgaatttttacaaactgaatacagctatgtaatcagcacccagatgaagaaagaatgttactagtatcccatgaaccctccttctctccacttcaagtcattactctctgaagggtaaccattatcctgacttctaacacaatataagtatttgcccatttaaaaatttgtttgtgtaaatggaatcagataatttttttcaacaacttgaatatgtaattcacttgccttctggcctccattatttctgatgagaaatcagctgtggttcttaggttcttattattgcttacttgtatgtaatatatcatctttttgtttgtttgtttgtttgtttgtttgtttgttttaaagagatggagtctctgtcccccaggctggagtcctgttgcatgattacagctcactgtagactcaaacttctgtgctcaagcaatcccagtccttccatcttggcctcccaaagtggtgggattacaggcgtgagctgccatgcccagcccttctttatttggctgcttccaatatttattcattatctttggtttttagttctttgattatcataagagtgtaagcgtggttttcattgtattcctttggcttggttaaatataatatccagacaatccctgatctgtcaaatatctaatttgtagaaattgtaggaaaaatatcaaatttttcctcaatttgagaaaaatttttggcaaatatttttttctgtcccatctctccttcctgttttgctttgttatcaattgcatgtatgttagactacttgattcagtcccacagcttgttaatgttctgtccatttttttcaaatttttgttttctgtatgctttagtttagatgatttctaaagtttaccaatttggctgggcatggtggctcacacctgtaatcccagcactttgggaggccaaggtgggtggatcacttgaggtcaagagtttgagaccagcctggccaacatggtgaaaccccgtctctactaaaaatacaaaaattagctgggcatggtggtacatgcctgtaatcccagctgctcaggaggccgaggcaggagaatcacttgaacccggaaggtggagtttgcaggaggctgaggcaggagaatcacttgaacccggaaggtggagtttgcagtgagctgagattgtgccactgcactccagcctgggagacagagcaagactccatctcaaaaaataaataaataaataaataaataaataaataaataaataaataaaacaaccaattctttcttttgttcacctaagatgctataaatgccatccaatgaattttttttatttcagatttttttttttttttttttttttttttgagatggagactcactttgtcacccaggttggagtacagtggtgtgatcatagctcaccctaccctcagactcctgggctcaagtgatcctcccacctcagcttctcatgtgtctgatactacaggtgtgtaccatcatgcttggctaatttttttagagatggggtctcgctgtggtgcccaggctaggcttgaactctggggctcaaatgatccttccccttcagcctccaaattattgtatggatatttttaaaacatagttggcaattacttaaaaattcttgtttgctatttttaacattgacattatctgtgggtctgtttattgattttcctcttgacttttttttacatgcctactaatcttttattgcatattggacatcatagataatatgtcatagaaactctagatgtacttatcttcctctgaagattatgaagttttattctaggaggctattaaattactggttgatcaccttgatcttgtgggggcttggctttatacttcattacagtgggtatattttggttttgcccttcgtcttagaaaatactgtatacttaaggcatggcctttctggggtttccatgggaaacccaagatgtttatcaagcccctctaacttggcaggctttgaatgccaaattctatcttccttacagtgggcagcacctaagacgaccaactatcctgtttgccttgggctgagggggttcctaggacatgagacttttagttttatctgttcaactgttgatggcatttggatagttttcagtttgaggctattatgtatgttataaataatgctgctatgaacattataatgggaagttattctttccagtgtatggttgaacctggtcacaagccaggctttaagaatagtgaattcaaaaccttttctctctctttctctctctctctccttctctccctcctctgtctctctccctcccccccttccttctcccctctgccttctcttccctctcctttctctcttccttttcctctttccttctccctctccttgtttcctccctcccttccttttctctattcttttgaataatcttttaaattttatagtagatgtatgttatagaaaatttaaaaatacagaaagcaaaaatatgatataaaaaacagatttattgtacatactattttgtaatctactgttttagtcaagaccttctcctttacatttcaataaacttttgtctcatctaatacccaggccatgtaaagatttaattaattactcaaaaaatctctttgacaactagtttgtccaagccagtatctaatgcacacagttttatgtcccttaagtgtactttaatctagtattattttctttccatgaaactgatttgttgaagagaccaagccagatgtcctgcaaaatctcccatcttctagatttgtctggttgtttacttgtgttgttaagcttctgcccgtatcccatatttcctgtaaattggaagttggttctaaaggtccaagtggattcaagtgacttagaatgcataataagtgatgttagtacttcatgtagcatcagagcaggaaatacataacatctagttagtctaccgatagtgatgctaatattggcaccctctagaatagggctgtgatagtctgacccttccattttctagttacattttttaaatcacatgatagaaacctgattgtaaggtgttattcatggtgccagcctacaaatattgggtgccagttcagtcattcatctgataattttagtatcagttgataattttagacaagttactttttgtcatctctgtacctctcttacttgactataagatgcctctctgaggctgggcacagtggcttatgtctgtaatcccagcactttgggaggtggaggcaggtggatcacctgaggtcaggagtttgagaccagcctgaccaacatgctgaaaccctgtctctactaaaaatacagaaattagccaggcgtcgtggtgtattcctgtaatctcagctactcaggaggcttagggaggagaatcacttgaacctgggaggcagaggttgcagtgagccaagattgtgccattgcactccagcatgggtgacagagcaaaactccgactcaaaaaataaataaataaataaataaaataaaaatgcctctctgagaaaaggagaggattgttaatacagctcatcaggcaccatgcaaatagtagtttgtaaaaacgtattagtcttgggagaaaccacacacacgaatagtgtgcaagctgacaaggtgtcaatttgttattattaagaatcacagcaataatttttttaaaaaaagcataattctaaatgaatgctaaccatgcctagggactgtgctaggtgttttacatgtattaacctatttaatctcatcacaacgacactttgagatgagtactggttttatcatccccatttgtagataagagcatgggcaaagggtttaagcaatttactgaagattatacagctggttgatgggagaaatgggattcaagcctaggcagttggcttcccctgatctcttcacatcatcatgctctgctgccttgcatgtaggaaggtggcagtcatattggtaagctaaagaaccagtgcttgtgcagggaattaatgactcatgcattctgcagtcatacgttgctgtgcttctgtcaggtcagaatttccattgtgctattctgattctgcttcttgcccagcttgtccagagagagagtaacacctttgactttagcctcccttgttgcaggacaggcttctgttgactcccctatttatctttgtcaagacttttcctttgaattcctccctgcttgtctgagcatgatttttatttaaagtgaggacaaaatttaagttttcctccttttgacacagcgtcttcagttttttttcattttcatcttctttccttacaatactggactttctctggtcttttagtttttctactagatcctacctttctttgcttttaagcccagcccttggggttttttgttttgttttctttttctttttttcctttttctctgttctctacaaatcatttgggtctacatccagcttctcccagcatttactcaatatgaaacttccagttatagattaatttgaattctttgcactaattgtttaaaagaccataggaacctcagaccatccctcttcatggtctcaagagctcccagaatcatcctcttggtaagctaagtagttattagtaaggcccagggacaggactgagaagtaacatcttctattttttatttcagttttcctttaatttggaagcaaacaaacaaaaaacccttcagcttagggttttttcaattgttaaagtaatactgagcttcagttaaggctatgaaagaaaagaaaaaattttaaaaagtagtaacgtgtttttttcaagatattgtgggtaaaaacataataaaaagaaaataataattacttggaatcatgattaacattttgatgtatttccttccaatcttttttatacacattttttttaaaaatgagagttacattatatattaagcttagtgtaatttttttcatttaacatttggagaagcatttttatcatgtcattgcatcttcttttaaatgttgcctatatgatcatacagcagtctgtagtctggctgtcccatagctttttcatatattccttatggttctttggctatgttgtctttttttttttttttttttggagatggagtttctttttttcaggctggagtacagtggcgtgatcttggctcactgcaacctccgcctcccgggttcaagtgattctcgtgcctcagcctcccgagtagccgggattacaggcgtgggctaccacatccagctaagttttttgtgtttttttagtagaggtggggtttcaccatgttggccagactggtcttgaactcctgaactcaagtgatctgcctgccttggcctcccaaagtgctgggatttcaggcgtgagccaccacgaccagctggctgttgtcttgactctcccctggactatgttcttgtacatctagaagcaattaaaaatctcgttgtctttttggaaatcacttgtttttaggatgactaggtagccaaggctttcatttggaaataccctacttccatttaatataaggtaaggagagagggtttttccccctgctgctttccctttttcttcctcttctgtcttgctcattgtcttagagcttagttgagaatcagtgctacgcctgagcctgggccctggctggctcagtggagttctttcaccatgctgagtttcactttcctcatctttacactaatgaaattactcataccctcactgttccttctcagaatgctataggcatcagtaaaacctgggaacaaagtgctctgcaaagttatgttatggtcagaaggtatctggttgtgttcatgcagaagagcgtgtgtcttgtgccttcgcccagctagggtggtctttgcaatctctaagctaatctttttttagcggtatattatcatataggctagaaaggaaatacagagaacaaactgggcgatccagtctccaactttaatcatctcttctccaaagccaagataatccaagccatctgaccacataagcattgcatcccttcctgccttgcctcttcccatgaccttgtttttcttttgatgttcattttgagggtggagagtagaaaaagcattctctttttgctgctctcagagtcagtggtctttctggacctttaagttctcaggcaaggaaaaccacatagtctacctgagctttcagggactgaaggaaaaaaaaaaagtattgctttactcaaattcaggaccacaaataaccactaccaacccattcagttgagtttaataatattattttattgtctgtaattgctcggtattcaagttggcagtataaaaggcctgcagagcaagcttaaaacatggttcaagatcttagatttcttacatctcaggtgaaagacagaccatagactcccaaagcaggttacaatttagatagcaatgtaatgagtcgtacagacaatttgttgtctataggatcttggaaaaaaaacagattcatgaaaagtaagtcaggagagcttcatagaggggaaagaattgggccgatgttattttaattacctgcttccaggattctcaattagccatctgtttcttatcttacagaaatatcttttgaagatttccatattatctgattccaagttcctttcctgcctctttgtccccattagagatgtcactcatgaggacagtctgacagcagagacttccttttgaccagcaatgggagaaatatgtggaaatagcctgaagcctgagtatagaaggctttgaatgccagtccaaggagttcaaactacaggtcaaagagagccattgacaattttaggcagggcaatgaaatcttgaaaaccatgatttccagtggcattggcagcagtactcagtgtggtttagcatggaagaaactatataggagcctgctacaataattcagagggataatagaaacttggataatgacaatgggaactaaaagaattagatttaccagaaggcagaggaaagacattatagacaggactgagtggcctgacatgaggtgggaggaggtcattcaacttagtcattcagcagttcacttagtcattcagcagatatttacagtgtgcctcccatgttccaggcactgtgctaggcactggaatatagcagataacaaaaagttcttgccttcatggagcttatattctaatagttgaaacagataatacataaaaaagtaaatatataatatatcagatgatgataaaatgaaacagggcaaagaggatggggtacaagggatattgctcttttatatagggtggtcagagacggcttcactgataaattggcattggaactgattcttggaggaaatgagggattttgctgtttagctctttgaggaaggtatttcaggcagagataatagtgcacatctaaggccatgagatgggaatgcgcttatctggtttgagaaacagtaaggagaccttgtacagagtaggcaagaggaagagtggtgggagatgtggtctggggcagcgagcaggtttcttcaggaagggccttggaggctactggaggactggagaggcatgatacagtctgacttctgtttaaatgggattattccagcttctgtgtgaagagagtgctttaggaggagtagggtggaagcagcaagggaagaccaattaagggagcttctataaataattagggcaggaaatcatagtggattgaaacagggtggagctttggagatggtgagaagtggtcaaattctgggatatattttgaagatggagccaataggatttgctgcttgattgatatggtgtatgaaaaaaatagcagtcaaagatgaccccaagcattctggcctgaacgattcgaagttggaattgccatttattgagggaagtgtgtggaagagccactgattctagtcaagccctgtaattcatgaagaatctgagagccaatgagaagtaacttgccttagtttacccagttaggtagtagttgagatgtgactgaaactaccaggtcttctaaattctactcactgctctgtccagtacataccatatttctgacttcagctttagacatggtaaagggaaggtttagtgagggcaagagctagaagaagacttgaaaattaaccacacaaaagaccagttgaggtcatgaaagggtattcagagtaaagggtagttgaggcctagaaagaagactttgaagagctagcaaagaagagagaagaacaaattaaaatgggcaaaaggaaaatgagagtaatatggctcaaaggacttaagagagaagaagactcaatgatgagttctatgaaggggtcaggaagaatgggaactgaacaaatgtcattagatttgggttttagaatcttgggaaactgtggtgcctacaacttaacctcctttaaaattttaagcacttttcttgccgtttcagctaataaggagaaggaatataacagggtaagcctgagacagagaattaaaaacaaatttacttccaactcctgcattaccttcttgtgaatcctacacaaaaatttgactttcccagactcccatgtgcccatctataaactgaacaagaagcatacttcttgcccactttgcctcctggagatcctgtgaggataacaatgacaaaggataggaaactgctttggaagagaaatgttacataaatcaagatatccttttctagctgactttaagtttttaatttaagaaaaattcttgaaagagtcacaaaaaactttactttagagatacactaaatgcaggacgtgttgactgataaaatagatattcttcttggaaacaatggaaaatacttcagtatcattttgattaaatcttgcttaataactgttcattagactcatatcaaatcctgtcttggctttgttatttaatttaatttaattttgtagtcattgttacccaaccacaaaagaattacccctgtgcttaaggccacacagatttttcaaacattgatatatcagcattggtccttctgatgaaacacaagatgaggttttccctgctgagtgtcaggcagtctgtctcaagctgcaggctgaagccccagtggaatctaattccatccttccagtccccttcatacgaagagtgggaaatagtgggaatggaaattaattgtacctgctggcattattaaagttatcagtgcgtatcccctcttgggccaggaagattaaaaaggctgttgtaatcagagcagatgatttctgacacactggatgggcttcctccccaggttagatgtaaggaagtgatctgagcttgttgcctctggcctgataccacatagctcggggctatgcagtgtctgcctcatcctcccatcagccctggaggaaagccaggatcctgctctctgaatcagagatctcttagttggaaaatcaggccttctcacttaagactagtgtattctggctgcgcattcctcacaagatgtagtcaggttaggttagaccttagagtcacaccttgttcaggttcaacctgagtgaaataaggaattgaggtgctgctccctggtgattcagctcgttttagcaagtgtttattaaatgctttccccaagcaccacaccaggcccagacaattctgcctgtacacatcctgtggtatttgttggttggaggaaagaggctcttgtagtttatgaattaaagaaaaaaaattcctgatctgggaatgagaatcttatcctacgtttcacactgactcacagcctaactttgactgtgaatgccgcctaactttgtaacctgtctaggacttagttttctaatctgtaagataatggtttggactaatctctctaagatttatctctgaaattctgtaattaagtgagggaatttctatgaaagtgcttggcaaaccattgggctattatgatagttctaagtggaaacattatgtttcctcaatacacagtgaattgagttctgactctctggggcagatagatttctgactttctgggccatgtgttgaaaatatgaagatggctgacgtggcccctgatattgaatacagtgtctagtgggagaaatagacatgcacataagctatgatgatacagtgtaataatgggttcttgggtggagggaaatatgaggtgaggtttgccttatgatgtcctttgtatcttaggaagaatgggagtgtaggagaggggagcataggggatttctgggagataaaaccatttatgcagaaagcaaggaagtataataggtgaaaagcgttccggaactacaggtggtgtgggtgaggatggctgcacacaggtcccttgtaggggagtggcaagcgatgaggctgaggaggtgggcagggccttgcctgccacatcaaagggcttataccctgaagccagtgaagcagaagcccctgtaatgttattgttttaacttcttattttgagataatttcagacttaaagaaagattgcaaagtagtccagaaattcctctgtacccttaacccaaattccccaaatgttaaaatcccatctttccaatatttgggggcgagatttttaaaaaatctcgtataatcacagtacaatgatcaaaatcaggaaattaacacagaggtaatactataatctctcaatcttactgaaatttcacttgttgccttgctaatgtccaattcaaatttctggttcagggttcagtttaggatcacacatgatgtcgaggtgaactgtcatcttagtatcctctaatctctgacagttcctctgtcttgctttgtctttcatggttttaaagagttctggtcagttattttgtagaatgttcctcaattttggtttgtttggtttcctcatgattggattcagtttaagcaattttggcaagaacaccgtagaagcgatgtcatatttttcttagtgcgttatatcaggaggcacttgccgttgatttgtccccattactgatggtgataattttaattactcggtgaggatgggtgtcccctttgcactgtaataaatgtcttgtgaagatactatgtaaatatcctatttctcctcatcctttgcttactaatttttagcatgcttgttaactgaaacaattctactagcggattttaccaagagagtgccatggacagatttgccttttagaaagattactctgaaatgtttggatgtgagagagatgtgagaacagggaaaaagttactacagtagttcattcaagagcggggccctgatctaaggcagtgagaggaggagtagagaagacagaagagccatttaggctatgtttggaatcaataagcagggtttacattttgtgctatagatttaaatgctggaaaaattctgaaatggggggaaatatcacattttttatagattaacaggcatctatataacctctgggttgctctttttttttttttttttttttttgagatggagttttgctcttgttgcccaggctggagtgcagtgcgcgatcttgactcactgtaacccccgcctcccaggttcaagtgattctcttgcctcagcctcccgagtagctgggattatagtatgtgccaccatgcctggctaatttttgtatatttagtagagacagggtttcactatgttggccaggctagtctcgaactcttgacttcaggtgatccacccgcctcggcctcccaaactgctgagattacaggcataagccactgcacccggccctgggttgctcttctaagaatagctgactttattaaacatattgtaggtttcattaaatgatgtttcacaaggtgttgcttctcctggaccaaattcctgttgttcagctgagagctatttctaatctccagtgtggatgtgctcatcatttggttataggatgtgagcaaatgagatggtgttctgcgtagcccagaggctgcttccattagccctttccccaaacttttgccactttcaggcttagcagtatcctctcttgggttcagaatgcctgctctttgccctaatacaaaacctagagctgtaggccatgttcttatgatttgacagtatcagggaagcatttcttattgacttttccagagaaagagagaaaataagcaagccggcaacaagacagaggggaaaagggaagtggctcagttcttactttaagaaacaacatggaagatatgtttgttgatttgagggtggtgaatttttgcactatagctttgtgagggagctggaaagagcctttcagtttttcatgactgggagtttaatttggtttataacattacttaaagataactttgaaattggtctaagaacttagggttgttcctgaccccaggtcaatggcctacttgacctaggcgagaggagaaagagttaaggatagggagttgagctttttgctccaaaatctatagagggtacacccctcttatattctggagtcttactgggtttctgaaaatgcccttgtgggtcatgaaacatagccctttgaatatttttctgccgctgctgatgtgagctgattaaactggcaggcagatgatggaaggaatagttacatgtcccaggcgggaggtcatgacagttggatctgtggttgacagaagaatttcaacacacattcaaatcagctcctaagatagattgtctgagttccctgggcctgcctcatgccctcctcaaatgcatttgactccttctggcccgtaatactcacacttcaaatgtttggcttggcgtccacaaatcaactcagggccggggtaggggtactgatgagcagtgatgccctctttgggagctaccacagcataggaaatgaacattagaccaggaatcaggtaacctggttggggacccagggctctagatggtttatttttttattttccttattggttaaattccctaccgcagttttgacattctcttctggatactgactgtggtctagagaaacagctaaggaaggcaaatctgaattaaaatctggttcttgggaaagaactgaagttttcagattttgcaaaattatggagagtgcagactaggagaaaaaggacaggcatagttgtgacaaggagctattttttctagttctgcattctagaaacagtactgatgagtccaaaaatatagagataaaattttgtcttttttcttgctttaaaaaaaaatgcttctaaatgtctacatacttgcctaagaaaatatttctcaactcctccagaatatttagggttaactaaaaattataaaaacataccacagagctagtccactctttatgcctagggtttacccaaaaggtctgcatgctctggcttggagaccctgaccccatctcaacttgctggtttcaagtctacatatttggctgcaaagccctaatgccaggaggaatgcggaactgacgagtccaccccatctacaagctagaaggacatcttgattaaattagtgtcaagggcagtggagagaaaggcacagtgacacaaagggtgttttgaggagccctgtagcgcctgtggagaatgaatgttcttgttaaatatggccgtgacctgcagctccacacatgccagagacacagctcaattgtccccaggatttggggggtggggacgatcatggggagaggacagcctggcatggaaaggcaggaatgcaggaaggcctgttgttgttttctttttgcgataactacagcaagcaattctttgatcatggtccttgtgtttggaagggatcaagaagcgatttcctttcccctgggtgtttgaacctttgctctgctccttgcttctctgggtattaaggggactcctgaaagcccccattgtcttcagcctctttccacccccttccttggggctccccaagaagattgttgcctgaactctgtagggcaagaatgagaagcagtgcccccaagacagtgcctacccttgtcatttacccaccatcctcatctcatttatccttaagtcccaagaccaaagcaaagaacacatgggctgttgaaggcttccacaggactgccctggtcagtgggaaagcagtaatgctttctagctgggtaaccccttggctgagttccatctgcactgtggccagggtgcgtggtgagacatgcttttgccatttgccctttgaactgccaacaatcccaatgtagcaaatgggatttaaagcaaatctaaagctgattgagttttagatttctttcctttaaccagaatattctagcagcttatttttatagttctgcttatatgattctctttttaacagatggaatcacaaccttttctgcagaatatatctgatgaatttaaaaactgatacatcaagaatattcttttgtatatgtctttcttgctgtgaaaatttatggcctttcttccccctatcttcgctctgtaattattaggtgcttactatatgcaaggcattgtataagattaggagaatacagataagacaaaatagcattgaaggagtttatgagttcaattccaacttcaccaattaatagttgttctcatggacaaattttttgacctctctaagctttagcgtctgtaagtactaagtgctttttgtgcagagagatgtagagaggtgaaatttgagctggatttttagtgaatgaaaatgatttcagtaattaaagatgaaaaagtacggagtttgtgagcatggagggggagctggagtcaaaggatattccatatggaagaacaggcttcaggatgaaggagagcaccggaatgtgtgaggactcttcagagggtggtgagtaaaaatagtttggctaaatcagagtgttaatgaggagagcagcttgaaacaaagccgaaaagagcctcgaatgccaaacttggagtttgaacttcattctgagagcactagggaacgatggaagacctactcatagggaaatgataaaatattgctgctatttctgaaagactgggcctctaattccaggacagggtaataagagcctgagatgtggtagcagtgacaggaggaatgaaaagaaggagacagatgccagacatatcatgaaggagaaatgaacagcgtatggccacttattggaaagagaattcgaagtcagtgattacttctttcaatttttttatgctagtgtcacttaggaaaagccagtgtgctgttacagaatttgaggtggctggtgaagctgacattttcacatgtctcacgaactagatgcccaaatctttctcagaccccagatggccccatatagagcttttatacgtgccaatttttagaatttcttgtagagttcctccatttggtggtcaccagaggatctctgagattagtatctggattcttaatcattcagctaatttcagagatgtcctttatttgaggtagatttaacctcctttttctgtttgatggagtgtggtttttgaaaagtccctaaggaagtaatgtgaaaccatacttgaaacctcaggcttgcttctctcttgttttaccagaatgctttggttaccacgtcctgggaaatgaacaacttaaaacgtaagtgtggcaagccttcactatcaccagtatctgttcattgtatcaaacaaagcatatttccattcttattaggtttccagaattgcactgggcctggtgagggctacaaataaacataagataatctgttttcaaaatttaaacttagagttgtgcttctagaaatggaagcttttctagaagaaaattcagaccaatccttttgcttcatgggagctgctttccttgaagaggcttctgccattttagaaaatattactgagtgtcaaaaagctgagcagagtgtttaatagacttgtagggctagcaggacaaatatggaaatttaaggcccaggggcccaggatgggtagccttggtaaaattccccaggctttgagacaccaaagggatacaattaagaaggaaagataagccagaaatagactaaggcagtttcatagagactgaagcctggattcaaattatcttaacctctaattggattaaggtgatttaggatagccagtggctagaaacaaatttaaatcctctctagaggaagatactgtggaagatactatcatcctagacctaatatatctctcatcatttttcattatgatgtttggcactcagttataaataattaggcctatgaggaaataagaactgtgaccaaaagctaagagaaacagctagacccacaggagatcctagtaatggtgttaacagatgcaaactttaaattaactatgtttaatatgtttatgagattaaattataaaaacaaacctggaaataataaaaaaattaactcaaaatggatcaaaggcataaatgcaagagccaaaactataaaactcttagaagaaaatataggtgtaagtcttcgtgatcttggattaggcaatgatttcttacatatgacaccaaagcacaagcgacaaaagaaaaaataaataaattgaacttcatcaaagtcagaaacctctgtgtttgagaggacactgtcaagaaaatgaaaagacagctatagaatgagaaaaggtattttcaaatcatatatctcatcaaggtctaattttcagaatatataaagaattcttacaactcagcaacaaaaagatgaccagtccagtttaaaaatgggcaaaagacttgaataggcatttctccacagaagatacacaaatggccaacaagcacatttttgacactgttatttattgggctactgcaaatcaaaaccacaatgaaacaccacttcacacccactaggatagctataattttaaaaaggaagaaagaaaaggaaagaagagttttggagagggtatggaggaatcagaaccctcatacattgctggtgagattgtaaaatggtgcagatgctatggaaaactgaaaattcctccaaaacttaagcatagaattaacctgtgacccatcaattccacatctaggtgtatacccaagagaattgaaaacatatgctcacacaagaacttatacacaaatgttcataacagcattattcaaaataaccaggctgggcacggtggctcacgcctgtaatcccagcactttgggaggctgaggtgggcagatcacgaggtccggagatcgagaccatcctggctaacatggtgaaaccctgcctctactaaaaatacaaaaaaattggccaggcgtgatggcaggcacctgtggtcccagctactggggaagctgaggcaggagaatggcgtgaacccaggaggcggagcttgcagtgagcagagatcgcgccactgcactccagcctgggcgacagagcgagactccatctcaaaataaataaataaataaataaataaataaataaataaataaataacaaaaagtggaagcaacccaaatgttaatgaagtgatttatggaacaaacttaaacaaagtatggcatacctatacaatttaaacaaaatgtgtcatgtccatacaatagagtagtatttagtcataaaaaagaaggaagtgctgatacatgctacaatatggatataccctgaaaacattataagtgaaagaagctaaacataaaaggccacatattatatgattccatttatagtaaatgtccagagtatgcaaatctatagagacagaaagtagattagtggttgctaggagctgggggaaggagagatggggagtgactactaacaggtttgacttttcttttggcatgattaaatattcgggacttagtggtggtggttgtacaaccttgcaaatatactaatagccactgaattgtgtaccttgtagtggtgaattgtacagtgtgtgaattatatctcaataatttaaaaaatcaaacaaattttagtacaaaaaatgcagtaactaaaagagctcaatgtgtagatcaagtagcagattagatggtgctgaataaataattaatgaactgaaacgtcagaaaacaatgcatactgaagctcagagagataaacagatggaaaatacagaaaagagcataagagacttatgggatagggtaagtaggcctaacatgcttctacttgaagtctcagaagaagagaacaaagagaatgggatagaagcaatatttgaagagataatggctgtgaatttccctaaactataaaagacttcaagccacagactgaagcattatgagccccaaacaggagaaatacaaagaaaatacaaacagctagaggtaaaaaagacgtattatcttcagtggagcaacagcatggttgacagctgacttctggacaaaagcaatggaaagcagatgacagtggaatgaaagtgtagaaaggaatacccttcaaaaatgaaggtgaactaaagatgttttcagacaagaaaaatatgagaaaatatatcaccagcagacttgcactaaaagaaatactaaatggcattatttaggcagaaggaaaatgatcccaaatagaatcttagaaatgcagtaaagaatgaggagcaacagcaactatatataagaatatagattggccgggcacggtggctcatgcctgtaatcccagcactttgggaggccgagacgggcagatcacgaggtcaggagattgagaccatcctggataacatggtgaaaccccatctctactaaaaatacaaaaaaattagccaggcatagtggcgggcacctgtagtcccagctacttgggaggctgaggcaggagaatggcgtgaagccgggaggcagagcttgcagtgaaacgagatcatgccactacactccagcctgggcaactgagtgagactccgtctccaaaaaaaagaaaaaagaaaaaaaatatagatctaagtgaataatcactgttaaaaacaacactaataatcatctgtggggttttccttttttagatgtgtgggtgggagggacagagtcttgctctgctgcccagcctggactgcggtggcacaattatagctcactgcagccttgaactcctgggctcaaatgatcctcccacctcagcgtcccaagtataacagctgggacaagaggtgtgtgccaccatgcctggcttattttttattttttgtaaagagagggtctatctgttgcccagcctggtcttgaactcctggcttcaagtgatcttcctgccttggccttccaaagtgctgcggttacaggcatgagccaccacaccaggccaaccctgtggggttttaaatatgtataaaattaatataaatggcaacaatgaaatcaacaatagaatctgtgtctgggtgggggtagggaaatgggtttaaagatattttcagaaagtggtaaaagtagtaatttgtattaggtgttggcaattcaaggatatatgttgtaatttttggtaaccactcaaagaatagtattgtaccaatctaagaaagggacaaattcagttaataaaaaagtaactcaaaagaaggaaagaaaaattctggggagggcaaaactatagagatacagaacaaatcaatggcttccagtggttaagggtagcggagagtttgactctaaaggtgcaggatacaagaggtttttggtgggtgatggaactgttctgtgtcttaattgtggtgatggttagacaactctgtgcatttgccaaagcacatggaactgtatgccaacaagagtgaattttctgaatgttttgtaaatggaagaaaaaaagaaggtaggaaaggagaggaaagaggaaaatagaagaggcaggacaaatagaaagcaattagcaagttggtgggtttaaaccataatataaggtgtaaattgacttatgcaaattaaagacagatttttaaaaagcaaaactagagtgtatgttgcttgtaagagaacagatacactttaaatataaggataaagaaagatttaaagcaaagtgataggaaaagatagctacaataaaatcaggccaggtagattcctttctttctttctctctcctttctttctttctttctttctttctttctttctttctttctttctttctttctttctttctttctttctttctttcttttctttctctctctctctctttctctctctctctgcccccccacttctttctttctgtcctttttttttctttctttttttttttttttctgagtcttgctctgtcacccaggctggagggcagtagtgcaatctcagctcactgcaacctctgcctcctgggttcaagcagttctcccacctcagcctcccagatagctgggattacaggcatgcgccaccatgcccagctaatttttgtatttttagtagagacagcgtttcaccatgtcagccaggctggtctcaaactcctgacctcaagtgatctgcccacctgggcctcaaaaggtgctaggattacaagcctgagccaccgtgcccaggcagtccaggtagatttcaatgcaaaaagtattttttgttataaagagagacatttccaggctgggcatggtggctcactcctgtaatcacagcactttcggaggccgaggcaggcagatcacttgaggtcaggagttcgagatcatcccggccaaaatagtgaaactctctgtctttactaaaatacaaaaaattatccaggcatggtggtgaacacctgtagtcccagctacttgggaggctgaggcaggggaatcacttgaacccaggaggcggaggttgcagtgagccgagatggcgccactgcactccagcctggtgatagagtgagactctgtctcaaaaaagaagagagagagacatttcctagtaaagactaagtttccaggaagaaatatatacttaataacataggcttaaaatatgtaaatcaaatgggacagaattaaaatgggaactagataaatcatcaccctaatgagagatttaacacacctgtctcagtgaatgattaaacaactagaccaaaaaagtcagtaaaaatacaacaaacttgacctaaatgacatatatggatactgcgcctgacaactgcgggtagatacacattcttttttttttttttttttttgagacggagtttcgctctgtcaccgaggctggagtgcagtggtgcgatcttggctcactgcaagctccgcctcccgggttcacgccattctcctgcctcagcctcccgaatagctgggactacaggcgcccgccactacgcccggctaactttttttttgtatttttagtagagacggggtttcaccttggtctcgatctcctgacctcgtgatccgcccgcctcggcctcccaaagtgctgggattacaggcgtgagccaccgcgcccggccagatacacattcttttcaagtgtacgtggaacatttacaaagtttaaacctgaaatggggaggaaaaatcgaagagcttaggggagaaattagagctggagattggaaatctccatttccaaagtctaccttctttttctcacaattccatgatttttcagtaggagtggggtactggccaagagggaaggtatcctcccccaagaatattgatttttcttttttcaactgtatgtaggccatgactaatgggaatggctacccatgtgtttactgtggacaaagacaagaggcttcaaaccaccattgtagctgacgaaagctgatacaggctcaaatcttcatcccagtccctaggcaatgcattctaatttctgtcagtaaagggctctactcattctcccaaagttggctttgtgctcctcttaggtccaaccctggcacctgaggtgtcaagaaaatgctgtcttcataactcactggagcctcttcctctcgattctaaaggctactcccagtgttctaaaactacacagatctctcgatgaattggctttgctgctgggttcctctttcttaaaagtatttaatcagcgattttcccagtgccccaggcatttcctgtacgagtgctgctgactgttttacttcctaccaggctgccctcctcctcttggcattcacacttccaactttcagatgagctctattaactcctgttcttccagcctccgcctggctcagccatctgggagccacacaggcattctttccatcccccagctcatagatttccttattgtagaagggcatatgttttcaagtaccttatcattctggctctttcccccgattctctcccagttccaagccattgattgtttttcctccttagttcattttacagctgctgagagatttgagctctcgtgttgcctgtttgcttttgtgtcttttgtcccttatgtcccagtctactcaaggttacccacagtcacctagataccatttctactctgtgcttttagtgtcctgcttgggaaatggggtgatcactcatcttcagaatgacctcaagaaatgctttggcatgagagatcagggcctgaagacattacgcccccagccaaatcattatccaaaagggtaaaagatggaaatttgccaagacaaagatcacagtggtagtttaagaaatgaaagcttagatttgattgtctgttttaagggatgttgttttgagtttattttcttagtattaggataggtcattcaaagagattggaacaaccatggaagaacattcagattattataggactgtgtttcagactgggagagcagagggccgttatcctcttcctgaccccaccctgaactcccctgaactcccacccttgtcccgagtatgcctgtccctgacaagagactttggtcagggaccaaagtgagctttgttagtgagcattcacagagggtaggagctgagtccacgaagttcacatcatgccaaggaatggatttcctcccagggccactagcattacttgtgggttatcaagtgttactgctcacacattccagagcttctagaaaagccgtaaggaaatggctttcagaaagccatttctgtcctagaggagagaggtcctggatttcactgaaccagaacttgatgggtggttttggtattctgtgacctaggtagtggggagccccttcctttggatgtttcctttatgcccacagtcgaaccatatcctagttgtacagccaagaaggatcttttctgtttaatctatctggaggaatagaaggtaattgtatcctccttattttcattctgccacccctaccttcatcatttcttcctttctgctaagcactttttatcatctttctttgtttcgttttgggagttttgtttttttgttttctttcctcaggaaagctgaattatttcttacagagtcatttagttcttactgaaactggggaagaaaaagattatgcaacagcaggcataaggaaaaacagagaacgttcttcccttcgggcccacagagcccattggaggaattcagctacaatcctgcctgggaagtagtttccaggaccttcgcaattccacatagcatctttaacatgtttgagagtacgtaaggaggcagcatagtgcagcggaaagaacactcaagtgagtgttgagggggctggattctaatattaatattagccaacatttattgaacaggctaggtgctagattctgtttaaagcactttatgtggattatctcactattcttattatcctattttacagatgtggaagctgaagcatagagggtttaaatataatttacccaaggtcatcaattggggagtagaagtaggattcaattcctgctccagagcctgcatgttcagctctcttttaatactgcatgtggtccttgataggctactgaccctggaaaagtcatttcaacttttagggctcattggtgaaccataaccaaagggagctcattgtggctaacctctgatggagtttccacttttaataatttatatgatgaaatgcagctatattgtttagttcttgtcattatgtgaaagcatagtatttaaactttgatctcattgattcagcaactgattattttatggccactgtgcacaaagcaatgggctgggtaccacagaggattcagaaaaatgcttaaaaaggtaaaacctatctcttccattagctttagatggtttcatattgtagttgctttgagatttttttagactaagtttttcagataattaaacaggaatcaaattcaaaaactattcatattccagaagaggaatcctgaaacaggtattgggccttagactagtcaagtttctgacattttcttttaaaatataacttgtcactaggatagtttatatccattaactcctgagtgaaggagcttctggtgaaattgttttttatggtgcttacaagctcaaggggttctttaaaaatggaatgtgactgctttgggagtcactaatactgaagctggatcattataacctgaaatatccattagtaacttagaaagacaaacccaaagaaaaagaatttactatgtaatagctggattttttgaaatcagattttttttttttttttttttttttttggcaagctagattcaatatctagcttgctgtggaattaggttatggtgtggaaacctcttggctgggacaggaaaaaaaattgatcttaaactaaaaaaactaacttaagatattccatttctagtaatacctttgagattggaagaattgcattctgatgggcccagacgttagattaatgtccatctttctcaacaggttgtaaacttttaaactttctgttttgcattcagaccacaagtgcctgacacttaataaatgttctataaatatttgctgatggactctttattgcttactccctaaaatccagccatttctcccttgccagcattcaataattgaacctgctttgaaacatctgatcagccacttcaagacggcaagttattttagctcctgtctaactaagttagtgggctccagtccttaaaccactattttctttattaattcctcaagtacagacttttgtatgtaaccagtcttcttaaacctgtgtataatgactcattaatgagttgtaaaataaatgtagtgagttatgaccaatataaaaaaatagaaaaggccaggcacagtcgctcgagaatataatcccagctactctaagaggctgaggtggagggatctttaggccaggagtttgagaccagcctggggaaacatcacgagactccatatctgaaaacaatttttttaaaaattagccaagcatgcctgttaccagctacttgggaagctgaggcaggaggattgtttgaagccaggagtttgagaccagcctgagcaaactcagtgagatcccatctctacaaaaattacaaaaattaaccagcgtgtttgtacacatctgtcgtcccagctacatgggaagctgagggaggaggatcacgtgacagttgagcccaagagttcaaggctgcagtgagctatgatcaggccactgcattctagcctgggcaatagagcaagaccttgtatctaaaaagaaagaaagaaaagaaaaaaagaagataaaaaaataggaaatatcatagtggacagcacataagtagaggtgaagccagctggacttcctcagtggagtggggacttggagaacttttctgtctagctagaggattgtaaatgcaccaatcagcactctgtaaaaacgcaccaatcagcgctctgtgtctagctaaaggattgtaaatgcaccaatcagcactctgtaaaaatgcaccaatcagtgctctgtgtctagctaaaggattgtaaatgcaccagtcagcactcttaagagctgtaacactcaccgcgaaggtccacagcttcattcttgaagtcagtgagaccaagaacccaccagaaggaaccaactccggacacataagtacttttattatagacacctattatgctgtattgcaataaaaaatgtattttttgaacatcctagtctacctatcttcagaaggcaaaagcacctctggtgtccctgttgtggtatctcctagcctacctctctataaaagttttgcaattaagtatatttgtgttttatacatccttgggcttctcatagtttaaggtcctaactggagttcagtctttctcagagccgtctcatggtatcctcaccgatgaatgaatgctgaatagaaagagccctgcttgcatatatgcaggtagtatggtggaggggaaatctagaagtcatttctgagctctgacctgctggatcatcaccccctgaacccccagagcctcggcatacagcctcacactgtaccacctattttggtggcccaagttagctgagagagaggaccagacacagtgcccaccatcacctagcactggccctgctaccaaacagtcattccttttagccctctcctccccaccaaaagcatttcaggcaaagtgccagctcctgaaatgtggcctctttgaagtggttagtgaatgcccctgaaaccaccaccttatgtatggtggtgcttctgctgccagagcttaatacagggtcatgttcctttcctctgaaatctgtaacataaattcagttttaaactggattttttttttaacagttggtctctgaacaatctttagggtggggaggggatagtagtggttgttggggagatatgtgcccttgaaaactggattcttttttggaaaactgctgacacaggctaaatggcagagaactaaatggccctactgttcctacctgctgacaggctcagccttgggatggggctgaaatgagctctcgccacatggcagagacatgccttcctctttttattcttctttcttacaaatagggggtacttttgtgcctgtcaaaaaatacagctttgaaatgtagataaccaattaacaacagtcccacccccaacttggaaagcacatgagtgctgatctaaataactagagaatcggtaacaagtaacctccctattgagaacaggtctgaaacctctttcataattggtgttctttgggaaacgctaatagacaaacccatccaagctcaggaaatgtactgatttaaagaggtctaaggaagagtgaccagcccagtggccaggcatcccggatgcctaggatccttatgtttccgtacatatctgctgttacatcctttctgtgagcaaggaggctttggaacattacagtcttgtcttggggagatgagatgacacagtgcatttcagttctgtttccaatgctgttatctgttggaaaaaggaagctttcctacccattttgtcagcatacaactggtagaagctgttgcaatctcattgtcttctgatcagcccctcggcagcagtcagagtggaggccagtgaagcactctggccaaatggttgtggtgagtttcaaaataagagatcccagcctgagcacaccatcacacttcccatccgatagaaccagcattgttaactgtaccacatctctattctaaatttaggcatcttttttttttccaggcaaagattactatgcaaacatttaagagaaaaactttgtccaaagtaattttttcccccaacttctatttggtttcctgcaatgttgagatgactcattctcttccaagaaattttaaagaaaagagatgcaggctgtatgttagtacacaaagactgctctgtaaattctttttcttccctgtctagaaaccccttgcctttttatagagaacggaaaagctctacagtcttcattgtcatgtactcggcctcatcaggttttgttgttcccaggaataaatgtcccccttgtctttgggtggggcccccttgtggcttaccagctctgtcaaccccactgcagtggccagcacggaagcccttcctggggccacgctttcccccaaaggcacacagttaaggtttctgaaacagagaacgaatggccttttatcatctgtgaaaggagagacactggcaatttcctgcctctggcctagtgtcagaatttctcctgattgctagaggctgtattgcacattttaagtgggctcgctacacatgtattcccagcccaaccctcagccagagggagcagtaagtcagatcacttcagcagcctgttcaaataaacagggataatagttgagtggtcctcccaactcatcagtacatgaaaggaaacatctgcctgggcttaattgctgttttttttggttacacttttccctcctcttcttcccccatcccccactctggggctaggttatttaagtcatgggtaagcaacagggtagaggaataggagctttctcctttaacctctgccattcaaacataaggaggagttaagaaacgataggctggcagggggagatggcccggaggcaggagggcagggcggtgggaagtgatactcatggtcacttcctgaccctgttgctgactctggggctcagagtgagtcatgttgcctcacttcacctccttgggcctctgttgcttcagtggagctcagctttcctctcaatggaaaggacaggctggtatgtgagatcacagatgaaaggcattccctcttgtggcttcttccagcagttgaggtcattggatgagagaccctggaatgataaatttaagactggcaagatcccctgaacccgtccattttgtagagcatctgggtccccgaggagaacttgctcattatcttctagccaaccagccatacactaaagggagggatgtttgaagctaatatggactctagaagccaggcagaagatcatgtagaatcatagaatggcagaggttggaaaagactttagaaatgttttagctgaagcttttcattttatagaagggaaaacagagggccagagaggttaaccaggttgtccagagttacctctttggtaatgcaggagccaggaatagaaagagaatcttgtgattgctaatttagggctccttccacccctttccccactatcagatgtaaaaattcatgcttactcatgacagaggccacacataggttatattccataatgaataccttaatagaaaaatgggcagagaacaccttaataagaaaatggcagattataaaagaaaaatgaaaatgactgataaacatttttaaaaatgctcaggctcattagaatcaaaggattgcaaattacaataggataccacatcaaattgtcaagacaaaaaaatgtgaaataaacattcatatatgctattggtggtattttaaattggtaccgtttttctcaaaggcattttagtggtataaatggtagtctttgacccagcaatgttatttctaggaaaaaataatgaaaggtgtgtgcattagatcatatacaaagtaatgtgatatggcattttttatcacaaaaatttagaagtgaagtaaatgtccaagaatgggagctacatcaatagaacgtattataatgctatagaacaataatacatgtggaaatgtttacaacatatgtttaagtgaataagttacaaaacaggatttataatgcaatcccaattttgtaaaactagaaaagattagaaaaatacataacaacacttagagtggtgatttcttagtggtaggaatttaagagttacttttgttttcttttttgaggtttctagtttccttattataataaacatacattacttttgtaatcagaaaaaaaagtattttttaagtagagatgtatgtaccttgaaaaaaagcaagatcttaaatgattgtgtatctgacatgaaagtccttcctttttttgcctgggagctagcagctatggtgggagggatgggaaacagtattataacttctgttaggatggcattttgatacccgaatttctggtaggaaagatctagaaggagctggcaaaagataaaacaagggctttccctctcaatgacccatgctgccaatcagttttagctctcttaggtttggcatagaacacttagtatagaaggtgtgacaatttccttcctgcttcctcctttctttcctttccttttcttttcttttttttgagacagagtctcactcttgtcacccaggctggagtgcaatggcgcaatctcggctcactgcaacctccaccttctgggttcaagcaattctcctgcctcagcctcctgagtagctgggactacaggcgtgtgccatcaggcccggctaatttttgtatttttagtagagatggggtttcactatgttggccatgctggtctcgaattcctgacctcagctgatccacccacctcggcctctcaaagtgctgggattacaggtgtgagccaccgtgcccagccctcattgtttatttctactgctctatgtagttagatgtcagccctgggtggcagcagcaaagaacccaggagccatcactgctcaagattaactagttggagaccccttaacatatattttcagcatctagtaacagctaatctctcaggcagtcaatattgagataccgctgccttgtgagttttgggtagaaataaagcaagtaagaaatatagttccatcctgcttggagttttctatttagttagggactttgaagtccctgaatgtttatatactttttcctatttcatcccattacacatcttactttcctttgaaatcttctggaatgcttgactgcaagtatctgagaaaccatgttccacctaacaacagttgctaggtaggatgtggctttcaggcctgctctttggggaccaatagaaaaaccaaaggctaccaccctttttccctctacgcaattgcctttgctaggctatagagagggcacatttcattttattaaaactctttgagtaatctgaccataattgggtctgattggagtggttatctgatttgctgggttaaataatgggccttaattgagtctgggttatttgtagagccagtgtggcttttgccttcgttgctccctcctctctcttctgtttcccaattaaccttcattcctctttccttgcagagtaaagaagtcggccagcagctccaagatgatttgatgaaggtcctgaacgagctctactcggtaaatcagatgggttgcttggctctttaacaagcagagggaagcagcatttg

SEQ ID NO: 1129 - DNA, 51030 bp, Homo sapiens
gcgtgctgactgagctagtcttggggtcctggagaagggggctggaggcatgcccacagcctcccccccatgagcttggggctggcgagggcacaggaggtggagctgacactagagacggttatccaggtgggtcctgggggctgtgcccaccctgtctggggcggggcagcgtggacttaacaggagtggtgagaggtgtgtgcgtcttggggatcaaggggtgggagaggtgtggtggtggtggggtatacaggggccccccgcttgcagttcctggcaagatggggggcagaggtacacacagggtgcacctgctgtggctccctcatcccagtgccctgggttgggagaagggggtctctactgccagattttagggcttgggggacctctggcatagccagatcctcatccatctagggtcggaaccggattggggcccccaacactggactgcctccagtggggtttgggagttacccgtagggtttggttctcatctctggccctgggccttcttcctggggcagtgagcacacaagaggctctttgcatggggattttttggattctaactcccaggcttcactccatcttgagggggctcctggggacctgtatcttgggcagtaggattctgtggctctccccacgaggccagggagccccgggtcccatgtcccctgaagaccctctcgcttttcccacagacactggagagcagcgtcctgtgccaggagaaaggcttgggcgcgcgggacctggcccaggacgctcagatcaccagcctgcctgcccttatcagggagattgtcacccgcaacctctcccagcctgagagcccaggtgccacccccatccgctcccctccacaaacaccacccacattttacctcttctcatgtccctttcctgagcagtcaccatgatgatcatgactgtaactcactgtggggcaggcacagctttatgacagaagaacccattttacagatgaggaaacagaggctcagggatgtaatttgtccagacttattccgcatgtggtgcaactagaaggaagggccgagcatctcctgcgtgcttgcctgtagcctgctgcagagatgtgaaccccaaatcccgtattcccacccggggaaggtgtgagctggctgaacccaagatacaggaagagggcagctcagctcagaccagggttttgcggaagtctgagtggatggcgccgtccatccgtttcccacgtgggcaggaaggcggatggtccctgctcctctcagtgggtggcgcacacggtgtagttatgtggcttgaggatctgggaaaggcacactcagttgcagctggtgtgctggcgtgtggcgttttggtgctctaaccattgtctgtgttcaactcccaagctacagacgggccccctccttgggagcgccagggatgttggcgccctggagccccagacagggagagactcagagggccctcaccctgacacctggggtgtatgtccagttctcccagggtagaaggggaacccacaggaggtggacaaccccgcttctcccgctggcctttctttccctcttctctctttctccttctcctcacaacctgacctatgctatgctctcctgagccctagcctttaaagttccatgaagcccttctcttgagcgaggctttgatgcttttctgggaggatctggttactactattctaccttttttttttttttttttttttttgagacagagtctcgctgtgttgcccaggctggagtgcagtggcgcaatctcagctcactgcaacctccacctccccggttcaagtgattctgctgtctcagcctcccaagtagctgggactacaggcatacaccaccatgcccagctaatttttgtatttttagtagagacagggcttcgccgtgttggccaggctagtctcaaactcctgacctcaggtgatcctcctatctcgactcccaaagtgctgggattacaggcgtgagtccgtgcccgccccacccatattacagataagtaaatctgaggccccggagaagaagactaattggaaaaggagggagcaagaactcaggggtctcctggctcctagactgagtgtctctcctgcacctcccaaacctgctgggccacactttagctggagttgtgttcactttacgtccagctttgtatcccctccttgccttcctccctgttctcagctctgtttgcaggcctggtgctgcagccattcccatctggactcctcccaggggcctggatggttttcttgccctccctgttggggggaggatgtcccactggacccagaagccaaccatgtgcccactgtcccttgccagtcctgctgccggccacagagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagagggtgggtgccgcccaggtggtggactaggccagggttcccctcgttcaagggcagggaggcatctagaccaggcccacacacggggcaaaagatgggccctggagtcaggttggcctgggcttggattgaggctctgccaccttgagtggcgttgagcaaatcactatgctctttaagcctgttttctgtagtggggattgtaatgggacgtggaattgtaggaatcaaggagataatagaataaagtgcctggcaccaggggtattttgttcccatctgtcccaggcctgttaggggtgtgggacacggagaatgagatccctaaagattcctgccccttgagtttctgggcatctcccattgccacgggccttggggttgaggcggtggctggatgctggctcgaggctggtgtgggcacccgcggtgttctgcagcccatctggggcagccacaagacctgccgccactgcctattggaatgagttccaggcagggaaggaaggagaagcaggcctgtcttcatgtccaggcaggattcacatcacccgtgctgcaggcttgtgggggtcccagggtgtggggcgggagctgggtgtgagccggtgcgaggggtgcgggatgctcttgatgcactgtctgctttgggcctccgggtggccgggaggtggccctgggaagttggtggtggctgaagattggtaagggacactcgcagctgggacagagtgtatgtgtgcagatgagaggcatgcaggtggcaataacgtattaacagtagctactgtttattgagtgcctactatgtgccaggcgcgtgctgagtgtttcacatttaatacaccaaggtcgggaccattatgatgcccatgtaacagaggagaaaacagaggctcagggaggggaagcaccatgctgggggcacacagccagttaaagttagacaccaggtcttccaactcccagcccagggctctgtttggtttctaaactaacccagtctagaaacaaagttctgaagtttcatttcctgtgtatgggaagagacactgggctagggatttcagggcacagctggcccccacaaagttggaagggacccagagaggcaggggctggcccagggtcccctgtgtggtagtggcagagctagggttggcatgggacccctgagctggacttgtccaggctggagcccgcattggcaggagggtgtgtgttcctgtgtatgactgtggggtgtgcccgtgtcctgggatttgcctggctggacaaacccacgactagttgggacttgtagaggagcagagtaggcggcccgcagtggcccctggcatgaggacagtggagagctcgtttccccagggtctgcagcgggtgtgtagggcacgctggccccagtcatgaattgtgggtggtgatggggccctgagccaggcacccctttcttttggtccatgcatggcacagtgccacacccccagggccgcctcttaaatgccaccttctgaagctagccctgcccccaggttggcagggaagggaagaggtgggaggtagcaggttcctcctctgctgggacacagctgctggggctgggactgcagcacagggggtctgggttagtctagaaagctccctcctgtggttagtgggggcccaaatggcacgcagagggcgcccgctgcttcagttgtcctctatccaccatggtttgaatgaggccccacctggaggcaggggtggaacaggaatgacctcaaaggcctttcctggagggtgggtccccagagaacttcagagcctagagatcacctcatcacagatagggaaagtaagtccgggagaggggcatgataggcccaaggtcagtggtggtcctgggatgagacccttggtccagggctctgcagttgggcaacattctctttccctgccacccccttgtccccatggccacaggtggcagtgcctgcccctgtggccctcactggcatgttgggctgggttggtgggcagtcagcgagattgttctgatctttccaaccctgcagcacccctggcatggggagcggagggagggtcaggtctgtgtcctgttaactgcatgtcctgcagggaaactgaggcactcccagaggccacctcccagccgagagagaggacctcagggcccccatgggggtccccccttcttgctgtccctgagaagcagatgtaggcgcagctgggaatggaaaggagggagtggtcacgcctcccttggctccagaggacagaccccctgggctccctcgtgtccatagcaacctggaaagagtaaattgaatggcggtctgagggcagcagttgctaggggagacagtcaacttctttcatctctggcttagtggcagcctccttcccttttgaattgcaagtaaaattgaaaggctgttttgctcacggtgaagtttgtggaaaggggtgaggtgtggccgagagggccctggctctggttctgagcactggagaagggggaggagaacccagcaacggcctgaacccctctgtgtcccagaggcaaacagcacctgcttcacacagatatgcagtgtgtacacgacatgggctacactgggccccacacagacacacagatgcacaaaacattccacaaacaacatagtgagaccctaaaaccaggccacacagaaacactccaattcacagaatatgcacagtgttagccgcacacacagccagatgccacacaaccccacacaggcacagaacagtccccccaccaccggggacctataacaaccatatgcagatgacacagcacgctatctcccacctcatgggtgcacacggacaggaaaagcatacagttcaacacagccaccaatcggcccacaaaggtatgcccagatgcacaaagtgtgtatcacacataccagggagcccaggcacaccccccagacccacccacatgcggttgtacacttgcctcaccgacacacagacatataccctgatacacacagccaggcccaacacccgcgccacaacatagaccttcagccacagatgccgccttagccgttcacgggaaggctcagatgcaccaaacagtcgacgtgaactcagcacccacacactacacacacagtgtcctgcgtggagacaaatgacaaaatacaccccactcgcacctagtgagagccaccaacatcagtgcacagcctgtgtggctgcctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacgtgtcccgggggtggggtgggtagagatgtccttgctttgtctgtggctcatagaacatctctcagcatatggggtcaatgcaggcctggagggcaccttccctaccgctaacctggcctggacccaagacccgagatgagcgtgggtgagagcagctgccctcctgttggcttcctgtggctggcgtggccctgcacgggtgggcttttgaatgccctgcctgggctgtagcaggccaggtcctgaggatgcagatggtgagtgcagggctagcatcagagtaagctgggctggggtgttgtcgctgccaggtgcccttgacccactgtgtgctctcccactgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtggaggaagggcagcagcaacagaggctttcctgcagtgaggatggaggggacctttttttttttaagatggagtcttgggccggatgctgtggctcacacctgtaatcccagcactttgggaggccgaggcgggtggattacgaggtcaggagttcgagaccagcctggccaacatagtgaaaccccatctctactaaaaatacaaaaaattagccaggtgtggtggcgtgcacctgtagtcccagctacttgggagactgaggcaggagaatcatttgaacccgggaggtgtaggttgcagtgatccgagatcgagccattgcactccagcccaggagacagtgcaagactctgtctcaaaaaaataaataaataaaataaaataaaaaataaataaataaagatggagtcttgctctgtcgcccaggctggagtgcagtggcacgatctcggctcactgcaacctccgcctcccaggttcaagtgattctcctgcgtcagcctcttgagtaactgggattacaggtgcatgacaccacgcccagctaatttttgtatttttagtagagacggggtttcatcacgttagccaggctggtcttgaacccctgacttcaagtgatctacccgccttgacctccaaaagtgctgggatcacaggcatgagccactgcacccagccagaagggggcattaatatgcaggcgccgtatagggcaacacctgtgtgcacctcttacaaatcttaatgctgtgtatatgagggggttccttcgtgtcctccgggaatgtttgaggttgcctgtatgtgttatgtgtgtgcatatctttaaggtcagatatgcatagacagattgacacctctgttttgaatgtattcccatgagctcatcccattaattcactatcgcaacaaatatttactgagcgtgagccatgccattccacagccaccattctagtactaagatacaatgaggaacaaaaaatccaggctttcctgagctcacattggggtcggggcatggtgggaagacacaggcatcaatgtaataaacagaaaccacgacagggctaagtgttctggaggagaggcacatggtgtactgaggcccctgaggttgacccaggtgcacctttgagctttgcctgcgtggtttgggtttgtgggctcacctgcatgtgtccatgcatgccccgtctgcgtgcccgtgcatggctgcatcaccccatacacacgtgcactgcccctgggcttgcccacatgtgctgctccccagggcgccaggctatcagcctacaaggcattgtgggtctgggcccagcctgccacgccctacagaagcctgagcctgccttcccaggaggcccaggactctcacccagggcccttccctgcagctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaaggtcaggaccacccactcctgctcctgtcctcccacctgttcactttgccccgccccaacccctggggctcaccatcagctccccatccccagattctccagtacaagaagaggtgctcggagctggagcagcagctgctggagagatccggagagctggagcagcagcggctgagggtgggtgccagtgtggggcaggggcaggccctgccctccacctgcccaacctgatgctttaacctctctcccacccaggacacagagcacagccaagacctggaaagcgccctcatccggctggaggaggagcagcagaggtgagggcgcagcagggagggccagggctggcaggatggccccctgcgcgagcgcctactgatcccctgtgccccattcaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggaggtgggcatgggggtgcagggaggccagcctgacccaagaggaaggggcactgcagaggagggaggactcagaagcctggagagggagagggagcactgtccaagggagcctgttagcagaagtaaatagccgtcatcacaatagctggtctttatcagtgtgtagcatgtaccacgtgcacggtgtgcgttgacctttattcctcatgataactgcatgtggtaggtgctatcattctcctcattttaaagagaggttaaggccggtcgcagtggctcacgcctgtaatcccagcactttgggaggctgagagatcgtgccactgcactccatcctgggcaacaaagcaagactctgtctccaaataagtaaataaataaagagagtttaagtaacctgcccacagtcatgcaactggcagctgggatgcaaagctaggtcccttgcatttttgcccttcgttgctgcctcttgcagccaaaagaggacttgaaacccaggtccctgtgcaggagggagccatgaggcttgggaggctgagcatggccgctgcaacacagctctgtgcacagacccacaggaagacccaatccctgaacgacggtgcctcccaggatggtcggagatgagggaagcagtgggagggagtaaacccgctctcacaccaacccttccctcggcatgtcttccctccagtccttcaacgcctacttcagcaacgagcacagtcgcctgctcctcctctggaggcaggtggtggggttccggcggctggtcagcgaggtgaagatgttcactgagaggtgaggcctggccggggacggggcagcagctgagagccagccctgctctttatgtccaactgaactcagttgaatttcagttcaactcaacgcacttactgtgcacaagggccggtgaggacacagaggcaacttgtaataaccattaccacagtcgtggcagtcagcatttattagatgtttactctgggctaggctcattgtatatttcatttcaactaatattcatagcttccctgtgaggtaggaactgtgttcattcacatattacagatgaggacattgtggcgcagagaggttgagtgatcttcctgaggtcacacagtagtacataagtggctgagtcagagtttgaagttcctgattttttttttttctcagacggagtcttgctctgtcaccaggctggagtgaggtggcacgatcttggatcactgcaaccttcacctcctgggttcaagcaattctcctgcctcagcctcctgagttgctgggataacaggcacatgccgccacacccagctaattttttttttttttttgtattttagtagagacggggtttcaccatgttgcccaggatggtctcgaactcctgagctcaagcaatcagccagcctcagcctcccaaagtgctgggattataggcatgagccacagcgccaggccgaagttcctgattttaatccactagaatattcagctttgctaccaaggacctcacagcctcttgtgatgaaaagatgtagatccccaaaattctaggctgggcacggtggctcacgcctgtaatcccagcacttgaggaggccgaggcgggtggatcacctgaggttaggagttcaagaccagcctcaacatggagaaaccctgtctctactaaaaatacaaaattagccgggcatagtggtgcatgcctgtaatcccagctactcgggaggctgaggcaggagaattgcttgaacctgggaggcagaggttgcggtgagccgagatctcgccattgtactccggcctgggcaacaagagcagaactccatccaaaaaaagtaaaataaaattctagactgaggaagcgagtggtcagtgatatgtacgtggaacagagggaatgtcctcgaggctcagaaggatgggaggggtggggaggtcagaaaaaccactttgtggagatggaatttgcacagagcctcaagggatgggtagggttgaagcagagcagcaggcgctccaagcaggagcaaggcatgagcaaaggcatggaggtgggagcccatggcagccaggggggttgcaatgaagagctggtacagggaaaggagagcctgcctcagcgggggagcttgggcctgcctgatccgtgtgagcagtcagctcaacagtagtgtcagggaggctgcggagagagccccaaggcaggaggccaaggtatttcatttagtgcgttaaaaacattttagttagtaatcttttcttttctttatggctcactacagcctcagcctcctcgtctcaagcaatcctcctacctcagatcctgtgcagctgggactacaggtgcatgccaccaggcttgctgatttttttatttcttgtagagtcgaggtctcactttgttgcccaggctggtcttgaactcctgagcccaagtgatcctcctgccttgacctcccaaaatgctgggattacaggcatgagcaaccacacctggtttaataatcttttgttaatatcatcaaatagccagtgtctaaattttccatatgtctcataaatgtcacagatagaccaggtgcagtggctcacgcctataatcccagtacttcaggaggccgaggcgggcggaccacctgaggtcaggagttcgagaccagcctggccaacatggtgagacccctatctctactaaaaatacaaaacttatctaggtgtggtgacacatgcctgtaatcccagctactggggaggctgaggccccagactcgcctgaacccaggaggcggaggtttcagtgagccgagataacaccattgcactccagcctgggtgacagagtgaaactctgtctcgaaaaaaaaagtcacagatagtcttgctttagttttttctttacaatttgtttgaatctcgatccatagacatttacaaaacgtaaatgtttgctttgtcttttttttctttttttttgagatggagtcttgctttgttgcccaggctggagtgaagtggcacgatcttggctcaccacaacctctccctcctgggttcagcaatcctatggcttcagccccctgcgtagctgggattacaggagtgcgccaccacgcccagctaacttttgtatttttagtagagatgggggcttcaccatgttggccaggctggtcttgacctcaggtgatccacctaccttggtctcccaaagtgctgggattacaggcccaagccactgtgcccggcccctgctttgtcttttaagtcccttttaacttatttgttcaggaaactgggctagttgtccttggagattctcatggtctggattttgctggttgcatccttatggtgtcaattaacatgtttctttatcccatgtatttcctgtaaattggatgttggatctaaagctaggtcagattcaggttcttctgcttgcttttttgtttgatcaagactccataagtagaatgtgttcttccagcaggatgcccctatgccagctgtctctcttttcaagatccaacccactcatcaaaggctgcaaaactgtgagcttctcatttagtcactcctgtgtatattaattagaattctggaatgaggcactttctctccttactattagataaccagtggtactgttcattcaggaaaggaaaggatttaacctgtattatggactgaaaatacatttttttttttgagacagtctctctctgttgcccaggctggagtgcagtggcacaatcacaactcacattaggcttgacctcccaggctcaagtgatcctcccacctcagccacccaagtagctgggactacaagtgtgcaccactatatctagctaatttttgtttgtttgtttttagagacagggtcttgccatgttgcccaggctggtcttgaactcctgggctaaagcagtgcacctgccttggcctccgaaagtgctggaattacagaaatggcccaccatgcctggccttaaaatacaaaacaaaaccaaaaattttaagtagcctttaaaatttttatattttacttttgattaagtcacatgttcacaaggttcacatttcaaaagggtacacagtaaaatggctccctctcacctctgaccccagatattcctcttccctccttggaggcaagcagcattatcagcttctttttctttttatatatacagattttttcttttttcttttttgcttcttcttcttctttttttttttggccaccaagttaccatgagaagcattatcagcagtttcttttttttttttttttttcttttttgagatagagtcttgctctgtctcccatgctggagtgcagtggcacgatcttggctcactgcaacctccacctcccaggttcaagcgattctcccacctccgcctcccaagtagctgggattacaggcatgagccaccacaccccgctaagttttgtatttttagtagaggtggggttttgccatgttggccaggctggtcttgaactcctgacctcaggtgatcctcctgcctcagcttcgcaaagtgctgggattacaggcatgagccaccacgcctggcctatcagtttcttaagtgaccttccagggttatcttacataatcaaataaagcagatcacacacacacacagagacacacagacacatgcacacttttttgcatatacgcctggtaaaatttcatcttcacagttcttgaagatgcttccctaacctactagttataactgggaggtggctctgtgtcaggccaggaagaacttctccactggtttttttgttttgttttgttttgttttgagacatagtctcactctgtcgcccaggctggagtgcagtggcccaatctcggctctctgcaagctccgcctcctgggttcacgccattctcctgcctcagcctcccgagtagctgggactacaggcgcctgccacctcacccggctaattttgtttttgtattcttaatagagacggggtttcaccgtgatagccaggatggtctcgatctcccgacctcgtgatccgccctcctcggcctcccaaagtgctgggattacaggcgtgagccaccaagcctggccttccactgctttttcttggccacagagtgttccacagaatggatgtaccatcatgtacttagtagcagtccccttttgatagacatttaggttgtcaccaggatttcttacatgagcaatgctgcagtgaacctccttgtccacaagccatctcctctgtgctggggtatatcgttggatacgttcttagaggaggagccggtggggaaggtcctatgcatgcatagttttcagagctctccctcagtgccctccgttgtggttgtatcaccctcccaccagctgagtaggggagggcctgttacccccagagcccctccttgtgtattatgtatccctttttttttccccaatctgagagtggacaaatggcatcccagtgtagggttttttttttcttcctctttagtttttgagatggagtctcactatgtttcccatgctggcctcaaactcctgggctcaagcaatcctgcctcagcttcccgcatagctgggactgcaggtgtatgccaccgcacccagcctagtatagttttatttttattttattatttattttgagacacagtcttgctgtgtcacccaggctggagtgcagtgtcatgatctcggcttactgcagtctccacttcctgggttcaagcaattctcctacctcagcctcccaagcggctgggactacagaagtgcgccaccatgcctggctaattttttgtatttgtagtagagatagggtttcaccatgttggccaggctggtctcgaactcctgacctcacgtgatctgcccgccttggcctcctgaagtgctgggattataggtgtgagccaccacgccctgcccaagcatagttttaatttgtagttgggagcaagccccatccatccccagcctgtgctctctcccgaagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccaggtgggtacctggtggatgccgcacgaggcaggcgtccctgcagaaggtaaaactggagagttggggagaagggagcatctgttcactaggggaagggccttcctctgtgagctcagccagtcttcccatgcactgaggttccgaaggcacttgcccagtgtttatcataaacagcttagcctcctatggcagaacttgtggccgggtgtggtggctcacacctgtaatcccagcactttgggagaccaaggtgggggattacctgaggtcaggagctcaagaccagcctgtccgacaggcaaaaccctgtctctactaaaaatacaaaaattagctgggcgtggtggcgcgtgcctgtaatcccagctacgagggaggctgagacaggagaatcgcttgaacccaggatgtggaggttgcagtgagccaagatcacatctctgtattccggcctggatgacagagcgaaactccgtctcaaaaaaaaaaaaacaaaaaaaaagaactcgtgccccttactcctgccacctggacaagtcctcaactgctttcccatgagataaagctggtgggaacctcattcccatttcacagatgagaaatgtgagatctggagaggagccgggacttgtctgaggtcacacagccagggaggtggatgttagggtccctgcctcgggtttggagaagcatggtggacacagagctagtggatttgagaagctggggtggtcccgtattcacctctgttgctcccccaactccagagtgacagagctgggcctggcagtgaagcgtcttgagaagcagaatctggagaaggatcaggtcaacaaggacctcactgagaagcttgaggccctggtgagctgcaggtgcccctgagatggggcagggtgagatggggtaccggccagatccatggacgcaggcttagggctgggctgcctgggtcacccccagcgtcccactcacactcaggttcagccctcacaggtgtgcaggctttgtgggaagcacactcacctccatcccatttcttcctcccagcagccctgtagcataatcctcataacacagatggggaaactgaggcccaagaggggtaatgcttgtccagtctcagagccactaagcgggagagtcgggacttgaactcccatccacgctctccaggtccagatgcggcctctggcaacctagctgccccccacccccaccagtgggacactcactcccccagggtacagcctggtttggtcacccctctgtgtggggcctggcctgggttctaggtccggctctcctgcaatcgactgtgtgacctggggcaggacatagctcttctctgggcctggtctgttcagtgagggcctcgggcctgctgtggggtctaccaggtggctggcctatggacatggcttcagaggccacctggtcagtggtgggccaggtagggagggaaaggggaggtttcagataagacagaaccccaaccaccctttgtctccctaaccgcactccaggaatccctgcggctacaggagcaggcggccctggagacagaggatggagaggggctacagcagaccctaagggacctggcacaggtgtgagcccagagaggcgggaagacagcgccctgccaggcagtcccaggctcccccgccacgtctttcggtgacctgggactgaactgcaaatgggtgggggcctgggacccaggctgtagctgctcagcacccctgctagctcacccagcctctgccttggggagcccccagtctcagaggggaggcacgaccctttgggagcccacctgtgagcaaggccaaatgatgtcttcccaataaatgggaggcctcagcggcgagccgaggactgagctagtggaggaggtgaaatcaggaaggcttcttgtaagaggcagcatttggaatgaggcagcccccagcctcacctgggcgtctttgcccagctaaccccgcggttcctaactcagcagcctccttctgcctccctcccccaccctcaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggtaggaaggggcttgagcgttctgggcgcagccagaggcctgggggaggggctcgcgccctccgggtgggggcgggggcgggggcaggtccggggccagggtccgagggaggagtctgagcgccctggggtgcagccagagccctgagaaatagtttctgagggtgtcaggacccccaaggaggtggccgagagctctgcggtgaagccgagcccagaagtgggggtgcttgggcagctgggggtgggtgcttgggcagctggtggagggaggaggctgcggcagtgttagggtcctggtagagagggagacaggtccctggtcatacagagccaggaccctgggaaaaggtctagcaaggggaatcagagcttgggaactaggggcagagccagggtagggaggagtctgagagtggaaccaggatgcaagggggaggagcctaggagccctgggggtgggatcagaacccaggagacgagtgtgcctgggggtttgtctggcatccggggggctttgataggagttgtccgggaccccagggaggtgagggctcagagggtggcgagggcacataggaggggagcggaagcctggctctcaggcctaggcccctatcctgccccaggccaggtccaggccctggaccccgcctagcgtaggctagtgtgtatccctggaaccagaagagagtaggtggctctggaggcctctcaggcccccccagactctgtgaccccccacaccccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcaggtgccggggaggtctgagctggggggtactgaagaataagtcaccgtctgggcataacaccagtcaagccttatgcgtatggctctgcactaatatggtcgccactagctgcatgtgcctattaacgtttatttatttatttatttttaaaatggagtctcgccctgtcgcccaggctggagtgcagtggcgcgatctcggctcactgcaagcgccgcctcctgggttcacgccattctcctgcctcagcctcccgagtatctgggactacaggcccctgccaccatgccgggctaattttttttttttttttgagacggagtttcactgtgtggcccaggctggagtgcagtggcgcgatcttggctcattgcatcctcctcctcccgggtttaagcaattctcacctcagcctctgaagtagctgggattataggtgcccaccaccacgcccggctaattttttttgtatttttagtagagacggggtttcaccatcttggccaggctgatcttgaactcctgacctcatgttctacccgcgtccatctcccaaagtgctgggattacaggcatgagccaccgcgcccggccaacatttattttttagtattcagttttgttttgttttgttttgttttgctttgttttgagtcacactcttgctctgtttcccaggctggggcacaattggtccatcacagctcactgtaacctggaactcccagactcaagcgatcctcccacctctacctcccaactgcccctagttgggggcctgggcctggcctggggaaggatatgggaccgaagcctgagagttaggtttccactcccttcctctgtgccctcaccaccctctgagccctcacctccctgggttcctgggcaactctgatctcagcctcgaggatagtagacaagccgccaacatttctaaattttttgtagagatgggggtctcactatgttgcccatgctggtcttgaactcctagcttcaatcactcctcccacctcagcctcccaaattgctgggattacaggcataagccactgtgcctggctctattaaaatttaattaaaatttttaaaaagtgaaaattcaggctgggtgtggtggctcacacccagcttgctggccaacatggtgaaaccctgtttctactaaaaatacaaaaattaaccaggcatggtggcatgctcctgtaatcccagctattcaggaggctgaggtgggagaatcacttgaaccccggaggcagaggttgcaatgagccaggatcgtgccactgcactccaggctgggagatagagcgagactccatctcaaaaaaaaaataataataataatgctgggcccggtggctcacacctgtaatctcagcactttggaaggccaaggcgggcggatcatgaggtcaggagattgagaccatcctggctaacacagtgaaaccccgtctctactaaaaatacaaaaagtaaattagctgggcgtggtggcaggcacctatagtcccagctacttggaagactgaggcaggagaatggcctgaacccgggaggcggagctggcagcgagccgagatggcgccactgcactccagcctgagcgacagagcaagactccgtctcaaaaaaaaaaaaaaaagaaaaaattcagttctttagttgccctagccacatttcaagcactcatcaaccatacatggccatagaacatttctgtcatctcagcgagttctattgccagcactattttggactgtatttcttggagttttttttagagatggggtcttgctgtgttgcccaggatggtctcaaactcctggcctcaagtgattcccctgcctcggcctccaaaaatgctgggattagaggcataagccaccatgcctagccttgaagattttttttttctcttaatttgagacagggtcttgttatgtcacccagtctggagtgcagtggtgcgatctcatttcactgcaacctccacctcctaggcttaagtgatccttccatctcagcctcctgagtagctggaactacaggcacacaccaccacgcctgcctaatttttctgttttttgtagagatagggtttcgccatgttgcccaggctgatctctaactcctgagcccgtctcggcctcccaaagtactgggattataggtgtgagccatcacgccaggcaccctgaagatttttaagacaagaaattatccacttcttagctgccaggttgtttttgatattttgttgtttggtttttctcttcataaatgtaaccatctaatgaaaagtttgaaaaataggaataaaaagacagcgccttctcacagcctcatctgcccatcctaattcatttagggcactggttttccttcccattgtgttgcctggcagtgagatagcaaacgtttcctgcacacctactgtgtgccaggctcttggccgagtgttttgtatgtactctgtgatttagtcttcctgtcaaactcatgcaattcggaactctgttgttgtaagcttgagagactggctcagactcatacagcgtgtgtggctgggggtggcagggtgggaactggaattcaggtccatgtgagagtaaacccaagctttccatgcctggaaaggagaaggtctttttaagcagttgtgttcacagcaaacatcccattttgcattctgctatttttacttaacagcacattgtcgactgagcgaggtggctcacacctgtaatcccagtattttgggaggccaaggcgggtggatcacttgaggtcaggagtttgagaccagcctggccaacatggcgaaaccccatctctactaaaaataaaaaaaaattggccgggcacagtggctcactcctgtaatcccagcactttgggaggccgaggcaggaggaccacctgaggtcgggagttcgagaccagcctgaccaacatggagaaaccctgtctctactaaaaatacaaaattagccatccgtggtggcacatggctgtaatcccagctacttgggaggctgaggcaggagaatcgcttgaactctggaggtggaggttgcagcaagccgagatcgtgcactgcactccagcctgggcgacagagtgagatgccgtctaaaaaaaaaaaaaaattactgggcgcattggctcatgcctgtaatcccagcactttgggaggccgaggcgggcaggtcatgaggtcagaagattgagaccatcctggctaacacagtgaaacccccatctctactaaaaatacaacaaattacccggacatggtggcgggcgcctgtattcccagctacttgggaggctgaggcaggagaatggcgtgaacccgggaggcggagcttgcagtgagtggagattgcgctactgcactccagcctgggggacagagcgagactccgtctcaaaaaaaaaaaataaaacaaaatcacgctgtgaagttttttcgcacctatggccagtggggaacgtggcagctcatggcaagtctttggggtcccagttgttcccttctcctccctcccctgccgtggccaccatgtgcctgtgtagcaggaagctgtgggatctgcagactcagctctatcaggcttcccagaattgaggggcatggggtgttataggggacatttcctggtcacatggcctagcagagctggtggcacaattgccgtgtgtcccaggagcctagctcggcctcttctacctggtagggtgcttggagatcacaccagcacctccatccactccaagtgggcggactggagagaaggaaagccaggttcttctgctggagtgtgtgagtgaaatgagtcagccatggacagggtggtcagggaaggcttcctggaggcaggtgccttggaagactggaggatgtagctcatggctagaggagcagccagccaccttccctgcagagagcagccccagcatcccctctgctccccctccccttgtcctgaagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcaggtgagcagcatctcgccaccctgccaggacccttcagatgtgcctcgggtcccctgacagtgcccccctggggttaggtgacacccactgggtcctgggcctcctaccgtctggacccctccgatgtcgggttttctaaccagacccatttcaggaaactggggctcagggaggtatagtcacttacctggagtcagagaactagttaaaaggtagaacttggatgataataacaagaataattaaaataacagtagtaatattagcagtagtattttaaaaatttagttagaagaataataatatccttactaatttcactaagtgccagataccattttaagcaattcagttctctcatttaactccatgataactctgtgacatagaagcggttatctccattttgtggatggtaaactgaggcacagagaagccatgtcacttgccccaggtcacacagttagcagaagagccaggatttgaacccagacattctgccttcagagttaacctcttcaccactgcgctgcttacctctcagggacgtgatcgatgatgatgtttagtagactgtggtggagcatgttattcttgtttctgaaggtccttggggagatgtgtcaggcactattttaagcacatgtgaagtttgtatccttaaaacaggccgggcgcagtggctcacgcctgtaatcccagcactttgagaggccaaggcaggcagatcgcctgaggtcaggagttccagaccagcctgaccaacgtggagaaatcccgtctctactaaaactacaaaaattagtcaggcgtggtggtgagcacctgtaatcccagctactcgggaggctgaggcaggagaattgcttgaacctgggaggcagaggttgcagtcagccaggatcgcaccactgtactccagcctgtgtgacagagcaagactgtgtctcaaaaaaacaaacaatgtcacgaggtaagtgttacctcattttgcagatgtgaaaacggaggcccagggtcatggagctaagcggtagtgggcttggttgccctgtggctcaggctgtttctctccaaactcctgcctcaggcctggtccccagcccagcatctcgctggctacaggaggttcggggcaggaaagtgacatgggccacccacccaccctttgtcccacagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggtgggtccctgtctgctgcacaaccacaaacctacctctgacccccagccccaagccttgtcactctggcacagactggtcccagtgtcaggcagacctctgagcctggtcacagactgaccccttccttctggatacaggctgatctttgtcacaggccacagacctctggacctctggtcccagccataagtggactgacctctctttatggccgtatccctgctcttctggatgctcctgggggcaatgcctatagctcagggtcatccagtgcctgagactcagctcctggggtctgagagttgtggccacagcgcagagggtccttggcaggggggcctgcgctgtccgctgcagcctgggctctgagcagtgctatccctagaccctactcaggggatcctctgaactctggccctgccctgcagcttgagctatttttgcacagctctgtggtgtgtggcttttaaatggctcataagcagcaggctttctgcggtgatttttttttttccatctcacactgtgtcccctccttgtctcccctaccctgtctctgagggtccatctctctgggtctcttcttgggcctcctcacctcctcccgacctttctgcctttcctcatttctcggggcctgaccctgcaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccaggtacgctgtgcacctgcgggcccacctgccttgcccacccatcctccccactcagtgaggcaccccgggcccagccctgtacctgtcttggcccctgcctccctttctgtccctggttctctgtctgtctctggttctctgtctgtctgtctatcccctctaggcgtcaaagcacagaagttccatgggccctcctcatctccccctccccagtgtcccatacacccaagggcactgtccctcattccctgggagcctcccctgggctattgttgctggtgggtgggtggaggaggcgtcctggtcctgggagggacgccctgctcacgaggccccactcctacctggcctccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcaggtgggcaaagctgtgtgtgggggtggtgtggagagcatgtggggcaggccgggctcccagccccctgcatccagtcctgggttaagtcacaggcactggagcctgcttctgggttaaatccagccccacttctgctagctggggaccttggacaagctgcccaatctcccatacctcagttgccccatctataacatggggccagccaggcgcagtggctcacgcctataatcccagcactttgggaggccgaggcgggtggatcacctgaggtccggagatcaagaccatcctggctaacacggtgaaaccctatctctacaaaaaattagctgggcgtggtggcacgcgcctgtagtcccagctacttgggaggctgaggcaggagaatcgcttgaacccaggaggcagaggttgcagtgagccaagatcatgccactgcactccagcctgggcaacagagcaagactccgtctcaataataataataataataataataataataatgatacagattaataataggtggagactttttagaattggaatcttagacttttgggaacatcacatctggaagagaccttaatgtttcagggatccagggaccttcatgcaaggtctatcctggagcgcctaggtttctgggaggggcctctagaggatggggtagggggtgcaggaagcagggtgcaggtctccaccttgaggcctgccgagcagctgcacttgggtctggtttatatattcagcttctctgcaagtttagagtaatacaagggttctgttactcccagagctgagtgagggccctcattttttttgtttcattttgttttgtttttgttgttgtttttttttccagacagagtcttgctctgttgcccaggctggaatgcagtggcacgatctgggctcactgcaacctccgcctccagggtttaagctgttcgcctgcctcagcgtcccaagtagcagggactacaggcgtgcaccaccacgcccggctaatttttgtatttttagtagagacagggtttcaccccgttggccaggctggtcttgaactcctgacctcaagtgatccacctgccaaagtgctgggattataggcacgcaccaccgtacctggctgggccctggtttttgtacacacgtgcattgcagatctagagaaggtcatgacttgcccaagtacatgtagcacatcagggcagaccctgggctcaaacccaggccttctgccaggactgggttaggcccagagttggggtgctgcacgatgaacaagctgggggacgctgggagtgctactcagtctctgggtgggggccagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcggtaaggccttgggctctgcccaacccgccctggggggtcctcctggggccacaccatgaccagccacacgcaggcacgggcccccaggggcagttactaaggagtctggcttgccgactcgtcctagctgtggctcaggcttccccagggagtgtgggcctggccaggcaggtagattggcacttggcccatgcctggccactccctgagatccacagtttcctggggccagggaggctgagtcccagggcctcagggactgtatgtgctgcagcttggagaaggaagccctggagggcagcctgtttgaggtgcaacggcagctggcccagcttgaggcccgccgggagcagctggaagccgaggggcaggccctgctgctggccaaggagaccctgactggtacgaggggctggggacttggggggaacaccaggttccagcccagactgcagcctcccaaggtctggggtctcacagaagttgggagcactggagtaggagtctggctggcctgggttccagtcctgtgccaccacttagatctcaccttcccttgagcaagcccctttcctctctgggctgcagattcctcagctgatgattggaggtggcaatgcccaccttctaagcctgttgccaggatgacgtgggaaaagcgtgtaaggccgtggcacggtgcctggctgagtcaacagtaactgccgttcatcggtcatcaggcctgttagtctgagttctctgtgcttttcagatgactctcttggccccagaatcccagccccacttccctgcaccgttcccatccagtctctgaactcagggcttctttctgctcacctaacattaactaagcacctacttgggtcatggaaattaattttcctgtccatgtacacctgagccagacagaaccaggaagggaaatgctggtgggtttccaacccgggagatggtttttagatggtagctataccatttccattccctgtagtcatttccattaatataaatagttaacgtttgacgggtatgttcatgtcagtcattaaaggagatgctttatgtgtagctgtgcagctgtgggaagttgctgctgatctctgagcctccatttcatcatctgttaaatggggatgaggataaactacataggcatgttatgaagacaaaatgaggttatgtctaaaatacttagctgggcgcttgacccatagtaagtgctcagtcaggaatagggttgttttttgtttgtttgttttgagacagagtttcactcttgttgcccaggcgggagtgcaatggcactatctcggctcacctcaacctctgccttctgggttcaagcgattctcctgcctcagcctcccaagtagctgggattacaggcatgcatcaccatgcctggctaattttatatttttagtagagacggggtttcgccatgttggtcaagctggtctcgaactcttgacctcaggtgatccacccgctttggcctcccaaactgctgggattacaggcatgagccatcacgcccagcctgtttgttttttgagacagagtctcactcttgttgcccaggctggagtgcaatggtgcgatctcggctcactgcaacttctgcctcctgcattcaagcgattctcctgcctcagcctcccaagtagctgggactacatatgcccgccaccatgcctggctaatttttgtatttttggtatagacagggtttcgctgtgttggccaggctggtctcaaactcctgacctaaggtgacctacctgacccagcctcccagagtgctggattacaggcatgagccactgcgcccggcctatttgtttttttgaggcagagtctcactcttgttgcccaggctggagtgcagtggtgcaatctcagctcactgcaacttctgcctcttgggttcaagcgattctcctgcctcagcctccctgaggctgggactacatacgcctgccaccacgcctggctaattgttgtatttttagtagagacagggtttcaccatgttggccaggttggtcttgaactcctgacctaaggtgatccacctgccccagcttcccaaagtgctgggattacaggcgtgagccaaggcacctgacctagggttgttatatgtttgacatccgtcccatttgggaggccttctcatcagtcattttatgcctttaatgccattctaggtaggcaggaaaggggtcagggccagtgggcccatgtagcatatagggaaactgaggcccagagagggcaagccacttcaagaggacccaaactagatgccaggcaggccctctgcctctgggattttgcccatgtggctcacctggcctaagtctgctggcccaaggaaaagtttcaacccaaccctgccctttcccccattcctctcgtgcaggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggttcaggcagctggggaggggtgggcaggactctgagccagtgtttcatcatcgttcttgctctgcctcggtctctacatctgtgaaatgggacttcctctctgttgtggaggtcctggggacagctaggaggactggggggatggggaggttgtggttcttattagacatgcagattcccaggtcccaaatctggtccagccctggtaatcctgatgcagagggtccacaaccacatttgggaaatactgacctaatgtacagcaggaaagcactttcatttgctaagaagtactgtttgcatatgaagagccactcagacctcagcatatagaaaggcaaggggccagggaagttactagaacactgactctgggtttgaattgcctgggtttgaatcgaatcttggtcgcttactggtgatgctacccaaggtgtccgtgccttcatttccccacctgtagaaatagggataggatagtgaaaggtattgaagatgagctgagaccatctgcatagagggcttagcatagtgactggtacttagcaaatgctccataagttatgattgctggcactgacatgctctccagagtggccctcgggacaggggccctcagccaccaaatcctagacagggctgcctctgacagaggtgcaggctatgactgcatggctccagggcatgccactcaccctgcagtacccctggccttgggtggttgttaccacgcttctccaggaggtggcggtaaagctcttttttttttttcttttttctttttttgagacggagtcttgctctgttgcttaggctggattgcagtggcgcaatctcggctcactgcaacctccactttctgggttcaagcgattctcctgcctctgcttcctgagtagctgggattataggcgcgccaccacgcctggctaatttttgcatttttagtagagacgggatttcaccatattggtcagggtgtctcgaacttttgacctcgtaatctgcccacctcggcctcccaaagtgctgggattacaggcatgagctacggtgaagatcttaaagaaggggcggtttggccggtcgtgctgactcatgcctgtaatccagcactttgggaggccgaggtgggcagatcaccaggtcggaagatcgagaccatcctggctaacacagtgaaaccccatctctactaaaaatcacaaaaaattagctgggcgtggtggcacgcgcctgtagtcccagatacttgggagggtaaggcagaagaatcgcttcaacctgggaggcagaggttgcagtgagccaaaatctcgccactgcactccagcctgggtgacagagcaagactccgtctaaaaaaaaaaaaaaagaagtggcagctctgtctgcttctcacagagttgctaggggcaagtgctgaggcaggcacctgccctcaggctccccaggtgggctgctatttgcctgtgggctctgcctgcccgcctgtccagtccccagggatctgaactcctgtgacctcccccttgctcttcttgccctttgcattgcctggcttggcctcattaatgtccccaaatctgtgttctctccagctcctctggcaacccctgacccccttcattcctcacagccagtcctaactcccctccatcccaaccccaatccctcttccacagctgtcggaacatcccctaagctaaaaatcagattgctccttgtcaccttggctcgagtcctctctcccactcccctcactgtccttagaatccccatggcccacacggcctgtcctggccccacccctgcctggggctctggccctgtgactcaccatgtcccgttcccctctgcaccctgcatcctctaggcctttccaggggctgtgttcttggcctggggtggtcttttctctccttacctggctgacagttacttgtccctccgcaggggaccatgttcggacccccaggccagcccactgctgctccttggcactttcacggccctggcgtgtccccgtcatagcccttatcactcccttgtatttacctggtcaccctccatctctgagggtatgggggccagatggctcttgctgccctgatgttttggggggtctgcctgggccccctcctggtgtgtcacaggcatccggtcctggccccctaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggttcgtgagccctggcatggcctctgctgctctctgagctgctccagttctggggccgggccctgctctgccacttggcagctaggagccctggggcaggccactgccctcttgggggcctcagtttccttacctgcaggaggggaggattagaagggggttcgtgaggctttgctgtgctccatgcctggcacacagtgagcacttactgagtgacagtgacagtcgtgacaccaggaaagctgttccatattctcccatgcctcgtcccaccccacgctgggcatggatcctcatggctgccttctgagcagtccccacgatgcccacaggcatcagctgacgtgtccccccaaataacaaatccctaactttcctataatgtaacggagacagggcagactgtgcccatctcctctcctcaccagctgtgtacctgggcgagtcactttacctccttgagcctcagtttcctcatctgtaagatgggtagaaagaaagactctgcagtcagggtgctgtggcgggttagtgagctctatgagtggtatccacgtccgggattcttgtgactgccgttgtgcccttttccagggctgcatgtctgccctgggtccacctgcagtggcacactcaggcctctaagcccccagtgggcacatttcctaggcagcaagaagcctgagcatgcccccaggaccagcccatcccccaagccctttgtcccctgcctctgcccaggccttgtctctgaaggagtctgagaagacggcgctgtcagagaagttgatgggtacacggcacagcctggccaccatctccctggagatggagcggcagaaacgagatgcccagagccggcaggagcaggaccgggtagggcaggctgggcagctgggcctctgtctcatagagaggcacatccctggctgaggagcccccaccacggggcggcatggccctgtcctggagaagcttccaggctgtgggaaaggaggtttagcccttcttttgggagcccccatctgagggaggtggctcagccctgccctgatgaatccttttggcgtgagggagaggctggctacacgggcagcactcactatgcatccaggggttggcagagggtccggcaggccagcgggaggggccgtgtttagagctaaaagtggacagtgcactgagcgggttgggagcagcccggggctgggggacacagcaggaccaagtctgaggagcccctctgtcccagagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggtgagcagccgcccccctcttccaagcagcataccctaaatggcactgtgtgcctgggggcctagttccccagggccccagaagagtgtaagattcctccctgcatttgaggaccaatgaatagcaacttagaaaggaggcagcaagcactacgaagcacctgttgtgtacaggtgggatttggcctcaaggaggggtgagtggggtctctgccctcttggtgttgtgctcaggacagtcctgattgatggtgacttcaggtcaaaacattactgattacagcacgccttgctcaaatgataactcacagcctgcggtctgagcactgcagagggatggggcaggctccctgggtccagggatctggggtacaagacccagcttgacgggggggtccctgaccgctgccctggggacacctgctgtgctcacaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcaggtggggtgtcgcaggaggaccagtcctgagtcctcatgggatcccatccctgaaacctaacttcacccccaacgttctggggaaattgcccagatacggatcctctgtctcctaagcagagcctggcacctgggtgattttaggaaggtttcctccctgttgattggggaaaggggcagaggggcagtgggcagctttgggtccagactcagacccacccaccgtcatcaccctggaaaccaggtcccctcctggagtcactggtctacccctcccagccgagggcctgggccccagccctgcagggctcagggcttagctcttcagagaggccacatgggcaggcagtgcctgatccactccagaaattggaggagacggcttttgtgtagagccactgactactcccaggacccagggcagcccctgacctctgccctctccagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcaggtactctccctgtgccaccccttagcctggggcttgctgtgtgccccgggccaatagctccccctttctggaattacgtttctacccctatgtaaaaccaggggcttgaactatgacaagccctctcacctaaccttggtgtgaatggatgggctttgaggagtccttgaatccctgaaactgtgcaaaagtctgcgtgcatttgtgtgcacactcaggctcacatttctgcaaggagaggagctggtgtccttgtccagttctcaaaggaatctgcaaacaacaaaaggtacagattttgtgaactaggtcagaggttggcaaatggttttttgtaaagagcccaaatggtcaatatttccagctttacgggccacacagtctctgttgcaactacttgactctgctggggtagtgagaaagcagtcccaaacagtgcatgaacagaggggtgtgggttccagtaaaactttgtttagggacactgaaatgtgaattttctgtcattttcatgtgtcaagaaatgttgttcttcctttagaaatgatccattttcgatgatttaaaaatgtaaaaaaaaaaaaaaatccttaactcagacccttgtagaaacgggagatgggctgaatttggcctgtgagctgtagttcgctgacccgtgaattcgatgatctgcaaactcaacagcagcatgtattgaagaagcacctgctgtctactgggcactggcctggacactgtgggttcaggcttctcactctagaagatgcaaagaacaggaaatggcctcattcagcccctaggcgctgcctcacccagagatatcacaaccaggccaggcgcagtggctcacacctataatctcagcactttgggaggcggaggccagtggattgcttgagcccaggagttcgagaccagcctgggtaacatggtgaaaacctgtctctactaaaaatacgaaaaattagccagctgtgatggctcatgcctttaatctcatgctttgggaggccaagttgggaggactgcttgagcctaggagttcaagaccagcccaggcaacatagtgagaaccagtctctacaaaaaatttaaaaaatagctaggtgtggtgacacgctcctggagtcccagctacttgggaggctgaggtgggagtatcccttgagcccaggaagtcaaggctgcagtgagctgtgatcgcatcaccgcactccagcctgggcgacaaagcaagaccctgactctaaaaaaagtttttaaacttttaatttttattttatttatttatttactttctgagatggagtttcactcttgttgcccaggctggagtgcagtggcgcaatctcggctcactgcaacctccgcctcccgggttcaagtaattctcctgactcagcctcccaagtagctgggattacagatgcccgccaccacacctggctaatttttttgtatttttagtagagacagggtttcaccatgtgggccaggctggtctcgaactcctgatgtcaggtgatccacccaccttggcctcccaaagtgctgggattacaggcatgagccacgatgcctggcccccccaaatttttttaattaaaaaaattgtttttaattacaaaaaaagagatcacaactggatagccagagatattctgatactctgatagccagagataccacagcccccttcacccaggccccttcctgagaaaccacaagactcccggaaaggagctggcatttgcgtgccagcttttgctggacgcgttgcatgctacggcctctcctgttacccctgctgtagcacatgggggaggtaggcagtacccctccctgctcctgtggggaaataggggcttagaacattgccgttgtctcagatcgaatcccagtctggtgtgtgtgggctgtgtgactttggggaggttactctgacactctgaggctcagttttctcatctgttagatagggataatgttactacctacctcatatagcattgtaccaagattaaacgagttaatataactgaagtgcttagaacaggactggacacatggtaagcgctccaaaaacgttcatcgccatcgtagaggggaaagataacccagggagctgtggttcctgcctgtgaactcctggtctgctaagggctgagccctccttctattatacccacccctttatgaaaggtagttttggcccattgattaagtggtaaacaggccactggtgcccaagtgcctggcatcgcccaagttcagtgtggttgtgtaggggccggctcccagtggatgtggggtggtatttgatacatgtgtccctacagcagtaggtaccaagtggccttgggccagaactgggagggtacaggggcagagctgaacctgctgccattcccgtgctctcacagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggaggtaactgagcaggcgggcaggctggtgcatctttccttcccccagcaggaagcaggtgggcaccccaatgctggggccattctgaaaggccactccctagggcttgctccttcccccactccttgagactcttccccagttgtagtaacaacaacccaaagaacagtgggcctactgtgtgccggcacaaaatgggtagggagaggccctgtagatacaaccttgtttgatttccccagcagccctatggggtaggtactgttagccctttttatttagttatttattttgaaatggagtctcactctgtcgcccaggctggagtgcgctggcaccatctcggctcactgcaacctccgcctcctgggttcaagcaattcttctgcctcagcctcccgagtatctgggattacaggtgcttgccaccacgcccagctaattttttgtatttttagtagagacaggatttcaccatgttggtcaggcttgtctcaaacgcctgacctcaggtgatccacctgcctcggcctcccaaagtgctgggattacaggtgtgagccaccacacccttcctaccattagccccattttacagagccctcagagaggtcgagggatctacccaaggtcacacagccacctaagtctgtctgactccaaagcccacaggctacccgctctgccttttccggctgtttcattgccatgaatctgttgtgtggcctgaaccaagtcacgtcatctctgtgcctcagagcgctcatgagagatgggctagcacagccgagcatgtatgaagggccctggcacaggtcctggcaaccagctgctcagtagatgggtttccagtgaaactggtgaccgtgagaggttgactctctaaatggcaggggtggctttgtgtctgtgtgaccatgcatcccatcaggaaatgatattttagtgcatgcccccattgtgtgcaaatttattgataaattatgggcaagggcggcaatgtagcctagtggttaagggaacagcctctggacacagctccctttggaaccagtgggcacttaaccttcctggctgttcactgtgttctcaagtgcagcccacagcccccgtgtggccccgtgtggtatgcctccccgcctttcccccaccccccagggctgtgagtacatgtgattaataagctgctgtcaagctattaaaaacaaaaaacaaaaaaaaaaacagaaacaaaaacagccgggcgcagtggctcacacctgtaatcccagcactttgggaggccgaggctggcagatcacttgaggccaggagttcgagagcagtctggctaacatggcaaaactctgtctctactaaaaatacaaaaattagctgggcatggtggtgctcacctgtaatcccagctactcggaggctgaggtgggaggatcacttgaacccaggaggcagaggttacagtgagctgagattgccccactgcactccagcctgggtgacagagctagactctgtctccaaaaacaaacaaacaaaaacccacaaaaacaacaaaaaaaacagcctttggagctagagtgcctggctttgaatcccagctctgcagtttactaactctggccttggacaagttacttagcatctctgtgcctgtttcatcttctgtaaagtgagatcgattcatagagtagtaattagagttaatattttttggaaagttacttagtgcctggcactgataagccctatgtattcaaatgccagctgttattactaataaactatgggcattacaaggcttgtataaagaataaagagattaataaacaagttctagtatttcctcccacggggatgtttttgcaccgcctgcttgagtggcgagcactaaaggagaaagggttgtactgaccacacagtcagggatggtgggctccagtctgggccttaggggtggggcgtcgggttgggagaggtcttgccgacctccacctcctggcatcactccagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggctgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggtaagggcagtgccgcgcgcagggaaggggggaggtgggcgggccgcactgaggccccgcccccacatggcagggtgtttttgtttttgtttttgttttttttcaaggagcccaccacacctctccactgaggtccacttcttagccccgtcccctcaccgagacccctcccttcactgatctgtgcttctcaagggcgcttcttttttctttagaccaggcctcatctgtttcccgggctcaagtggtcctccctcctcagcctcctgagtagctgggactacaggtgtgccaccacgcccagctaatttttgtagtttttgtggagacggggtctcactatgttgcccaggctggtcttaaactcctggcctcaagcgatcctcctgtctcagcctctcagggttgggattagaggcatgagccacggcacccggtctaggccacttatttttttggggaagtggggtgattcttttttttcaacttttgagacaggatctcactctgtcacctcagttgaagtgcagtagtgtgatcttggctccctctgccttggcagcctgtgcctcctgggctcaagtgattctcccacctcaacctcctttgtagctgagactacaggtgtgcactacaatgtctgcttaatttttgtgtttttagtagagatggggttttgccatattgcccaggctagtcttgaactcctggactcaagcgatcctcccactgggattacaggcgtgagccaccgtgcctttcctggaccgggggctggagggctcttaatgcctttgactccttatctgattttctgagcttccatcctgccatatactcccacatactttcagtcatctctaggttacttaggataccaaatacagctaagtggaaatcttacacttgttacactgtattgtttttaattattctttttgtttttttttgagatggcgtcttgctctgttgcccaagctggagtgcagtagcacgatctcggctcactgcaacctctgcctcctgggttcaagtgattctcctgcctcagccccctgagtagctgggagactacaggcgtgtgccaccacgcctggctaatttttgtatttttagtagagacggggtttcaaggctgggcgcggtggctcatgcctgtaatcccagcactttgggaggcagaggtgggcggatcacgaggtcaggagatcgagaccacagtgaaaccccgtctctactaaaaatacaaaaaaaattagctgggcacagtggcaggcacctgtagtcccagctactcgggaggctgaggcaggagaatggcgtgaacccggaagatggagcttgcagtgagctgagatcccgccactgcactccagcctgggcgacagagctagactccgtctcaaaaaaaaaaaaaaaaaaaaaaaaaaacaggatttcagcatgttggtcaggctagtcttgaactcctgaccttacgtgatctgcccacctcagcctcccaaagtgctgggattaaaggcatgagacactgtgcccggcacacctggctaatttttgtgtatgtgtgtgtgtgtatataaatatacatatatatatatgtatattttttttttttaggagagatggggtttcaccatgttggacaggctggtctcaaactcctgacctccagtcgggatgatctgggaacagatgatggtgatggctgcacaacagtgtgaatgtaattcatgccgctcagttgtacacttaaaaatgatgaaaatggccagacacgttggctcatgtttgtaatcccagcactctgcgaggccggagcgggtggatcactcgaggccaggagttcaagaccagcctagccaacatggtgaaaccctgtctctactaaaaatacaaaaaattagtcaagtgtggtggcagacgcctgtaatcccagctactcgggaggctgaggcaggagaatctcttgaaaccaggaggcagaggttgtggtgagccgagatcgcaccattgcactctagactgggcaacaagagcgaaactccgtctcagaaaaaaaaaaaaaaaaaaaattgggcaaagccaaggtaggggctagggcagttcatgcgggggcagcaggtgcctcactgaggaggtgatgggtaaggggagaacgtgagcgagcagctgggagggggactcggggcgagtagggaggtcctgagtggaggtgcgcctgtcctgtggacagcaggggccagcagtcccagagcatcaagcaggggggtgagatttggggacgaagggcttgctccaatagacattataggcctctacggggacttttaccctgagacgatgggaccttctagagctggaggcccccaggggcaggcctgcttctttgggaacctctgagcgaggccttttgggtggtgaccaagttcatggctgcggagcagttttggtgtccctctgcggccaaggcaggatgctcatggcaggacccgtgtcctgcagttccagtgccagcctccaggtagtgccctggttccacccgccctgccccctccacctccccgggccatcactccaagcaggagtgctgccagggagtcgggctgcctggattcccatctcagccctgaaacttcccagcattgagaacaaccaaatcactttgtttttgtttttttttgagcccaagtctcgctctattgcctatgctggagtgcaatggcgcgatctcgactcactgcaacctccgcctgctgggttcaagcgattctcctgcctcagcctcctgagtagctgggactacaggcgtgcaccactgcacccagctaattttttgtatttttagtagagatgggggtttcaccatgttggccaggctggtcttgaactcctgacctcaggtgatctgcccgcctcggcctcccaccagagtgctgggattacaggtctgagccaccgtgccgggcccacttttttctttttcttttcttttcttttttctttatttttttttttttttgagacagagtctctctctgttgcccaggctggagtgcagcacagtctcagctcactacaacctctgtctccagggttcaagtgcttttcctgcctcagcctccagacctcagcctcccaggtagctgggactataagcgtgggccaccatgctcagctaatttttctcttttcttttcttttcttttcctttcttttccttccttccttactttcttttcttttctttcctcttctttcttcttttttttgaccgagtctcactctgttgcccaggctggagtgtaatggtgcagtcttagctcactgcaacctctgcctcccaggtcccagttcaagcaattctcctgcctcagcctcctgagtagctgggattacaggcgcccgccaccacacctaatttttgtatttttagtagagacgggttttcaccatgttggccaggccggtctcgaactgctgacctcgtgatctgcccacctcggcatcccaaagtgctgggattacaggtgtgagccactgctcccagtcttttctttcttctttttttgagacggagtctcgctgtgttacccaggctggagtgcagcggttcgattaggaacactgcgagctccgcttcccgggtttaagcaattctccaacctcagcttctcgaatagctgggattacaggtgcatgccaccacgcccagctaatttttgtatttttagtagagatggggtttcactagttggcaggctggtctcgaactcctgacctcaggtgatccacctgccttggcctcccagagtgctgggattacaggcatgagacaccgcacctggccaatttttgtattttcagtagagacggggttttaccatgttggccaggcttgccttgaactcctgacctcaagtgatccgcctgcctcggaccccacagtgctgggattacaggtgtgagccaccacacccagtcaacagaacaagcaaatcacttaactgctttgtgccagccttgcctgggaagagggtaaattgttccttacctgtcaggaagttgttgtgaagatgaagtgcctagcacagtgggcactcagtatggagagacttgaggtgatgcagcaaccacccttgcactgggccctgggaacagtggtggatggaagagacgaggcccagccctcatggtgctcctggtcggggtgggggtggcagacatcagaccccgctgagggtgggatgagctcactgtaatccagcctgtggccagagaggcctctgagggagagggatggccctaaaggatgggccaggcaaagagaggccatggggagaaggggagcagcatgtacagaggccctggagctgggacaaagaatgttctagaacatgggagatgcagggtggccagtttgtaaagggtgagagggtttcagctgggatgggcaagaagacccctaagctatagcagagaagttgggcttgattctgagggctgttgggaaaggcagggatgacagtgagtgagatgtgtgggaggcccgtggcttctgcatcactgagcaagtcttctttctcttctaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggtaagcctgggtgtgcatggctggatggggaacctggagggccctggggaggttgcagggtgtcagagcaggggtctgtctttgttcccccatgtcggggctacaggacgaacttcggacccagaccagtgccctgaatcgccagctggccgagatggaggctgagagggacagcgcaacctcgagggccaggcagctgcagaaggcggtggctgagagtgaggaaggtgagtctgatcctcggggtccctgttctctctcctgtgttttgggcagttgaggcaggagccgggggattggcctctgaccttgccgtggcccccatgacctgactcggggctgtctccaagaggaccctccttggacagcctcacctgtgtgcaggcccgcatactacgaagggtgcagacagtctggccctgcactgggtggagtgcaggctggacattttgtgacctggtttgggtctcggggctgtgcttggccatgcctgacggggtgggtggtggctacagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggtgggcaggagctgagggccagcggggcgacggggaatctgtgtacccgagtgagtgtctaactcttatgtgtgtctccctgtgtctgtctgcctgagtctctctgcaacccactgaggtgaccagcctgtgactctgtgaaaccatgttcagactccatcctctcatgtcacttgtggtcactaggctgtagaaaaaagagcttggtcaaggtgcagtagctcatgcctgtaatcctagcactttgggaggtcgaggcaggtggatcccttgagcacaggagtttgagaccagcctgggcaacatggtgaaaccccgtctctatgaaaaatacttagctgggcatggtggtgtgggcctgtagtcccagctactcgggaggctgaggtgggaagatcactggagcccggtaggtcgaggctgcaatgagctgtgatcatgccactgcactctagcaaggcagagtgagaccctgtaaaaaagaaaagaaaaaaaaaagaagaagaagaagaaaagaaagagagcttgggctttgggctgtcatctgcctggttttcattttcctaatctgtaaaaggaggagcagtgattacgtcacagggtgacacacacaggctcttatcacaggtggtactcagggggcctctgttttatgtctctgtagttctggggtttttatgtgtgtttgggggacagctatgtgtgccagtgtgtatgtgcgtctgtcgggcaggaaactcaggccctggtggtgacagtgcagccaaagctcccctctgccctccccagcctgtccctctattactgcttccccccaccacccccgcccccaaggcctctggcctggggccgagcttagctggattgttgtgtctgcggcttcaaccctggccatgggcccagccgcaggggctgcaggaggaggccaggaacaaagctgggcaggagccagagtgggggccccagacagggcagggctggggctctgggcagggtggcagaggggccaggctcaggataggggctggggaggctctaataacaccccctgttgatccaccctgtctctaggatagtaccagggatgggaggacccctagtctgccttcctgtcccatccccactccccaggcctttttcactggctgaccctgggcaggggagggggaatcaccacctgaaaccctagaacagcagggccccctcagaactgtccggctcagctcagtttgcacgagtcagtggggcaggagaagggccttggaatctgcatttctacagcccctcctcagggctcctgtgagcacccaggttgtggtaccctgggaccaatccagtgtccctactgtacagatatgaaatggggccatagggcgcgaaggggcagtcctgggttccacagcccattggcctgggctaaaactggaaggtgggctctgggatcttcacgtccactcatcctgggaacgcatggggagaccgaggaccccagagggtcccaggccggccccaggtcacgtaggtcacccttcgaggctgctccccactttccccctaagggccccagggcgtgtgcgggagggctgcggggtgcactggacgtctgggcctgagccccatgccacctgcaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtgggcccctccccaaatcacagccacagtgttcacatgccctgtgccaagagctttgtaggcactacgcagtcccccaacaaccctgtgaggcaagtattacccacatccccatttcacagatggacaaatggaggctgagaggtgatgtcattgtctaagatcccatagctagtaagaggcagagccaaaattagaattcaggactatttgatgacagcatctgcatacataggagtcatctgggacaagttagagatgtaggtttcactcatttccctttttgccttgactgctaggaagctcagctctaactggaatgttaaataatacggctagccttgcctgaacacccaacaaggtcaaaaataaaaaaattttagggtcgtggtggtttccctttctcttccacagcagagaggagagaggagtgaggacagggaggagaccagggagtctgagacaactaggttgatggcactctgggcactagtagttagccagcaatgggatggggcccaggtggcagtaggctgagccagcaggagtgcttaggaacactgggtctcaatgatggaggcccagagagaagtgggaagggtgtggattgggcatgccaggtggaggtcacagtgggagcagaggtatagaggccagatgggaacagccccgattgttctggctgtcctcctgccaggtggccgacagcgaggtgaaggcagggaccctgcagctgaccgtggagcggctgaatggggccctggctaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggtctcgggcccagggtctggctggggtgggcccagtgagagagtcagccagtaagagcaggcttggaggggggccctggtagagagccagccaatggggcagtcagttggagccaatgagagcaggctttgaagggagggcgtgggcccagtagaccatcagccaaggagaagaggctctgggtatgtcccgtaagaagacaaggctactggtatagacttggggggacccaggggcagggtttattggggagagttggggtctgagtgggtcccaccttatgcaggtcagtggataggccgtggatgggtttggtgtgcaccccaccctccaggtgagatgactgcctgttttatgctctgtggacctgtccagaggtacagaatagagaggactccttagggctcccaggccagccaggcaccatcagcccctgtcccccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgagggccagggtgtgccccctctgtccccaagactgtgaggccctaggatagggtggggacgttcccacccatctcaacctcatcccaaaccctggtgcagcctccagtaaggaaacatggttcattcagagcatagtcctgttatacagatggagaaacagactgagagagacaggtttggcttcaggtgacaattctctgatgtgggcctcaccgtcgcctgctctgtgagtgggccagcctcattgtccccaagcttcagataagtatgctcaggcccagagggattcggggcctgcctggcttctgttgcaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtaggctgctccccaggctctcccctcacttcctctggggcctaaccgtggtggatcccactgcacatccccagggtctgctacctctggtggggttaggttattccatcagggttcaggaacctgagccccctcagtaagctcctcctggcaccctgatctcctgtggctctcctgcctaggtggagcgggagaagcttcgtagccatgaggacacagtgcggctgagcgcagagaagggccgcctggaccgcaccctcacgggggctgagctggagctggcagaggcgcagaggcagatccagcagctggaggtctgaccccacccagtccgggaccccaacttcatccctagtatgagtgctcagcaattccagtggagctgatggcccagccagcccagggcccataaccccctcccccaggagccctgagccttccagtgacccagcgggccatggagggatgggttctccctaaggtgtacagaaaagacacgaaaggcctgtttgcacgtgagcctgtgggttcatgtacgttgtggccatgcagcagtgtgagaatccatgtgacgattcttgtgtatggagcatgaatcttgtgcatggtgtggcgtgtctaggtattatgaatatgtgtttgtgtacagatgttttcatgcatgggggagttgggcctttgcacatacacatgcacctgtgtgagtccagataggtatttacatgcttgcctttgtgcctgtgtgtatgatgtctgagtgtgtgtgtgtgtgtgtgtgtgtgtgtgtgtgtgtgtgtgtccatgcacctgcctgagtgggggtcattgggtgcactcatcctgggctcgcaggctcactgtcagggccagcaggatggaagacacacaaggatctctcctgccttccccctctgcactggccgtgtcccagggaggtacctgacaacccgtcacacatgcacacacacactcacactgggccagaacgcggaccacagcccctccctgcaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtgcaggcccccttagaaggctgggccaggatggatgtgtggggctgcagaaagaggagagacccaatcaagaccttgtgggtataggcagtcgatggctcccgtaaccgaaaagggtggggttggctctgcgctggtgtcagccaagaccagaccggggccacgggatgctcctgggccccaggcctcctgccatggctctgttccccctggctccatgctcagggtagccttctccctgggtggccaggtggcctcagcagctccagcctcaggttctcccagcaatctgtcatctcagaagagagcaggggcagaagtcctaaggctgtccctcactggcccgctcagatcacataccccttcctgaccatgcctgagccagccttgtcggccgggcaaggcttctctgctaggccgggctgggtcacatgtccaccccttgggtctgggctgaagccacgcccacccaagtgatgatggggataaagaatgggggtggagttgccctcaaaggtgcccaacagtcagaagacgcctgactctgctataaggaacaaaatgagaaaggcaggacagcccctggctctcagtgagaccagacctttcctgaaactgtggcactgtgtccctccgggttccctgctgcctccctttctctgaagccaggctgaggacctggctggccttaccttccctttcttccccaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccacccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaagtttgtacagctgtg

SEQ ID NO: 1130 - DNA, 28764 bp, Homo sapiens
tgcttacgcgcacgcgcattccttgctagggagaaagtgcgtgagccctaccttggggcgccagaggccgccacaacgcaggcgcattcagctaaggaccactccctccccccgcactcctgcctcgccatttcccctccctggccggccggccggccttcttcgctttgcgcacgtaccttttgaggtaacggcccaaagaggtagaagcgcttttcccgcccggccgcggggcgtggctctgcgcgcagcttgatgacgacgttttggcgcggtggcggaatggcggcttccacctctgaagcgggcgacgctatgggtcccacaggtgagtggcgcgggacgcgcgcgtgagacggtccgacgccctgggggcttccgcgagcccctgcggaggccatctccgttcctccgcgagccccaggactcgggcggcccggcggctctgcccaggccgggcaggctggggagtggagggccccggctgagtcttcctgccactcctctgggccatgcctttgtgccaccttcccgcgccgctcgtacactctgttctggtccggtaggtgttcgttgaaggttacccgtcgttgaaggaattgagggaaggagagctttgtgttgaaattgagccttgggctcaacaggcggtgtgggaggaagagccgggtgtgggtcccagctcgacccttcccctgtgcgctccacatctccgagccttggtttcggaggctcccgaagcccaattcgcaggagagttggaaacaagtgggcgcgtgctgttaagggaggtcttggcatgacagaatttgcttggaatgattagcgttgcccaagggctgtcgctgtcagaaaaacaaaacaaaacgaaacaaaaaaaacaaacgggtccgaagcagctcctggagaaaataggtgttggagagtcgcgacgaagtggactctaggtgcatggcacgcagagacctgtgacgggggagggtggccatggcagggtcagagaacaggggtgtgggagacacctcttgggagttctcgggtttgaatttcctctcttggaaagttcctagaaattcctctgggcctcattctttcagtcgctgcccatgaaagcttttactgagcagagatgctctccccttcatcatctctagagctccgcacttatccagcagtccacagtttaatgctgctttgatcattttgcagtagtgcagtgttttcttgaccaagtgcattaggactgaggcgtttttctttaacactgcaattgatagctaggttaagaattgaggccgggcgcggtggctcacgcctgtaatcccagcactttgggaggcccaggcgggtggatcacgaggtcacgagttcaagaccagcttggccaagatggtgaaacctcgtctctagtagaaaatacaaaaattagccgggcgtggtagcgggcgcgtgtaatcccagccacttgggaggctgaggcagagaattgcttgcacccgggaggcggaggttgcagtgagctgagatggcgccactgcactccagcctgtgcgacagagcgcagagcgagactccgtctcaaaaaaaaaaaaggaaaagagaaagctggccgggcgcggtggctcacgcctgtaatcccagcactttgggaggctgaggcgggcttatcacgaagtcaggatatctagaccatcctggctaacatgtgaaacccactctactaagtaaatacaaaagacaattagccgggcgtggtggccggcgcctgtagtcccagctactcgggaggctgaggcaggagaatggcgtgaacccaagcggagcttgcagtgagccaagatagcaccactggactccagcctgggcgacagagtgagactccgtctcaaaaaaaaaaaaaaaaaaaattgaaaaaacttgggagatgttcctattgccaagtggcagagaggcagagattcctgtctcctctcactctacaactgcctacatggcctctttacacccagcctctcttcctccacagactgccaggtgccaccccagtgccgttacttgtgcagtgggcagagctgggccaggaaaactgtaactaggccaccagtgggacttggcagacttcctgtctgtgaagtctaggtctgagcattttttatttttgacctgggtgagctgagaggtaggaatctggaaagctgatcttagttttctttcctttttttcttccattttttgagacagagtttccctctgtcaccccggctggagtgcaatggtgtgatctttgctcactgcaacctccacctcctgggctcaagcatttctcatgcctcagcctcccgagtcgctgggactacaggtgcccgccaccacacccagctaatttttgtatttttagtagagatggggttttgccttgttggctacactggtctcgaactcctggcctcaagtgatctgcccaccgtggcctcccaaagtgctgggattacaggtgtgagccatggcgcccggcctttgatcctagttttctgatggcttattcaaaggctcccttggcagagcttgctcttcccctccgttcattgcatagtgcacgggtaatatggaggggatttgcccctgtctcagttttgtgaggcggtctttgtattggaatcttggttctgccacttactagctgggtgggggtaagtgagttatcccatttctgcctctccttcatcatctgtactgacttgcagtcatagtacatctgtacccatcgggttgttgtgaggttggtttttctattcttgtatgacaaacttagcagtttaaaccagcacccatttattatctcatagttatgtgtgcagaagtccaggcaagctcagctgtgcattacaagattaaaaccaaggtgttggcagctttgctcttatctgaaaactccagggaagaagctgcttccaggtttatttaggttgctggcagaatccagttccttggagttgtagaactaaggtctttgtttccttgctggctgtcagctggggactactctgtaacttaaggtcccctaacttaggactctaattggatgtgcaaaatgccatcacagcagtacctagatgagtatttgattgaacaaacaggggtcgggaatctcgggctgctatctttagaattctgcctaccactgaggattaaatgaggagatatatagagagcatttagagtgagtcctggtatataacaaatgctgtacaagcattaccagggattcagtaccacaaacttggctctgaagctggccactatgggctgcaggagaacagtgtttcttttttttttttgagacagagtcttgctcagccttctaggctggagtgtagtggcgtgatctcagctcactgcaaccaccttctcctgggttcaagtgattctcgggtctcagcctcctgagtagctgggattataggcacccaccatcatgtccggctaatttttgtattttggtagagacggggttttaccatgttggccaggctggtcttgaactcctgacctcaggtgatcctcctgcctcagcctcccaaactactgggattacaggcggaagccaccgtgcccagttgagaacagcatttgtataaaagatgggaattgctggccgggcgtggtggctcacgcctgtaatcccacattttgggaggctgaggcggatagatcgcttgagtctgggagttcaagagcagtctgagcaacatgatgaaacccccatctttacaaaaagtacaaaaattagctgggcttgttgatgtttgcctgtagttcccgctagttgggaggctgatgcaggaggatcacttgagctcaggagtttgaggttgcaatgagctatgatcgcaccactgtactgcagcctgagtgagcaagcaagagcctgtctctaatcaataagtaagacatgagaattggcaatataatgtgtgttgcaaattggtaatgtaatgtgtgatattctcctgggcattgtgaaactatgtaatattttgttagggccaggtgcagtggctcacacctgtaaccccaacacttaggaggccaaggcaggaagatcagtggaggccaggatcctgggcatcacagcctgacaaactagcctgggcaacatagcaagaccttgtctctaaaaaaaaaggaaaattagccaggcatagtggcatgtgcctgtactcaggagactgaggtgggaggattgcttgaacccaggagtttgaggttgcagtgagctatgatcgtgctgccgcatgccagcctgggcaacagaacgagaccctgtctctaaagaaaaatataaaaagattctgctgtgttgcagatgttgagattttgtctttgtttttccacagtggtttgctaagaaggccattttcaactctccattggaggctgctatggcgttccctcacctgcagcagcccagctttctactggtaaatatcaactgcttgcatgagtgtcattgtggtcatagttctgtagctgtgggacttgagtgttcttcccattgacttgaagaactctgtagtggttgttttttaggggcatgtgatggaaacaatggcagactccttaacttgactgtgcctcgttattactacaggaccttggggttactcaacctctgggctctgggttttctcatgcaagacaagttcattcaaattctattttctctacttcccaagggtatgaggaggaggagcaagtgagaaggatgtatatcagaatgttcataacttgtaaattcttaaatagatatgaagcattctaataatcagtcataactgtcatcagtgaaaaatggagacactgttgtgcggggggctgctaggttgcactttaagtattaaacatgatgctgagaactgggtgcagtggctcatgcctggagttccagctactgaggagactgaggcaggaggattacttgagcccaagagtttgagaccagcctgggcaacatagtaaagactcaaaaaggaaaaaaaaatgatactgagaagtgagaagttagatatgaggcaagtattggtgatgaaagttcctaattttagttcttaggaggtgtttttgtaaacatttatgtggaaggacattcttcctcagtgcaccccactagagtcaacaggtctggcccatggccagacagctcaggtctccatctctgtctcaatcactgtgaaatccaccctcgtttggaggtagacaaggccttagatatcctttggcaaagctctctaggttgaaattctagctgtttctcctgatcttaatccattcgcacagacgccctttttctccttgtagtcagggtgctttcctcacatcctacgactaggtagatttcattagtccttgtcctgagtcttttctggcctctccattgccttcatgattagtgtctacttggctgaagcggtctgtaatttttgtctgccctgtgttttaagatcattggtttagtaggttcagtgtctattgaataaaggacagctcatttaagagagcttctgccatagccgtgatgttgttgggcgttcttactgatgatcacaacggtgtaatcacggtggtccatcaggctggaaatttccagttgatgcgtacaaactcagtggtactctgtggcttgtgaggggtgcccttacacaatcaagatcctcttctggctctggggctgactctgggatcagcccctacttatggattggtagaagtcaatcctgttctgatcatgtgcagcactctgagggggtactgggaaacaaggctgatagttcctggtccagagagcatagaactacggcctctcctagtagtactctttgggccactgacacacatgaggggctggggaaccaggccagtggttatgggtctgactcataacctattgcttggatttctgtttgactcaagccagagtttgactcaagccagagtatcactaaaagctgcagagtgaatgtcctcgtgactttttcgctttgttctgttttctaggccagcctgaaagctgactctataaataagccctttgcacagcagtgccaagacttgattaaagtaattgaggattttccagcaaaggtatagctctgctaatgtctctctttggagcatgtcttatacattcgttgaagaactttattataattcctaatttccctccccgccccaaccccgagcactgcctggcacagaggcctggccattatcatgaccattatgtttatggacacatttaaacatgtgaacttgtagatcaggggttcttagccacaggtgctctgtccctcaagggacacttggcaatgtcagagacatttttggttgtcacatctggaggtagatggggagtgtgtgctactggcatctaggaagtagaggccagggttgctggaaacattctgcaaagcacaggacagctccctgcaacaaagaagtatctagcccaaaatgtcaatagcaccaaggttcagaaaccctaacgtaaatactaaaaatatgtatttaaatcacacctggaattgtcaagcccaggaagctggcctagacaaggagttaataccaaatggcaataggtcagttaggtttcaggggcttcactctggaaaggatgttgctttcctttctgatagagcatccttcaagtcagaagtttccatctctttttaaagaatctttttttgtggtggctcatgcctgtaatctcaacactttgggaggccgaggtgggaggatcacttaagcccaggagctcaaaaccagtctaggcaacatactgagaacttatctctacaagaaatttaaaaattagctgagtgtagtggtgtgtgcctatagtcccagctactcaggaagctgaggtgggaggattgctcgagcccaggaagtcaaggctgcagtgagccataattgcgccactgcactccagccagggcaacagagtgagaccctgtctcaaaaaatatgtattttgtgtatttttttattttatatattttaattttcttcattgtttatgtttgtttatttttcttaatttagtcttctatcacacacaaaaaatgtattttgattggaggctgacttacttagctggcccaagcctaaagcaacactgcttggtatgccatgtaccccattggaagaacccaaagctgctcttgtcgttggcaccatggcaccagggttcctttgggtgcagggctgatctcgtaggtctcagccagggagtggcctcctcagaaggagctgggcagcaggtggtgcaggactagagccggggcaggaatgggtgctggtcctgcccgcggcctcaccacacattgtttcaggagctgcacaccatcttcccatggctggtagagagcattttcggcagcctagacggtgtcctcgttggctggaacctccgctgcttacaggggcgtgtgaatcctgtggagtacagcatcgtgatggaatttctcgacactgggtaggtaggttggtcaccggagagaggctgggtgattcctcatggtgattccacctttaaaccactctctgaatttcttaagattaagaaacaatcaaagcaagataattcacagttcatttgccctgtttttgtttgtttgttcaatttcatgttcagtggcccaatgatgaagttggtttataagcttcaagctgaagactataagttcgactttcctgtctcctacctgcctgtaagtaaaccacagtggcgagagtggtgctcggggcagtgggccttgcacagccctgtggtgatgggcaatctcctccagtcctctgagggcaaattgaggagcgattcgttccaggggtgtgagaggcaaaggaaatgggtattgcatgactgctacccttgctgtctgcagctttttatgagatggtaggagaagttctaagcaaagactcttgttcaggcactgctcagaggcagggcactgtccccacaggtgggttctgtgtgtgggtctcttccccagcagccttcccaaagtgctgctgtgcatgtggggtactgcgtatcgggcactacgcaccagcacctgcccgcaagcctcactgcctctctctgcagggtcctgtgaaggcgtccatccaggagtgcatcctccctgacagtcctctgtaccacaacaaggtccagttcacccctactgggggccttggtctgaacctggccctgagtatcctttggtggccctgaggtagggaggctgtgggtggcccagcacttgacacttgcggggggtgtggctcatcaaccctgcgtgtttgcccctgacgctgctctcagatccattcgagtattacatattcttctttgccttgagcctcatcactcagaaggtaaggaagggatgccttttgctgggagaggtggggccacggcccagggcttccctgcacttgttggtgcttggtggcctggcagtgtccagagcccacgctaacaactagcttggttttccagccactccctgtgtccctccacgtccgtacttcagactgtgcctatttcatcctggtggacaggtacctgtcatggttcctgcccaccgaaggcagtgtgccctgccactctcctccagcccaggggggaccagcccctcaccgcctcccaggtaaggctgccctttgttaagacctggcccttccataagggagtggcctggtcacttgcatcgcccacggggacaatgttgccaccctttgtccacggttccccaatttttcttatgcctcattccccacccccagctgtcttagcacagactggagggtggggtgtggcgggcaatctgtccttagtgttcagtgtctttggccatcactgaagctatcaggtccctggaggcctccacggcctgcatgggaatgggctgtgttgtgcatggagcagctctccccacaggcagtgtctgaggcagtgagcagggtggaaaggttgtcctatgagcaaaaaaaatggaaatctctatgggcccctggagcaggtcttgaaggggaggccctgggccaaagagcctgttttgccagtccaaacaggctgagcctgatgcgtgcctgcacaggtcgggagtgtgaaccaggggctctcatgcctggctgtcctgggtcctcagtgggcactaacgcagggcctcttggccgacttcccaggagaccctcttgccccagcatcagctgcctgtgcacctctgaccctccttaatctcactggcctattgccttccccaggaagctgcatgcaggccccttcctgcaagtgctggcccaccccagatctgctgtcatgtgtaaggcaggccaggcctttacgtacaattcacgtgtggacagattccccagagggtggaggggagaaagggagaggcagggaggagatgctgcccaggtggcggcagtgatcagtgaccctgaaatgttgctgatcctgtggaggacttggaggtgaggcagattcacaccctcttagatgcagaattcagccgccaagcagtttttgatgcctggttttttttgtttgttttaactttttgcgttttttattttaattttttcttttagaaatcgtatatgtgggctgggagtggtggctgacgcctgtaattccagcactttgggaggccgaggtggagggatcgcctgaggtcaggaattcgagaccagcctggccaacatggtgaaacctcatctctactaaaaatacaaaagttagctgggcatggtggtgcacacctgtaatcccagctactcgggaggctgaggcgggagaatcgcttgaacccaggaggcagaggtcatggtgagctgagatcacaccattgcacgcgcacgcgcacacacacacacacaacacacacgcacacagaagagatcacatacgtatggtttgggtttatttatttattttattttattttatttatttattttttggagatggagtctcgctctttcgcccatgctggagtggtgcagtggcacgatcttggctcaccacaacctccgcctcctgggttcaagcgattctcccacctcagcctcgcaagtagctgggattagaggcacaggtcagtgtgcccggctaatttttgtatttttagtagaaacggggtttcaccatgttggccaggctggcctcaaactcctgacctcaggcaatccatccacctcggcctcagcgaaagtgttgggattacaggtgtgagctactgcgcccagcattttttttttttttttttttttttttgagacagggcctggctgggttgctcagcctggagtgcagtgttgtgatcacaactcacagcaacgttaacctcctgagctcaagtgatcctcccacttcaacctgccaagtagctagtactataagcatgcacccctacacctagcttttattttatttttttgtaagatgggtcttgctgtgttgcccaggctgctctggaactcctgggctccagcaatcctcctgccttagcctcccaaagttcagagattacaggcatgaaccaccgtactggtccattgtgggcttttgtttttttttttgacagggtcttactctgttgcccaggctggagtgcagtggcgctgtctctgcttcaagtgattctcctggctcagcctcccaagtagctgggactacaggtgcctgtcaccacacccagctaatttttgtatctttaatagagacagggtttcaccatgttgggcaggctggtcttgaactcctgaccacaagtgatctgcccgcctcgaccccctaaagtgctgggattacaggtgtgagccaccgctcctggcctagccattatgtatttttaaagacagtcttactctgtcacacaggctggagtgcagtgtcataatcatcacttggtggcacaatcatcactcaagccagcctgtcacctcagtgcatcaccacagccagctaatttaacttttttttttttttttttttttgcagagatatggggatgcctcgctgtgttgcccaggctggtcttgaactcctggcctcagcaatcttcctgcctcagcttcccaagtagctggaattacaggtgcaagccaccacacctaactttttattttgaaataacttcagacttacagataagtttccacacataataaaaataacttgtaggccgaacacggtggctcacgcctgtaatcccagcactttgggaggccaaggcgggaggattgcttggggccaggaattcgagaccagcgtgggcaacgttgggagacctcatttctacaaaaaaaaaaaaaaaaaaaaaaaaagccaggtgtgatgatgtgcaactatggtcccagctactcaggagactgaggtgggaggatcacttgtgcccaggagcaatgagctgtgagctgtgagtgtgccactgcactctagcctggggtaacagaacaagatcctgtctcagggaaaaaaaaaaaaaagaaactttcatagacccttcacccagatttccaaattgttaacactttgctgcatctgttgttttccacctctattgtatgtgttttttttctctaagccaataggagtaagctacaggatatgacaccccttgacctcttaatatttcagtgtatttcctagaagcgaatgcattatcctatatagtcacagtgcctgtaaccacaccaggaagttagtattgccaccaggcctcacactgtgtgcagtgatgtttcacaggctcacccactgtatatagtgatatttctagtccccttcagtcaggaacggtcccttgcctttctgtctttcctgaccttgacccctccagagcatgtggccgccccttaggctgtctggtatttgctggtgactaggcccagcatgggctttgttgggaggagcaccgtagtgggacacctggtccttgccaggtgcccttttatcaccgggttaaaaaggtgccggtcaggtttttccattgtaaaataattactttgtgcccagattaaatagtaatgaggctgggcgtggtggttcatgcctgtaatcccaggactttgagaggctgaggtgggcggatcactggagctcaggagtgtgagaccagctcaggcaacatagcaaaatcccatctctaccaaaaatttaaaaataaccaggtgtggtggtgtgtgcctgtaatcccagctacttgagaggctgaggtgggaggattgcttgcacccaggaggcggaggtggcagtgagccgagatcatgcccctgtactccagcctaggctacagagagagaccgtatctcaaccaaaaaaaaaaaaaaaaattaatagtgagtgcctgggcaacatagcatgaccttgtttctactaaaaagaaaaacatcagccaggcatggtggtgttggtcccagctacttgggaggcctaagtctaggaggttgaggttgcagtgagctgtgattgcatcattgcactccagcctaggcaacaggatacgatcctgtctcaaaaaaaaaaaattgataatgagaatttaccaggaagatgtatggagaccatgtaattatcagtagtattaacatccacttttgattctcccctttattcaaattaattttatttgcagacagggtcttgttctcttaccccagactggagtgcagtggtacgatctctgctcacagcaacctcaacctcctgggcccaagagatcttcccgtctcaaccccccaagtatctgggactacaggcaggcatcaccacacctggctaatttttatattttttttttgtggagacagggttttgccctattgcccaggctggaaatttcttaattatttagaaacagggtcttgctctgtcaccccaggatggagtgaagttggtacgatcatttgtcactatagcctcaactcgtgggcccaggccattctccctcctcagccttctaagtagctagtactacaggcacatgccaccaggcccagctgttttatgtttcaatgtttttgtggagatgggttctcactttgttgcccaggctgatctcaaatgcctggcctcaagtaatcctcctgccttggtctcccaaggtgctgggattacaggtgtgagcccccatgcccaacctcactattgattcttgaccaaatcagctattaatagggcggttaccaagtggtggttctctaacttatccctccttcattgattagtgggtcagtggtcactctgcggtaaggaagacttctctctttgctatttatttattcaggtatatcagtgtggatcagggggctgggggggaggtatgcattgtgctattgaacaagttgtaatctctccctgctctcgttgattttgatatccagattgcccctggctaggccagcgggagcctgtaaactcgggcctgtttctgtgtctccctcaggacaccaaccatgccctttgcttcctatggcctccaccacactagcctcctgaagcgacacatctctcatcagacgtctgtgaatgcagaccccgcctcccacgagatctggaggtcagacactgctccaggtgagagttgagctggtcaaaagaaactgttcagccagctgggcatggtggctcatgcctataatccccagcactttgtgaggccgaggtgggcagatcatctgaggtcaggagtttgggaccaacctggccaacatggtgaaaccatgtgtctactaaaaatacaaaaatgagccgggcacggtggcaggcgcctgtaatttcagctactcaggaggctgaggcaggagaatcacttgaacacaggaggtggagacagcagtaagctgagatagtgccattgcactccagcgtgggtgacagaactggactccatctcaaaaaagaaaagaaaagaaaaaagaaactgtttagccaccttccactatgtggggcagagtcccagaggcggcccctcagcccggggctgattctaaattgttggtattttcctgctgtgacatttagaaaacatgaaagtaaatctgcccacccttctaacttgtatgtcattgatggcgtttttcatcccaggatcccctgtccatggaagttgtttcgttttgcctgtggtgaggcaaaattgttgcagaggcttttggtttccatgacactgaatggtgaggggtctgtgcagcctccacaggccttccattgattcaggggatccaagtagtaggtgacagatttccttgtctgcccagaggggctccagcctgtcaggatggtatgggctggctcacttcctgagtgctggtcagctcccaggtcctggctgtgtcttctaggcacacatcagagagattcagcaggtgccgcttctgacgctggatcctggggctgacttggtagccacagccttgcttttgacagcctgacatgtagataagataggattctatctcccatcttgtatataactcctagtatttggggtgctacactttttgaagcctccataccgtttcacagcatcctcgcagggtggaatggtaagaaccgttgcccctgttcacagaggggaccatgatgcccagatggctcttggctgtgtagaccgtgggctgtgctggccatgaagagggcagaagatcgtgacacagggcttatagggcagaactggaaggttctgctgttccctggaccaaagcatttttttttttttttgagatggagtctccctctgttgtccaggctggagtgcagtggcttaatcttggctccgtgcaaccttcacctctcaggttcaagtgattctcccgcctcagcctcccaagtagctaggattacaggtgcccactgccatgctcagctaatttttgcatttttagtagagatggggtttcaccatgtctccaactcctgacctcaggtgatccacctgccttggcctcccaaagtgttgggattacaggcgtgagccactgtgcccagccctttttttttttttttttttaaatcagagtctaactttgttgccaggctagagtgcagtggtacagtcttggctcactgcagcctcaaactcctgggcacaagcaatccttccacctcagactcccaagtagctgggattataggtgtgatgcctcaccacacccagctaatttttgtattttttgtagagacagattttcactatgttggccaggctggtcttgaactcccagcctcaggtaatccacccaccttggcctcccaaagtgctgggatgacagggttgagccaccatgcctgttggttgcctttttactctatcaatagtattttttcatgctcaagagtgttgattttaatgaagtctagttgtctattttttttcctttttgttgcctgtgctttgggcgtcatatctaattaatcattgtcaaatctagtgttatgaagttttctcccatgttttcttctgagagtgtatggttttagtgcttatcctcaggttgcttacccattttgagttattttttggcgatggtgtgaaggaagggcccagcttcgctgttctgcacatggaatgagttcccagctctgcttgttggagacactgtcctttccccactggatggtctggcaccattgtcaagaatggtttgactagctaatgcttttttgcaggtttttgttgaaatgtggcttcatcactattcgttggagatgtatcaaaaaatgcagtcccctcatgccaaggtatgtttccacagtttttcttcccacctcctgcttctgaccctgctcagcctgctgcttcttatcctgcctcggagtgagttttcacaggctggatggtgggaagcagaaacccaccacccacctgtcactcagaagccgagtaagaagtgggcatcattctctagtttccggtggcgggcagggggcattgcacactgacgtgtagacacttgaggcctggaagtctggcctttccggggccctccctgtgcagcttcctgagccccctccctggcagcgggaacagatgaggttgtggtgctcttgctctgggggtggggggagctgcaatgcctctgggagccactttctcgtctgtctccttgaccatcagcagtctttgtgctttcccacgaaggggtggcctggagccttctttgcctgctccccctactcccccacctcctccagagcatgagcaagcagcccttctcgtggcgagtggcacctggtgcccccctgcatgcagcctggcttgcctcctctccctccgcctcgcctctccccactctctctctgggcagcctgctgccttcagatgcatggaggtggcggaggccctgggttgttactgctgttgccgttcctggagctagcaccacccctggaccggtcagagtgagaaagcagctaggtgaaccttagatctccagtcagtcatctccatggagcagcttgactcatgcccatccatgcccttgcctgaagtggcatcagccacgtagtctggtgcccatggcgtctgtgcatcagtatgcttgggaaactttggctttgtcactgacagaattattgagggcttcctccagaatgtgggtgatggagttaaacttcagaagagcatcctgtcacttttcctctggttctggcaaagagctgtgggtctgcttctgccacagtctgcagccagttccatggccccatgctttgccatgtggaggctctctcagagcatagggtcccccaaatcctcaccctcagaatcacatgggtggagagtggggaaaagctgaggaccccatcttgggcctcttgagtcacgaagagcctgcagtgcccttcctgcttccagagcagacttgctgcatgtccctggctggtgcctgggggcctggttattccccgggcccgctcctcccgcagggctctgggacactcactcagcactcgtgcatgtggcgtggcgtggcctggcaggggcaggggccactgcaccgcattgtgttcctgttgctccttctgccttctgagggagtgtagtaagcacacctactttcaagagtcagccagaaaggctcttttgggctgtcacctgtgaggattctgtgtcctcacgggccagaggaagggcagggggctgtccctgtggagggcaggaggtgcagttcccttcttccccacatttgcttcctcttggccagacgttggggtaggtgggccctgcccagaataccttgcagtagccggaccaagtacccagagacgctccactcttcgcctcttccagttcaggcaaaacacaaaacgcaagaaaacttggtgggtgggagtcagagaaaggcagctgtggaagtctgtgtctcccaaggcttcttgtcgcttgcccaggcctgtgctacacgtactgccatacagaaatccctgcccgtccccactagaccttattttcagatgcaggaagtgaggctcctggggtcatcctcctcaccctgcttgagtccaggatgcgtgcttgctccccagtggccctgtgggcagtaaggatggccatggcgctgtaggccactgtgttcctgcaagcaagggcagagccacactggggaactatgtgtctgattcctccctgagccccaggtctggcacagaggaaggctgtggagggcaacaccttcctgccctgctccttccctccctgctctgcgtgtcatggcgactggcgtgtgttctgatttctcctgtgtggagcccagtgggtgtgctgcttgggcaggaggcatgctgctggcggggcaggatgtgcaccaggccggctgtggctgcactgggctgaaggggtgcttcggcaggccgtggtgctgcagggcagcagctcggagggtcctggctaggagccagctcagcctcaggttcctgctgcctctgggtgtgtgtggctgtggccagatcctcaggggctcccgcccttgggaacccactgtatgtggagggtgggagtttctggtgcggtaggagaggctgcctccagcagtcagagctgatgtgcacaccaccttagctgacgtccagactatgagggtggagggcagggcctggtggcctgagcctgtgctcctcgtctctgtgctacccttggggacctgtcctcgccctcagttctcagagagccagtcatggaggggacattgatttgagttttagacacataggaatcaatcatgtcttataccaatttggtaaatttcttaagacaacccagggaaatccagtcaattccacatgtgtcttttctgggcagagtcttcctcctggaacatgctccgctggtttcttttctgagcctcaggatcttgaggtcttggtggctggcagcgtgtcccagtgagggccctgggctcttggagggctctgggttgcatgtgccacacatagtgtgacttcagagtcactggggagagtgggtcccatcttgaagggcagtgagttgggcccttccaaggagctagagaggcctttaggccccagcaatactgaggggccacccaggtgacctggaggcccctctgcccgggcctccaaagcgaggacagtatggccacagccctggcctggctgcggaggcgggtgctgcgctggcccgcggctgctgggactgcaattgtttggattttcactgaccgtgctttgtttttgtttttttctcctcactcctgggctcgttctcattgctttctttctctctccgcttccccctcccgtgtctggtcctatctctccccttccccacccggccctcttgtcctctgctcttctgtctcttctgacatctctctgttccttttctcagctggaggttctgcactaccgactcagtgtctccagcgccctctacagccccgcccaacccagcctccaggccctccacgcctaccaagtactggctcattcgttcccttccccctgcccagagtgcatgtccatgcctggcaaagcaaggggccgccggggccggctgctggtgactcagaggctagttccaagcagagcgtagcccctgtgtcggggggaggcaggggtcagcctccagcctggcttggcccctggctttgtagactagtttggttgggggtgggggtggtggctttgtggcagaacgaggcatgtgggcatgtggccctggctgtccaggttcccggccagtggaggtgtcacaagctctccagtgttggaggccccgtgcttggccctggtttgaagagctggagtcctcaggcctcagcagtggctgggttcactgcactctgcagggtctggcgcttaggaaggagctgaagacgcagaggcctgggacttacgggtggtgtgggttctgccttgttcagaactgtcacccagcctggaggtgctgtgacccagagcctgcgtgtgaggcaggggggtgggaaggacctggggcttgaccctatagcccacagaagctgtcagtccttgacagcccagccagcacccggccttcatccggggagccctggccactcatatacacctccagaggcagattagagtgggtggtgacctcatagaggttgcagctgcctaggcagaaatgacaagtgtgtggatggatttgaggtcagtgaagcagagttcagacctgtagggaacttcagggatgacagaggaatctgtgagagccgggggagacgggctgtgctcacagccagtgatctgtcccgttcacctgggaaggagcacacatgattgaacaggaatttgagcacaagatgagaaaatgtgttggccccttagcgctggtgggctggatggcggccacagcacacgggggcacctcattccgcaggagccactgcagaggagaggaggaacctgagggcttgtgccagggagggaggacagtgtccagaaagcatctggcaaaccccatggtgggaaggtgaccagcgagacccaggtggggtgagctgaggtgctgtgagtctcagcccagtgggaaatgtgcggctttggggacacatccttaagaagcaagcaggtgactgtgaccagggactccatgtgggaacatggcccaggaggggtgcagagctgagggagaagtttggctcagcaaacctatgggaaaatagcctgagagggttccatgtgactgccgggggcaggggtggacagtgggccctccagacccttcagaaggaccaggtggtgtggggcaagtgcaccagcagggaaaggcagttttccagttcccatgtggaggtcttcccctcccctgagctgcagggaggatgttacggctcagaatcccaggccaggattggagggagggcctgggctgagactggaagaggagaaagatcctggtctaacttcccaccccactggtgcccttctagttaggcaatatagatacaggtattatgtctcatacttttctccttccgtcttttttttttttttttttgagacagagtctcactccgttgcctaggctggaatgcattgacatggtctccgctcactgcaatctccacctcccagattgaagtgattctcctgcctcagccccttgagtagctgggattacaggcatgtgccacccacccggctaatttttgtatttttagtagagacgtagtttcaccatgttggccaggctggtctcaaactcctgacctcaagtgatccgcctgccttggcctcccaaagtgttgggattacaggtgtgagccactgcacctggccttttcttccaaaacaatgcaaattcattgcccaaagacttaacgatacagagagaaaaatagccagccacgatggctcatgcttgtaatcccagcactttgggaggttgaggcaggcggactgcttgagctcaggagtttgagaccagcctgggcaacatggcgagacccctgtctctacaaagaaatacaaaaattagcctggtgtggtggtgtgtgtgcctgttttcccagctacccaggaggctgaggtgggaggatcccttaagccctggaggcagaggctgcagtgagcccagaccacgacactacactccagcgtgggtgacagagtgagaccctgtctcaaaaaaaagaatgccttccaccccatagctccatcttcagactcagccactgatctctggggtgtgtcacttggacctgtggggacagtttcctgacggggagacttgagtgggtagcaatatgggcagtggcccgtgtggggtctacagcatcccaggatatacccagaggctgggccctgcaccagcctcagcagcacagatgtgttaaggcccaaagggctaggggacaagtgtggagaggcgagcgtgtccactcaagactcagggtcctgccctcagcacccccacttccctgccctcgtctactctcgatgctcccacttgccctcccagtgctaagcaaccagaggaagcccatggccaccaaaaaggctttcctctccggctagatctccaggatcctgcttgtatgttacaaatcaaaaagtttggcctaggctggacacagtggctcacacctgtattcccagcactttgggagacctgaggtcaggcccacgtggtcaaaccccatctctatgaaaaataaaaattagctgggcgtggtggcacacacttgtcgtcccagctactcaggaggctgagtcaggagaattgcttgaacctggatgcggaggttgcagtgagctgagatcgcgccactgtgctccagcctgggcgacagaagaagaccttgtctcaagaaaaaaaaaaagtttggcctaatatgcctgactgtgcttttgtcttggggttttcctgaccacaggtccctgggcaacagaggaagtgacacccggggcttctactgggccgagttctcatctggctgtgtccaggatgaggagcaggtggaaggaattggggaggaaagtgaagccgtggggttcttatttttgaaccaggtcttaactctcaccaaggctggagtgcagtggcacgatcctagctcactgcagcctcaaactcctgggctgaagagatcctcccaccctagcctcctgagtcattaggactataggtgtgcaccacgacacccagctaacttttaaaaattttttgtagagacagggtgtccctatgttgtctaggctaatctcgaacttcttagtgatctttccgccttggcctcccaaagtgctggaattacaggtccgaggcaccacacctgggttccatgtgctttctgcacacacttgggaggcaggtgggagaccctggatccagagcttgtgggtgatgctggctttctcctgccctggggatcaagacaggcaccagtgcccaagggcacagcctgtgccacccgctgcggatttgcagcagtgcagaagcaggcctgggaggccctctgcagatgtgtctgtcttagtgaggcctcccccggggtgggctgtgtgggcgctgggccaagcacttccataccacaagctggtcacagttcagaccaagcagtgcaaggcacgtctgctgggtgccaggcacagtggtgccccatggggtggccccactcccggcctggctcgtgcctcctgtggggaagcagagcaactggctcggtgcgggatgtggtcagacctggaggccgagtgctatgggtgccgcgctccttcccaggccctcacccctccttctccacccaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacggtgggtggcccttgcggcttcccaccactgccgtctcccccactttcccctcctaaggtgtcacccacagcgacctctccccagggcatggagggcagggtgaggggagtccctttctgttcacagagcacgtgaggcctctccaggcctaggcaggtgtcctctcaccccgcccagttggctcccagagcctctctctccagactggccagagaggccccattgtgctgccatctcttgcatctcatattcttcaaccctgtcagaagagctggggtggccctgactgccagggccagcggagtgggctgtttgtatgggactgagggtgaggtgtgtgcaggagctgcactgactcggccgcctgcgtgctgtgtgtccttgggatgttccctagcctctctgaaccttggtttcttcctctgaagaatggggctgaacctcccggaggtgcccagtgctctcccacggtggagccaaccctcactaatgggagccctgggatcatctgtgagcagggcctccttactgggcaagcagcaggtgaccctccccatcccctgcagggccgctgtcccgaggttcatccagcagaaactctacctcttcttggagcattgctttggccactggcccctggacgcatcgttcagagctgtgagtgttggccccgtcacacgtgtgcctgtgtcctctgtgtgccttgaggtgggaggtcctttggggcagataaaggaggagagcaagtgttatcacagaggccttggcaaggagggggtcttggagggccacattgttctttctgtttgagtttccaaagccaaccctcaggaaagccttgccctgtcccacctgtctggtgcagggcaggttcctacccttacctgactagggagtactctgacccctgggctgggaaaagcccaccctggcttctggagggccagcaagagagccaaacctcacagggctgtgcatgtctctcctgcgccctctgggggaagtgggaagagtcagtcccacccagctgccgcctggtatctgggctccaggccaccggaggatttggcccccagccactgagccctcagcacatacctcccccacaggtcctggagatgtggctgagctacctgcagccgtggcggtacgcgcctgacaagcaggcttcaggcagcgactcccagccccggtgtgtgtcggagaaatggtgagccgcagcccctctcacagacatgccactggctcccccaggtggatattgttccagtgggtggaggccaagccagcggcctgtgctggggtcagcctggccctggcccccgtggcctcctgaagtcctctcccagcccctgccgagcggaacacagaccagcctttcctaggctcaactttgccaggccctagaattggtttctcatggaagccgtgggtgacccatcctgccctgtcccctctcccttctgtcccagacgagtgttcagccaccccgaaactatcccttgatcttcatcagcacagagcagagcagcagtgatcaagcaggggatgagggaagccgtcttcccccatcccctgcttgatcctcacagcagaccccaggcttccgtggcacctggcatggccactgacccctcccctccttgcccaaggcattcccctttggaccctctgggggatcctccctcagccccctcaggctctgggctggcctctgccatggtggcttccatccacttggaaaggggcctcagccttgctaaggatgtggcgtcctcagagggcctgggtcttacctgcctctgtcctgccctccctgcctgcccgtggccccctgagctgtcatctgtgacagcttgtcaccttggctagggagagtctgaaagcccaagggtgagcaagggcattaggggcatggaccggcgcagaccccgcctccagttggaaggctggcgccaacctgccaccttggtccccagggcgccctttgtccaggagaacctgctgatgtacaccaagttggttgtgggcttcctgaaccgcgcactccgcacagacctggttagccccaagcatgcgctcctggtgttctgagtggccaaagtctttgcccagcccaacctggctgagatgattcagaaaggtaagtcctcagcctgggccagccgggtagacgtcaacccagccagaccagggccaggcccttagctgggggtggctggtctttaagagggacccacacgtccagagtgggccccggcaaagggtgctgtggagactcctgggacacatctgtgcggtgaagtctgaaactggctggatcctgcctgccctgcagccaccaggcactgggtgggggatcgcaggtgtgctcacagagcgggccggcacggtccaagctgcggccccgtgaccccgccgtttaaccctggcaactcgtggtggccgcttcaggaggtgagcctggtctctgccttgcattcatcctggctgggttgggcgttggtttctgtcgatcctcctgttgtttacctcctgcagacactgctaggggctctgtgagccagcagctcccccatccgccctccccatgtcagccacctactgtgtgggagatgttgccaggcagggcctcaggaggacacccctgggtcagggctccccagacacctcagagacaccccagaatcctaagggcagcagtcgggtactctgccccggggaagtgggtgccagttcgtctcctgccttctaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccaatgtttgggcccgaggcccgcaccctggtgagtggattggcggtgcctgtcctcagggcccctggagccatggggctgagcagaacccgggaagtgctgtgatctggcaggaaggagggaggctgggtgtagatttgacgccatatctccttcccccattttagtaaagtctaattttttcctgataacgaaggcagtgtttgttgggaaatttcaaatgtagaagatcatcctttagtctttaaaagtcctctggcagaagccactcctcctgacgctcagcagtctggctgtgcattgctcttggggctgcctgggtggcagcacaggcctatcctgctggtgacctgcccacgcctcccttgcaggtcctgcgcctcgctcagctcatcacagaggccaaacacacagccaagtccatctccgaccagtgtgcggagagcccggctggccactccttcctctcatggctgggctttagctccatggacaccagtggctcctacacagccaacgacctggacgagatggggcaagacagtgtccggaagacagatgaatacctggagaaggccctggagtacctgcgccagatattccgggtacgagctatggggcctgccccaccgccatcagggtccccttccctgaaggatccactccacccagcctgtggtcagccacctaccagtcccaggccccacacatatggacccagtgttgtgggaggcaggcccacaccccaagcgtcatatctgggtccccttgttgccactgttgtaggctggtggggtgaagactggtcccctctcttcatcttgatgctgagggcagtggcatttctctctggcagctcagcgaagcgcagcttaggcagttcacactcgccttgggcatcacccaggatgagaatggaaaacagcagctccccgactgcgtcgtgggtgagaacggactcatccttacgcccctggggcggtaccaggtgagagacctgtgtctcagaggcacatgggctgggccctgacccgtccccagctccctcctgcctcgtgagcagaggccatcaggcttctctgagttgtgtgcggggctgtgttttctgacccgaccccatggcctggctttctagatcatcagtgggctgcgaaggtttgaaattgagtaccagggggacccggagctgcagcccatctggagctatgagatcgccagcttggtccacacgctcttcaggctgtcgtctgccatcaaccacagagtgggcaggagggcaggcctggcctcttcagagagggttctagatgctcctgcttggggtgcagtcctggggtggcctgtgagggcggggtactgctgtcctgaggcctgtggtgccaccaccccacaccctcatgcctctgtctgtgcttcagttcgcaggacagatggcggctctgtgttcccgggatgacttcctcggcagcttctgtcgctaccacctcacagaacctgggctggccagcaggcacctgctgagtcctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcatgctgctgctcaccctgggctacgtcctctacgcctctgccatgatactgctgaccgagcgggggaagctgcaccagccctgaaggtggcagctgccttcagagcaggctggagggatttgccacacagccccacccttgggctgagaggacctgggaagcccctccaggagggaacacggtcatcctcaggcttctggagcggggttcctgcagccgcagaggcatctggaggaaacacaaccaagaaaggaaggcagttgggccccagcaaaggagtggctaccagggctcaacagccacgctctgtgacagcgcagagctcagcgccggcctttccctccctctgccaaggactcatggccaagccagctctcggggccttttttccagtgcccatttggctactctgctgcaccaagcttgggagccagcctgccaagagccgcctgggcctggcctccccactggctggccttgaggtaggcagagtgggttgtggcgcctcctctctctgtgtgggaccaggacggtggcttaagtctccactccaggaaagaatcaaagtttctagagttgtgagaaaaccagagagtggctctcctgattcttcactctggggtgcgttcttcatgttctcccagctgttccaagactgggccgtagaattccatgtttcaggagcctaagaccctcccagagcccaggtgcttcaccgcagaccgcaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagaataatggcattttagggcctgtgaccaaaaatgaagcttgtaacgaccatggatctgaataaacatgtccttgcttctgagtc

SEQ ID NO: 1131 - DNA, 8532 bp, Homo sapiens
tgacctggaccctctgcatctcagaaaggtttattatcaactgaaggaggtaacatgtagcctttgctggggacaaagatgtgacaagtctctgccccatcctaggtgctgccctgcgtagggctcttcccaggcccgccccccttgggcagcctggtagcgctgggctggcgtggcatcctctggctggatccctcgtggttgctgcgttccgccagggccaatactcccccgagggcagcgctgcctttgtctctccctaaggagacacaaagcacaatgattaggaatggacgcgccccataaatgcagcacctgctgtactcgtgctccttgggcaacatttgtgtctacacatttccatcaaagtcgcttcagctagaggccctgcatcagccccaagtcctgagactcagaaccactaaagacaggtcacgccccagaagcccttggcagtgtgcaggggaccctttaggatgtgtcctaggagcgaagccacgcaaggagcacactgccaagggaacattttgaaaggacacatgccacgggcccatttagggaaaggtaggtgtggtggtccacacctagcctggtcagcaaacctagtctgccctgatcgtgccatcagcggcagcagcagcagcagggacgcgctgcctcatcctcaaggtgtgttcacgctggactgcacatctgagctgccccagatggtgacaggcaggaagtactgcagtcaccaagtcctggaattgggtttctgattttgattttggaagctctttcattgtttcctacctacccgagtgttctgcagtggtcaagcctcttgctttcgggtttagctgccagattccatgacagggttcctgccacagtctgaacgcttgagactttccttctgaacaccagaggctctctcggatgaagaccacaggttcagagtttctttgatttgtaatttgcttactttactctttaagatagccaagaaaaatctgcaaccacactcgggccagagctttattttaatgggatgcatttccctgggctcagggtgttgacagcatcggcaagactgagaggaccctccaaggtacaaacgtgcccgggtagcaggcttgcccgtggggtcacagccccccatgcggagtgccttggccagggctctcccctgctctggcctggtggggtctgacccgtgggctctaaacagggcgtgtgtcccctgcctgactcagtgttgggtcccccatttcatccccccagcatttcctttgtcctgactgagggagtgccttgaccactctgacctaatcagctacatgttccccctgcaggctcaaaccctggctggggcttgcatgttcccagacactgatacacgtttaggttgttgcctggaacactgaaagatctgacgtgttgctaagcacgtggaaactggtcccaccccagccaaattccttgcaccctcatagaaactccacaccccaccccctcagtgcggtgtgcctaggcacaacctctttcctggctgtccctcgtgagggcacgctgcagccccctctgtatataagctccctaacaaatgctttggactgaccaccctggcattaagtgtttcttcctttggaatcccaactggctctcatcttggaaaggtttggggcagtcccgtgtgggaactcccctgccatcacttttagggtgactccagacaagggttcagccaacagaacacccagcctcaatcctggtccttccctggcctcttatcaagtgtagtcaaataccctgcaaagggaaactggattcctggagaaaagatgcaaccgggtgtctagggacccattaggtcatttgtttcaccatctgtcaccctgaacaagcagagactcctgtgtctgagatgccgtggacccccgctcttccagaggtacctccagctccctttctatgctaataccacaaaattctccccataccctgcagggataggacggccctccttatgagtttccggggagttcttcctcagagaatgagatctttgctcattcttgcctggtggtggtgagggttacagcggtgtcatgctgggaactctgtcagcttgtcacacttggctgaacaaagatggagtcagggttgccctgagccaaggaggagcgcagtcaggaacacgtggtgggtgatgattggccacctcagcccagcagtgactagtgaaaaaggcacaaagcagacaatagccaccacgcatctcttgtggtacaaactgccataattctagtccccactgactggtcaaggggcaaggattctgtcttccatgagcagacgggacccaccaccctgcagcagctcccacactgggccagcatcctcctctgaggccacagtccctctgcaggccaggccagacagtcagatcttctgtagccgcagcctaatctgggtgcttaggtgcccatgcgctctcagctccccacagcacgcagcatggcaggccgtgcacctaggcctgactcagagtcggcttcccttcagtttgccgccatctgagcttcctctcctcccctcagtagtgacccagtcccttctggaaacaaggatgacagcgaagcagaaaagagcaaataatgctttttttttttttaagagtggtgggggaggggggtttagagactgagtcttgctctgtcacctggtctagagcacagtgatgcaatcacagttcattgctgcccggaacccatggcctcgagggatcttcctgcctcagcctcgatgtagctgggactacaagcatggggccacacctggctaataatgcttatctttaaatctgacagggttgacaaaccctggaaatgtgaaaccaacataaccgtaagccataactgatattaagaaaatcctggaaatcttcaggaattgcgtgctctcggggctagtggggagccctgttcaggcctcctcactttatgaaggatgagaaggcccagaatagaatggcctgcagtgccttgcagtggggaaaccagctttgcttagccctgctccctcgggaggggctactgagtcagacgggctagacagtgggattgaaccaagtgtggctgcaggttggggtgtgagggcagggtgactgatgcccctacacctggtccctggagggccctcctaaacgccaaaaacagtcaatgaccactgaatgttaaaaacagcctggctcagcaggggtcagtggctcgtgcctgtaattccagtgctttgggaggccaaggtgggaggatcctttgaggccaggagctagagaccagctgggacaacatagtgagacctccatctccacaaaaaatttaaaaattagccaggtgtggtagtgtgcacctgtagtcccagctactcaagaggaggtgggaggattgcctgagcccacgaggttgaggctgcagtgagctatgagtgtgccactgcactccagcctgggtgacagagcaagactgtctcaaaaataaataaataaataaaaagtaaaagaaaatgcacaattagctcaaatactttaattaatctaaaatatccaacgtattatttcaatatgtagtcagtacataaattattcataagatgttgcattcacctttgttctttttcttgtttctttgtagaaatgggtggggtcttgctatgttgcccaggctggtctcaaactccgagcttcaagtgatgctcctgcctcagcctccaaaaatgttgggattacaggtgtgaaccaatgcccagcctcattcactttggggttttttgtttatttttgagacagggtctcactctctcacccaggctggagtgcagtggtgcagtcacagctcactgcaacctcaacctcccaggctcaagcaatcctccaacctcagcctcccaagtagttggaactacagatgtgtgccaccatgccctgctaatttttgtatgttttgtagagattgggtctccctgtgttgccctggctagtcctgaactgctgagctcaagagatccagcagcctcggcctcccaaggtgtggtgggttttttgcattcccttttgtaccggtcctttggcatctgctgcgcataccacacgcagtgcaatgaccacgccagccatgtgtggctcgaagttcctgtatcaggcagcacagctcaggtgagactcacggcttccacactccaaacgtcatcttacacgcatgctctggacaacttttaaaacgtatagtttccctaaacttaaatataacgcttgactgaatttatttttccctcaatgactccagactctcaccaagacaagcatcgaccctctgtgcttctggggttttctatttccccttccctgtgggtatgagtgaatctggtggtggttgttcccacaggccgtctgcatggctgggggacaggcatccagaggacccagggtgcctgctgcagctcacagaggcaagctcgagagggcctggcccatagcctggagaactcaacacccgagtcctgtgggaaacctatggcctccatgcccctccccccggattactccgacaacccccctgccatatggggtgacagaatcctccaccccagattctgccattaccagggcagctggagctctgtgtggtcagaagctgtaatatgtgggcctcagagagctctcagcattccatctgtggcctctgcctctcactcagcagcacacgtctgccccattcccctccacctcctcctcaggttccactctatccccatggggcctcggtgccctcatgtcgtggctttctgccacccagcctacaggacctgggctatgcttccaggacacagccctcgagaaacaaatgaccctgaggggcccagcactccaggccactcctgtcctcgggtaaattctcttggagcccccattcgctcacatggcaccccctaatcctcctggcccctctatgcctgcatttccagtgccacaacccccacatacatcttgactgtgcccccccacctgcctcctcctgccctgggcctaccagcacctggacagcgctctgcctctcccatgccctcccactgccccagctcacacgtgtggggctctgctgacccttcctgctccaccctgtgtaacccttgctgctctctgggctctgaagcctcctcccaactccattgctagtggtttttcttttcctttcttttctttttttttttttgagacagggtcttgctctgttgcccaggctggagtccagtcacaagctcttggctcactgcaacatccccctcaggctcaggcaatcctcccacctcagcctcccaagtagctgggaatacagatgggcgccaccaccacgcccacctggctagttttttttttttttgagatggagtctcgctctgtcacccaggctggagtgcagtggcgcaatcttggctcactgtaagctccacctcccaggttcacgccattctcctgcctcagcctcccaagtagctgggactaaaggcacctgccaccatgcctggctaattttttttttgtatttttagtagagatggggtttcaccgtgttagccaggatggtctcgatctcctgagctcgagatccgcccgcctcagcctcccaaagtgctgggattacaggcgtgagccaccgcgccgggccctgcctggctagtttttgtattttttgtagagatggggtcttgctatgttgcccaggctgatcttgaactcctgagctcaaggaatccacctgccttgacttcccgaagtgctgggattacaggtgtgagccagcacactggtctcactggtggttttcctcactgcctctcactggactgagtgtgatcatctcacttccctgccacgccctctgccctgagagctaggcctggcacccagagccctgagtgagtgctaagtgagcagcaacatctcctggagtgacaagaactctgttcccagtttctccctcctgctggacacttgcccctcaattgctcatctcagcctgcagtccatacacccctactccaggcctgtccttcaggccctctccaccctctcttgggcctgagctctgggtggcagtgaggtggccgctgtcaggaggctcatgcaggaggcgcgaccaaagacccctgggctctcacaggcccctgatcacacctggtgacacctggaaagtgtcccaactcaggagtgaggcgggcaagggggctgagtgctggagtgtggccatgggaccagcacatggcatctgtgtggcactgcctggcagactctgggaaggtgggagtctctgtttcagcctccagacttcctgtccaggtaggggacaacttctaagaggccgaggcgtttgtcacgcctggggctgtgctctccagcagagcacactgcacccggctggctgtcttcccctggagaggggctctttacactcaccactagttcgcctctggggtgtggggatgttggtcctgtccccggatgccagcccgactgtggggtctagagactgccacaccatgtctctaataaaccgagtcagaaatagtgccctgtggctaagcggcagggcagcggtggcctgcatgatcctgcccttgcagctcaaagctgcttgggcctcttggggccatgcagtttccatgaaaacaaggaagagcaccaacccccagagataagccaataaacgcaacctgcaaaaggagagaacaggcagcaagagaggcggagggaacccggggggcctggagagagaggtgagtgtgtggcagctgggctgtggagcataaccagagaggccgcaggctgcgggctggaggaaaacgagggccttgcaggggggctactgttcctggcagagagaaaggaggcctctggaggtcagagagagacacaaagagagcagacagagcgagggtcagtgaagaggccagcacgcaggtgcccgggccctcttgggtcagcgggcgtgggtgcccaggccctggcacttcccccatgaaggcagcctgctttccacgccttctcatgatgcctgtgagggtctcctcctgcttccaggcagggagccagctctgggcctccttccattggcctgggaggttgtgctgcatttcagagagagccatcgggagcagaagcaacatgcggagaggatgagcagggacggaggctccaccatgacactctcagtcccagcatctcctcagcccagtcaccacactggagagggaggaggcccttcagaccccgcaggcctctgcaccctgggagttccgcgtctaactctcttcctgcaatcatcagaggcaggaactgggcccaggtggggtaaaggcaggaagacgtctgcctgccctgctccctgggcacttccctggatgctgtataccacaggacagagatcgagactgtcttttgaaaaacatttagagacaggatctcaccctgtcacccagactggtctcaaactcatggcctcaaaggatcctcccgccgtggggtcccaaagattataggcgtgagccacggcgcccagccccaaaccgtcttgattcccgactttgtaggatgaaggcctgagtgaagaggtggggaggagctaagcggaggagccctacccagcctggaccaccctggggcacgcactctgcgtccacctgacctggacgtgcctcctaaggctggcagcgaagcccaggagcagagcccacggatgggccctgcaggtgctgggcctagaccgaccgacagacaggcctggccactcagggccacgccgccgctgtgccgcgcctgccccctccccgcccgccacccccgccactggggcagggacagcgggcccagctctgacctcgggtctcgggcacgctcgacgtgggcagagacacggccgcagggtcctggggctcgctcgctagcctctgcccggcacacatggacttgagcatctggaagacggcgaggggggccacgttcagcttcagcaggtccaccaggatcctggcggggacagacgcggggccggtgagccctctccgcccggcgcggccacctccctgaagaccggacaaggacgggggcgggggcagcgggggctcctcccgaccagcgggccgggcgtacccggagagcagaggtcgggggtgtctggcgagcatgcggcccccacccgccccgctcacttgaacacgtcggggtcgataccgccgcccgccgcctgagccagctcgtacagctccatctcctcggtgctcagcaccttcttgcgccgcagcgccagcttctgccgggccgcctccagccccgggggcgccgccgaccccggcccaggccctacgccctgcgccgccatccgcgaggcccgccgaaaggtgcgccccgccccgccgcgccccctagcggatgcgcccaccgccctctccctgcagcgccagcgtctggcctcccgggctgccctggcgggagcg

SEQ ID NO: 1132 - DNA, 6842 bp, Homo sapiens
aatcccgtgcggcgcgcacaggcaggaggttgcagttgggcgctcagcagctgtggcagccggttgaggtctggcagtagcgttgggctgaagcagcggagttcgccatggtaaggcccgggtcactcccgccccgcagatgcccaggcagacgaagttggcctcgggtggacagagggacgttgttgcgggcctgggcgctgagaggaggccagagaaggacgcagggtctagtgcgggacaggaggacacgggatcgtttcctggatctttgggtcccagggcagggacggcggcttttgttttagatgaagctgccggcctttagtgaacgggaccattgacggtgtcccgtcccccagagagcaaatagtggcgtcgcctcctgaagacgggagggcgctgctcccgcttcacacgtctttgtgctactcgaaacaactgaggagccccaggagccttcggtgacgggggttggggctgtggacattgatcagatgaggaattaaggctcagacgctgctgcaacattgccttgttcacctaaaggcaaccgttaggccaggcgcggcggctcacgcctggaatcccagcccttggggaggtggaggcgggcggatcacctgatgtctggagttcaagatcagcccgaccaacatggcgaaacccagtctctacaaaaaaatacaaaaattacccgggcatggtgatgcgagtctgtggttccagctactcgggaggctgaggtgggaggatcagccgagcctggaactttgaggctgcagtgagtcgtgatggcgccagtgcactccagcctgggccacagagaccctgcctcaaagacacaaacaaaaaaagcagcccattaacataacagattcccaagtcccaagtctgaatagctgtggtttgtcagttatcctttttttcctttctttttctttcttttttttttttgagacagcactcaacaaatgctgtgttgcccaggctggagcacagttgcaggatcacggctccctgcagccttgaacccctggcttccagcagccctcccacctcagccttccgagtagctggtactacaggtgtgtgccaccacacctggctaatttgtagatttttcatagggacagggactcactatgttacccaggctggtctcaaactggtcccaagtgatcctctcacctcagccttctaaagtgctgggattataggaatgagccaccacacccagcttggcagggtttaaagaaaccaccaaaggacagtgcagtgtcccagcactaatgacgtctgggagccattacaggcttcaaggggtagagagagggagtggttacaagaaattgggagggtagttttatgaagagggcagcctgccaaaagtgtggccttgagagggattcaggtcacccacagcagttgagcaggaaggggccaaggagggagtaccctggcactgctttctccagccccccagtatcccactgctgcctgccattgaccaaaccagcaagaagccagagggcgaggaaggcctctgatgctgttctcaagggtcagccttcgagagcacagagcaggtggtgaatgatggacggggtagaactggggggtagagagaggacacacactgagcacctgggcttggaccatggtgacctgggacctactctgtatttccttacccaacccgactaccttatcctttgatcaggacataatcaaaaactgctacatattcttcagagaattactgtgacgggctataatgtggggttgattattgacattacatggcttccaagttttaaaataacctaagttttgtgtagtggcaaacaggttctagggctacctctagaacttactagctagtatggtttacagcaattagttttcacagcgataaagggatcagtcactaaccctcctaggaaatatcgattgtgaaagcgccagatactgaagcagtatataaatattaaattagaatattttgcatgccatatagtttcaagttgccttgaaatgaatgggttcacttttatgttcctgttcacagcgcgagtgtatctctatccacgtggggcaggcgggtgtccagatcggcaatgcctgctgggaactgtactgccttgaacatggaattcagcccgatggccaaatgccaagtgataaaaccattggtggcggggacgactccttcaacacgttcttcagtgagactggagctggcaagcacgtgcccagagcagtgtttgtggacctggagcccactgtggtcggtaggtgcctgggcactggatggcagctttcctgagagggtgggagagcattggtaaagccccgtgtgggctcctttgaatcctcctgctgaaaggatgggatagacaggcatatgcccatggcattgttaggagagaaactgaaaggttcgtgatcaaagtgtctgtgagactcggctcctaatttaggaaaacctgacctacagggaaaagctgctttgccagcagtaagatgggctgtgaagagattccctcgtgcgtgcctcagccctgctcaggtggccctgcctgcagggtgcagtggcattggttccctcccgaatgctgtgcattctcttatgctggtgcactagagtcttgacctgcatcttaggcatagaaggtaagtacagaacagtcatttgcttccttcagattcgcagcctgatgtagtttccaaggagagctacaaagaggcagcacctttcagtggccccccaggagatgacagcatcacctgaaagcctgtgggacccaggtcatccagggtgccctgatgggactgccctgcagaagtcacactgacctggtgactgcccaggttgtaagagtttctaacttacagcctttgatgtagctacacgtaggaaagaattatgtacctgcgtaggagtgccagagcttatttcctttcactgggaactggttgtgctgacatttatacaacaagctgagtttaactttgtagagtcataaattgcatatgcagtttggttatcacacagagacattttctaccagacactgccactgttgacctatgacatgtaggtcatgtactttgaacagcatgtgctctgtagaagtgaacactcctggaatgtgtccatcttggtgagtacaggccttaaaaattcacagcacacactgtctcttttgcagatgaagtgcgcacagggacctacaggcagctcttccacccggagcagctgatcaccgggaaggaagatgcagccaataattacgccaggggccattacaccatcggcaaggagattgttgacctagtcctggaccggatccgcaaactggtaagaagagaaggtttcatgtggccattttcttgcatgggaggggtagttcttggaatgtgaaagggaagtcattttatcaacacttagaccagcatcttggccgggcgcggtggctcacacatgtaatcccagcactttgggaggctaaagcgggtggattacctgaggtcaggagtttgagaccagcctggcctacatggtgaaactctatgtctactaaaaatacaaaaattagctgggtgtgggggcacacacctgtactcccagctacttgagaggctgaggcaggagaattgcttgaacccggaaggcggaggttgcaatgagctgagattgcactactgcactctagcctgggaaacagagcaagattccgtctcaaacaaacaagcaaaaacttagaccagcatcttgagtcctactgagtctgcagtggtgatttgtccgtagatctttgcttttctttgcttcaaagtgtactgcatgtttattatggatgatttgaatccatatcaactctttagaggcaaagagaagcggccctggcttgttggaggttggtggtgtggcttccatgggcattggctcacgttgtgtggtttctctcaggcggatctgtgcacaggactgcagggcttcctcatcttccacagctttgggggcggcactggctctgggttcgcatctctgctcatggagcggctctcagtggattacggcaagaagtccaagctagagtttgccatttacccagccccccaggtctccacagccgtggtggagccctacaactccatcctgaccacccacacgaccctggaacattctgactgtgccttcatggtcgacaatgaagccatctatgacatatgtcggcgcaacctggacattgaacgtcccacgtacaccaacctcaatcgcctgattgggcagatcgtgtcctccatcacagcctccctgcgatttgatggggccctgaatgtggacttgacggaattccagaccaacctagtgccgtacccccgcatccacttccccctggccacctatgccccagtcatctcagctgagaaggcctaccacgagcagctgtctgtggccgagatcaccaatgcctgcttcgagccagccaatcaaatggtcaagtgtgaccctcgccacggcaagtacatggcctgctgcatgttgtacaggggggacgtggtccccaaagacgtcaacgcggccatcgccaccatcaagaccaagcgcaccatccagtttgtggattggtgcccgactggatttaaggtatgactgggtgatgtggaggcctttcagcaagcagcagatgcacaaaataacactggccctgaaggcccacatcctttggggagattatccctgttccatgggctaggcatgtgggcataaattagtgaaccagagttgataattgattcagtgatttctttttttttttttgagacagtcttgctctgtcaaccaggctggagtgcagtggtgcgatctcagctaactgcaacctctgcctcccgggttcaaacaattctctggcctcaccctcccaagtagctgggattacaggtacccgctaccacgcccggctaatttttgtatttttagtagagatggggtttcgccatgttggccaggttggtcttgaactcctgacctcaggtgatctgcctgcctcagcctcccaaagtgctgggattacagtcgtgagccactgcacctagctcagtgatgtcttttgaactctctgtctgagtcatcacactatatatctgtggtgagctttatttatttatttatttattttttgagacagggtcttgctttgtcccccaggctgtagtatagtagtgtgatcttggctcactgcaacctctgcctcccaggctccagcgattctctcacctcagcctcccaagcagctgggaccatagacatgcaacaccatgcccgggtaattttttttttttttttttgagacagagtcttgctctgtcgcccgggttggaatgcagtggcgtgatcttgactcactgcaacctccacctcccgggctcaagcagttctctgcctcagcctcccaagtagctgggattacaggcacctgccaccacgcctggctaatttttgtatttttagtagagatgggattttgccatgttggccaggctggtctcgaactcctggcctcaggtgatccacccgccttagcctcccaagtgctggattacaggcacgagccactgcacccagctaatatttgtatttttagtagagatggggtttcgccatgttggccaggctggtctcaaacccctggcctcacgtgatctgcccacctgtctcccaaagtgctggggtcacaggcttgagccaccacacctggcctgatgttgtcatttatagaacaagtttgctgatccctgctctagttgaccctgtgcactgcggccaggacctcaggtcatgttatgcccgagttctgaaacttggaatgcttcccctttggttaccaccttggaatgtcaccccctacttaggcaggcacatggaccacttcgaccacttcctgctgctgtggtagcagcattcatatgacccttgacccatgatctgctacctttgcatatccacagtggcttgttctgtgggtcagaagtgggtatgatgttccttgtgatagcatggggaagagttgtgtactctgaatctatctgggtggaagaagtttagctacagaatttaattgtaatctacaaagaagacaagcagcatacattttcagagggaagactgtcttcacctgggcacctatcacatgtcacaggtactaggacacagccctttaggtagcttgggatcccaccagggtggctacctccaaggttcctttctctattcctcatctggaactatcaccctgcctggtgcagagaagggcttagtgacgtttgtgaggtgaactgagcattctccgtgtcacctacagggtgtcttctgtttgaggaaaagtagctaccatttctaggtttgatataagcttcatggactgctttctttcccttctctggcaggtgggcattaactaccagccccccacagtggtccccgggggagacctggccaaggtgcagcgggccgtgtgcatgctgagcaacaccacggccattgcggaggcctgggcccgcctggaccataagttcgatctcatgtatgccaagcgggcctttgtgcactggtacgtgggcgaaggcatggaagagggagagttctctgaggcccgcgaggacctggcagctctagagaaggattatgaagaggtgggcgtggattccgtggaagctgaggctgaagaaggcgaagaatactgaggggagggtgtggtgggttctcccctgccacccccgggatggctgcttccaagttgtttgcaattaaaggttctgtataaaaccaa

SEQ ID NO: 1133 - DNA, 643176 bp, Homo sapiens
tgacaggtcaatgaagacacatctccttttcacgtttatttcattttgttttaagatcacagaagagcagagcattcatacgtgtaaagtaacagaagagagaaacagaatttaaatacatttaaaaagaaaagaaaaaaagctttttttcattttaattttaattttttttttttaacacacattgcgctttttatctccttcacagagctagtacccagggaaaaaaatccacctaataaacaaaaatgaaaaaccttgaaaaacaaaaaatcccaaacaaaaaatggccatgtgtttgtatcttcaagggaagatcagttcatgtctacagggctgaaaaaaggaatatatttatatatatatttatatgtatataacactgttaataaggagaattctaaccaagagcaggatttatacacccttcagtagagcagtgataaggaaggtggggagcattgggagatgggggagggagttggaagtgttctcttttgcttctctccccctgaatttcttccctttaacctccctactccaagtaaatacttagggagcagaacttggccacagttcaccaggatgaacaatttccattctctggtgaagagcaaagacttagggaagtgggttcaaaagaggctcctggtagcttgggattgctgcagcgtgccatgaagctaggacttccatgggttttcttcacttgcaagaagcatatttgtactgtgcctggctttacatagggaggattgtgcagagtagaatgtggctgtagaagtagatccaggagcactgcccaaaaagaggtacttctgaaatgaccatgaaaacggggagttgtcccatggacaggtcattctcccacttagagagagcttcataagtaatctaagcacatcatatatccttacctacacaaagtgatgtgattgctgggaagtgatgaacaaaccctactcttcagtgactggaaactctgatgccttctgttctttcagacaataaaatcaaaggacaactttggatagatgctaacctgagcctctaggacagcttaggacaagaggatctgtgctcaatgcatctagaacatggcacaagaaaataattccttattaattgcttgagaaatcatcctttctgcttacccttttctcagagaacctaactttcacatttgattttggccttcacaacaattcatactgtcttcaactctgtaacctcctaaattgtgtttatttttgttttattttcagcttgtcttctttaaatagaattgacttgtactttttgaaaacaatacttgttttctctccatctatttgctttatttcatagcctataattcaagctttgggaaacttatcccatgagaaattccttccaaaacaaaatgtattgtcttgcccatttcttacagttcagcctttgaacctgcctgggaccccatgcttaccgccatcagcacaagcaaagagtttccaaagacacacatttactgtaatgaggtacttggcccaggatgacagaaaactaatgtttcctttcttatgcacaatgtcctcatttgttacatgcataatacccagtctggctattttccttcctatgaaagattattagaatatagttccacatttaggttttataatataaacaaggaaacaaccccagctatgtcaatgtccttagtgtaatttgaatgtgtcccttctctacactgctataaagttttgatcagaaaaaatttacagacccagtccagagtccctgtattctagcagttttgggtttagaaatgaagacggtagaatgatagttctgagaagtgatgagaatacagagaccaaactagagataacaaacagctgctgtttacaaacagtgctgggcacagcactaagtgaatattaaattcttattcagaataaaggttagagttgaaagagattttagagacgtcagccgaatccctcactttcaggatgagaaaaccaagactcaggaaagttaaatgacttgccaatgtctcacagctttatttgtggctgaacttggggttagaacccaattctcctgactcccaattcaatacaccttctacctcactttaaagttgtcagtttatcttagatgatgaggaagcagtaccaagaagacacttgggggttgatacaacaggcacatgagcccttaaaactccttcctgttttttttctttttttttctcttaggtagattagtgcatttaaagcctgaagttaatttgacctaaaatttttataagtctttgcagaaagttcacttgtttcctgaaatcatctccttgataattttttatgtaacagttgttcatattgtaggaatgatatatatgtcatcctgttacacgtgtcaggcacttcaaaaagactccaagagaacatgcctgagaaagataactcccaattaaaaatgattcagtccctcacttgcaatattcaggataaatgtgtggaaacattaggctaccagataaataaaaggtagttatttcctagggtgactcagcaagatatttctcgaggatataacattttttatattgcacaatttcttagaatccagatggcaagctttcccactgcttttgttgaatggaaaataaaaactgagtaatattttgctcatcaaggtttaggtcacttccttggagctatttaaataagacatcttagatggtgagaaaggagtaaaaagaagatagctgggagtggatacagcagacatatagcccttaaaacctttccctctatttcccttgctttggggtcgggtgagacaactacagcaacagttgggacaatctccacttagatcctgaaagaccaaagaggtgacttgagcaggatataaaccttgaactgttcctgtgggtctgcttcctttggctaaggcaacctcatatttggagctttagtcgtaattcttccgattctgaactgtgaaacgtttcagtttttatttatttttatttgatttttttttccttaagaatcatagtaaaccttagcagtagttgggcactgcatgaaaaatgaagtttacatagtttatattatgtacataaactagtgatttacattgatttacacatgattggtgcctaatttattaatcagcacgcagcatgtaaatgtgctcaaaagaaatcaaggtttaaaataagttttccataatattcataaacattttcgctggtgtaaatgttaaacctaaacccaacgttaacaccagcttccttgccaagagaaaagtgagatgtacatgctgggtgaaaacaaattctttcctaaattttggttggcgacatttgaacagcatagctacatgcaaatgagaatagtttacttcttttctgctagtatgcacataaatgtaaactccattttgcatttagtgagatgtttacagatattatgccaaccatgatggaaaatttacatcactgaggcaaatgcagtctttggagaagaaatattctaaacatttaagcaaggaggaggcttcctaaactgcatttttgtttcttatctcaccatttttgtggtgtgtttcacatttgtcttcaaaatattaatagtttatgtaggtaagatatagcactgtacttacatttctcttaaaaaatgatattggtaaccaagactaaatgcaggctaaaagtgtatgaggatgaaaagaaaaatgaggacatggttaatcccattaaacatagtctataagcaaatttcttttcgccaaataattacaaaacggaaaaagtggggctctatgtctttctacgtgagcatagattttctttctaaacaaccaaattcagtacttttcttccttttaagatcaaaacattattcttaatttgtcttataatacatacattattgtaaatatagcatctataaagataaaaaatacacacacatatatattattgttttccacaaataattcgagccctgcaaagaacaaaatgaaaaattcagggagaatagccaatagaaacagtgaaaccacaaccaactcagggatggaatctgcgactctggaggattcaagaagctcacaacttggtaaagtaataactcaaacaatttcatgctgaggagtttagcttttgtgtgcaaaggaggtaagtccatttttggaggagaaacagatttttgtttggtcctccaagaacgtgaaaatcacgagtacttttacaaggtctctataagtagccccagtagtctgactatgtagtaaaaaaatgcccatggcaagcgagaagtctgtctgacttggaagagaaggcaaaggtcaatggggcagtccttcctgagagaaaacccatctgcttttctataagccttagttcttttaagacatggggatttcatgtctcgaaacaaacaagactttttatccagcaaggcaaaacctttgctcaacaattgcacagagcataattacaattctgcagttgtaaagccctggatagttctcattcttcaggaagcaccctgggtcaaagtcatttctgtttttgttaactgaaagttgggtctaaggatttccttttacgaatggtggagttttactttgtatacaaaggatattaaatatattagccactcagattaattgatgaatttcactcctctcagtatattatttccaaccagttggtgcttttcagtgcggggtttcaaactttgattaccaagggacaagattcttgaaggaatttattccaatatgattaactaaattccaagaagtcttatgttgagattcaatgatttcttggtgtcagtcctctggccctacctttccctgacttttctctaaactatattttcctccattgttcacactgcttagggaacactttcaatcctatgaaatttctggggacaatgttttctctgaaacaggaaccagaagcaaatttttaaaatttcaagatcctgctagagacacaggcaaacaccacatttaaatatatgtttaattatgtttaatatatggtccattatattaaaactgagggaacaaacggtgctgacatggcagacatttatttcaatggagaagttcctcccatgaaaccaagaccttgtcctcatgataaagtggagacaataagaaagccaggtatataattaaggcctgtgacatgccatggggatctgttcctgaaggtaatactaacatccaacttctaacaacatccaacttaactcctacttttctcttcctgtatatctttaaattagcatgcgcttttctaaagccacacacttaagtgtgtgactgcctcttcaatttttggggaatgcttattattaaagatgataccctttattcttgaactaagaagaccaaactgttaagagaaatacctgattgtcaataaattgatgctgcataggaatatggctcaccttccctatattttactagctaccttcttggatgagaatttgttttctctcctatgtcagaatctgctataaacactcttaaccatccccaagctgaatttttccttgtatcaagtctaaactgcaaaatcatgaaagaaggctgtgataagcttctaaaacaaacaataaaatcccttagaagaaattgaagaaattaacaatgctacttagatctttctccctcctgccttcctttcctttctccttccttccttccttccttccttcctccctccctccctccctccctccctccctccctccctcccccccttccccgtccccccctccctgccttccttccttccttccttccttctttcctttctttttttccagttacaaagtttctcattttataacatggaacagctatttacaaggttccaacttaatgacataccatatttggctctgcaagattacattcaaatataatctcaaaataattctctgtcctctcatgaactgaaccactttcagtgcttactactgtgtaagtgagagcaagggttggttttctgacaaagacatctatatgcagagagccagctctctcggcaagacatttcctaagaaatccttctggtgatgtggtaacaccaagctttgtggtactcataaaatttctgtctaaatttattacaagttgcccagcaattttggttaaggacctagatcacatttcagtgttaatgtcaagatgactcttatagatgtaaatttaaatagagcagggaagatgaatatcatgcaattcttagcaccctggcataggataacagtggaccaccatgaacagtggtgctgcaaacaccatcagtgaaacagaacagggattatgcaggcaaccaaataaaacattaacctagaacactgggaaaaacatctgcagaggagcacaaggagtgaactgcttttcattatggccagtgctctgtattagagctctgacagtatctccagaatacagtaggagcctgggcatctgttgactttttctgccttgctcactttcactgtattttatctgaaataggaaacaatctctgctcaggggaattcatgggacaaatgttatttaagattagggaggaggtaaaacagggctgcttaggatctccaagtggttcatcattctttcactgggagttgacacttggagaccttcctgtttctggggatttactcaacacatgctgctcattttcacagtggagcagggcctaccctgttaaatgccaggaaatataagaatccctcagactcatgaaatgagagtaaaatctgaaattttctctcctaggtcacctcgtccacgtcataattccttatgctgtttgcttaccccatcgatagtaggcactttcatttacagtgatattctgagtgactccccactcggttctgatgatgggactaggaggaatatggggtcctgcccttggaaggagcatagcttggtttgaatacacactgatgccatgtgacagccatggatgtagggaggactctgctccttgcctctttccccgccatctcccccagcaacttgttacagccgcatctcacaattacaatgcaggacagtatctacagcacaatgagtctatgtacacatggaccattcccttggcatgctttagagagagacacacacacgctcacacacatgtacacccacgtgagagcgaaagacttgagcacacacgcacagtggagaaaatgaaaatggcacttcctagcatttgcggcatgactagtgctctggggagggggtggaggtgaggagaggtgagggaggaaaggtgggtgaaaagggagtatctagggtgggtgtgggggagatagaacgcactggagggagaggggatgatctctaaagttggagagatagtggaggaaggaaagccagagaaaggctcaacataagattccattgatagtctgaagtggctacaagtcagctcaaatgaaaaatagaattaaaaggttatggaaatataaacaccaaaggcaagaccttattttcttccccacagatgaaaaaagatgaaggaaggaaggataaagtgtgtgttggggggcttaatatccatctggttcttctcttatttttacagcatccagatgtccttagtgtggtgtagtctttacacagcatacatttgcttagtagatataaacatatcccagtagaaccttctccatcctgaatgatacataaatttttaatgatggactgtaaaattgttttaaatgttgtattttcttcttcactttcttatttcccccttcatgtataaacacacaaagttgtgaaataaacggtctcccccatctctctctctctctctctctctgtctctctctctctgtattctgtgtgacgcatttttgtgtgttttttaaattatttttaaatttttattctattaacatttgctgagaaggcagagcagagatgctgccagcagccacagtggtacggccagactgatggatccatttattcctctcaccgacccaggtcctgcagagcaaaagaggagagagaaaaagagaatgagttacatgggcccactgtatgttatagctgactgctgatggtatcagaggtaagacctggccaggtactagcatctcaaagttactgcacttatgtgcagcccaagaagcgctcaaaacttttctaaatccttctcctccttgggctacaagtatcctaaggggcatcattggctgaaacacttctaaatacaaaatgcttttgccgggtaagtccttaaactggctatcactaatgtgtctgatggtacagcaggctcctgttcacccagcctcctcctgttggccctgcccgaagtaactctctggggccagcactcgttaaggttccaagcattggtgagggtcctccagcagtcagacatgggtcttctggccaattcatcatggcatctccaccaataaagcatggaaccaatccacgactccctctgtccccggggggaggcagtaattacttatttgctaatggggaggggaactgttttaaagtaatgcttatggctagatggtaccttagcaagggagaaaataagtcaatacatcttaaaatcttaagaggcagcaaaggatcaactcctccaaactcttcatttgtcactttaaaaatcaaaaacaaaaacaaagacgataacaacaaaaataaacaaacacacctagagaggttgagaggcaggtccaaaccatgagcagaactgagatttgaactcacccagattaacctggaatggccatccgtgtttcctgctgccaccttagttttcccaatgtggacacaatttgggggatgtgggtgtgggtctgagaggggaaataggatggataggaagctggagaaggggcttgtgtgttcataaaagagaggattggggaggaggaaatcagtggtctggcagaagagcttatcatctctgctttgcttgttccattttctccatttgtatagttctgctcatattccattaaagtgaaaaaatagtatttttcactacagggacttttggatttaagactacatacttaaacaatgatgttcaaaagagaaactggtgtgactgtaattgtcagtcacttaaaaattttgagagtgcgtatgcagatggattatgtgtgagtgtgtgtgtgtgtgtgtgtgtaaaactatgatggtttgcaggtatgatggaagcatcccctggtatgtgaatttttccaaaactgtttacaaacatacccaattggagataggataacaaggaaaaatgccaaattccatggtctcctaatctatgctttatgtaaataataaaagcaacaacaacaataagaacgaaaccacaaacgattatacagcacttactacacgattttgtcacaactgccttataaatataagcacacaaccatgctataaggtagatactatgatgaaacctgttttacagtgaaatgatcgaggcacagggagattggatgcactgtacaagtttacacagcttgtaagcagaggagctggggtttttacccaggtatctggctccagagtctttgcctgtaagtactacacagtaaaggggtgactgtaagtctcctgtcaacattcagcaaattaaacttgggtttgattaaaatggtcagcacaaacaaaaacaaggagacaactactatcattgcaaagaagatttttgataggagagttttggctagaataccttcttgagaatattaaaaacatcacccaatataaaaatatgaacatatacaaactttgatcagcatacagtataaaatgagctgtattatgtgtaaatctatggaaacacagaataaagattcaataaattaattatctgattttctgaattgttataggatcatattaacaaaaggcaccttagctaccttcaggttcatgcatttcatgaggaattaaggttcaatgagattctgtatcttgcatgaaagcacccgattagtaattgttgaccaggtgcttaaattcaagtgtcttaagtcatctcaaggcctttcctaatccacttctatgtctcctactcccaccctttttggacttttgggaccttcaagctctcttagtggcaacttcccccagggcttttgggctggtaggaatgttactttcctaaccttttagtctttctatgtacactagatggcaagagctccttggcatgtttggttgtatttgtgtattgatgaggttttcaaaacagagaaaaactacacaaaaattaaagccatagagggttaggcagaaaatacttgtgtttgcaccagagatagtgtaaaacaaaaggttttcagaaagggtccaattctgctgatttcctcaatctcatttttagtgcaaggacaggctagtttatcttgtagacatcctggagctgaatgatatcttgggaaggttaagactagtcttatcattttatttgacagtgataagtatttgagaaagccaaaattccattattgaaaaatatgttacagaatatatgaacctagataaacatgttcacatataacattcttgataatacatgtatacatacatatacatacaaagtatatgttatatacttatatatgcaaatgatatacacacatattattgatcttttacaaataattcagaattaactgttattttcacgtgctattctatgttataatgaggaatctcagtataactatgttaataatctttaattttatccttcataatattattatatacagtcatatgctacattacatttcagtcaaagatgaaccacgtatacaaaggaggtcctataaagttatagcactgcatttttaccatacctttcctgtctagataagtttatatacacaaatacttaccattgcccatagtattctctatagtaacatgcttacaggtttttagcctgggaataggctataccatatatactaggtgtgtaataagctatattattgaggtttgtgtaagtatattctatgatgttcacaagaatgaagtcacataataatgcatttctcagaatgtatcccagtcattaagtgatgtataagtatatttgaaacttattttgtgcatcagttaaagatatcttcatctctatcaattattatttattaagtgctctcatatagctatttagtgtacttatatgacttactcttttcataactgggtttgagagtaaataaataggcttaaaaatacaagggtaaatgggtggtagttgggaaatcatcacaagtgtgtatgcaattatagatatatgtgactgcataggagactacttcagttaatggctatttcagggaagaataatcagcaaaatcattaattatgttttacttcagagttatgaaatttctgcttatttgtggaaatgcaaatgataaatcttatttcccacaccagatggccaagctcagcaagtgctttcatatactgacagataaaatgaaagcaagagtctgcaaacataaattagccttaagaatagatgggcaaatagaaccacaattcaaattttgctatgtctttttcatataacagacaaaaattatattttagtatccaatccattctatatgtgtgttatatatgtgcacacccactgatgtatgtggtatctggtaaacattcagtaaattgtattattactaatccaaatgcagaagtttggattacagaaagagatgaaataccaacctgaatcaaaggcattgatttgtgaaatgggtcaaggcttttaatgttgactcaaggagcaaaattcagctgcagcaggactgcaaatcataagtcaacatgccaggtcaaggttctcaaccccaaggtggaataagttagattctgtgtccaggtgaatgctggattgcactttcccataacaatgaaagagaatttgtgattaagggcaagatagataaaacattctgaaactgagggatatgagaatttttttggcaagtctctagactataaatttgtttcaggatctggagccaattgatttgtttttcagaaaaatctcaagtaaaggaccaggtgatttttcaacacctgttttagcgtatgcttagagacattttgtaattcaaatctggtcaacggttttctgttgctcctcctaggagcccatttcttggatttaggactaaattcattcaaaggggttgtcaattatgctttcagtgatccttggatattcctttcagccactaagaaatcaagataaatcataattttattccagtttgtagttcagccatacgagaaaaaaagccagaggagttaaagtttgaattctcttagaattattaagggctgattgagtgactgaaaatagaacaaaattctaaacaatttgtaaaatacttgtttaacaaaggagaacagtaatctacacagtctcctaagaatctgcctcccgtagcatctagcccagcggactaaggcatgttggtatcctgggaagatgcatttagaaggaagcctgataaaattgactttggcgccacctgctgtccattttctgccagtacagcttcctctgggtgaatgaactggggattaaagctcaggctggagcaaattagaggaggggaaatacggtagtccccccttatcagtggctttgttttctgccgtttcacttacctgaggtacatacagtacaataagatgttcagagagagagagagaaagagaaagataacattcacataacttttattacagtattttgttagaattgttttattattattgtagttaatctcttacggggcctaatttataaattaaacttcatcatacgtatgtatatgaaaaaatatagcgtatataggtagggttctgtactatctgcagtttcaggcatccactggggtcctggggccatatcccctgaggataagtgggaactactacatcgatgttttctttgagtaatgggtcttaaaatcaattgaatgtgagctcttcctacattttctttagcactttatgcattttctctactctctataaagcgagattttggtaatattctcacattaaagtcagaatcatcacatctgtttcatcaacacagcagcaagtattttggcatacaagtttttaaaattttagtccaatacgtagaacttctggtgacactggcagtttattttgtctttgaaataaaaaacaatgctatgccttattttttcaaccacatatcaaagccataatgtatcacatataacactagccacttaagattaaaacataattggtaatcgtggcattgagaagaaaagaaaggctgaaagggacaatattttatgccttcttgaaggcctcaaatgatcctgtttccaagtatatattcatggctgcctcttccctgttgccttcagtgaggaccttctagcactggccataaatacggtgctggccctttcttgggagtaagcaacaaagtgtccataatctctgtggctcttgatcactggtgggatgtaagttccgcaagaatagatttccacagttgagagtgatcttggttgtctcacccctctgagactcagagaggaagatgccttcatatgagacaattataatcatgtagatgaccatcaggaagtaaagagggtggggtctggccacataggtacctctgtggctctggtctggggttagacactgttagggactagcatttattggacttgtaaagacagcacctcagaattagtaactacttgcattttagggtctgttttatgaagccaacaagtgaatgtaaaataggctctgcatcttttctgagagccctgtcactgggcagtgagcatttccaaaattgcagctctgtcagaatgaaccatgaatacttaagaaagggaaagtaggaacagggagcagcgcaaagcataacttgctgtgttccagggatttaaaaataaattactgtcaagagcaatataagggtcatgggtttgatcaggaactttttgtaaatgaaaaagttcacaatttggaaaaaacagtgctagatgtgttatggaaattgttatcacaaattattccactgaaactcaagtatataagacaacaatatattgctgtgaaatcttaattttgacatatggaaggtaaccaaaaataagaaccatacctttttgcttgaagtgcacggtggtaccaatttctaaaataagaaacattaagcaaaacaaaaacaaataaaaaatctttatcaattaagaagaaacacaaaggtaatctgatattctccactgaaaggcgaataagagaaaaggaggaaagaacattttaataggaaagaatattggtagagatggaaagaaaggcaaatggaaagagattgttttgttggaacaaatgatgtgcagttggaggtggcaaaaatgatttgcaacttcaaatacctgatgctacattgtatgcatgtagacaagttcaagaactctgagtatggaatgtaaaggtactcttgaccgcaatttagtggaataatagaatgtgtccgatccataacctcgtcctaccattttgccctggtttattccactcaagccaactggctgtcctgctcttcttccaacagatcaagtctattccaacttaaaaccttcacgcttgcttttcatttgcttggaatattcttcccctagatctttgtattgatcacttagtcacttcattcagatttctgctgaaatgacaacaactcgaaagggactcctctcatcatcttgttaaaaatagcatcttctgttattttctctattcctttaccctgctttactaatctaaatagcacttacctctaacttgacatcctgttatgcatatactttttgcctatttatagtttcgtcctcttcattagactatatgctccacgagggcagcaacagtgtgtgccttctcaaatactgtatccctagtgcttagattagagcttggcaggtagtggatattcaataaatatttgtttaatttataaataagtctcagggtcggaagagctcaggtaggttaaatatttggtttctcttttaagtacctttgtcaagtaaaccacaatgctcttaggtctttagaagcaaatatgtaaaacttctataggacaccactttgaagctcaggaacaacttagcaggtgctcagatagaagagcccaaactgctgttggaatacagaacctgtctttttgtccttgaagcccatcacttgcagttatttctatttaacaaatgcaacatgctgcaagttcatacaaaaagatggagtaagaattctcccctcctagcagaagccagcactcaccctggaagtgaatccaggttctattaatatataaaacaatggtctctagctgttgacgactttctgtatatgtctcatcatctaaccactgatgttttaagttgtgtattaaacatactgccacttgtttcctttcataatacgagctttgacatcttttctttaggatcaacatattgcattaaaaaatattgaaaggcagtgtggagaatatgttcatgaaaacatgaggaaactgaggcccagagaggtcatttgcgaagtgagaggcaaagctgagactgaaatttagggctcccacttctctagacagaacctagtccattattccacaatacccctttggcagtttttatgaaagcaatgcctgtatgactcaagaggtatcactgggatatttaaatgattcaatactggctggaaaggtacgactcttgtgcaaagtgcaactttcctctttcttgcatcaagcctcttagcttattatggtaagaatttttaagaaccccttaaggccacagagcgatgctctttcctaaaagaggcctcaatcctcgatgaggccatcttcagttaaaaaacactaagtttatggtacacaggcttcgtgggaatgatttcaagcaattgttcagaaatccagacaggtaggaagcctggtgattctgctgaaagctttctcttcacctctctttgcgtcagtttcatcatctctaaaatgagtttacttacatgcatcttataaatttgtgctatgaattagatcaattaatcaacatactatacttacaatggtgccagacacataataaatgctcaataaatgaaagttgtcagttttgtggtaaaatcccttctagacaggattattagtgcaattttagtggagagagaaaaatacatcttaacaagtaagtcatggcattgcaagtccaaagaatttatatatatatataataaattatatatatatataagaaagaaggaaagttgtacttttatatatatatatatatatatatatatatataactgcagcaacatgatgaacaaacaatgggagattctagcacaaaaaaagtgattggaggctgggcgcggctcacacctgtaatcccagcactttgggaggctgaggaaggtggatcacctgaggtcgggagtttgaggccagcctggccagcatggtgaaaccccatctctactaaattagcccagcgtggtggcacgtgcctgtaatcccagctactcgggaagctgaggcaggagaatcacttgaacccgggaggcggaggttgcagtgagccgagatcaggcccttgcactccagcctgggcaacagagcgagactccatctcaaaaaaacaaaagtggcccggctcagtggctcacgcctgtaatcccagcactttgggaggccgaggtgggcagatcacgaagtcaggagttcgaccaacacagtgaaaccccgtctctactaaaaatacaacaaaattagctgggtgtggtggtacgtgtctgtaatctcagctacttgggaggcggaggcaggagaatcgcttgaacctggagggtggagattgcagtgagattgcaccactgctctccagcctggcgacagagtgagactctgtccaaaaaaaaaaaagtgacaggaaagcggattgattagggcatattttgatcagggaaagtctagcaatgtgcctgcgttaacctgtcactggcataggtgtgggtaagaatctacatgttctaatggattctaatggatctcttaggaaacagatgctcccctatgaatcaactagagaaagttgattacaagaagcatataaaaaattcccaaatattctactctgtgaagctaatatcagaaaaattcagatatgaaatatacatttgcttgaaatatctttaaaaagcaaaacaggttgccagttaaatgttaagtactcctccctatgcctgtaataaatcaacttctttgtgaaatcctaaagatcttaacagttgggattccatttttctttaggaaaagagaatggaattcttattttggactcttatttcctacccatcaccttctgtaggagcagaacattctgagcacatttttgaaaatgtggttatgtgttgccatcttgtggtaatactaagacatgctcctacgtgctgtgcagatgaatcacctttgtccacgaggtggcaatagtgggagaaataaacacttttttttttttttccagtgtcaggccaggcatgaaatagtactctttaagaggggattttctgttgttatagacagaatttttttttgcatttaacacctaaacattatttttacttttctagtgaaaatgcaatctcatgttcgtgaatcgaactgcattgccagggatataatttttgcagagatttccagggcaccgtgcttagaacacaacctggaacctatgatttttatgcctttcaggaagacttctaactaaatattaatcttgcttcagcaaatacacttaacaaataagtatggcagtgaaggtacaaggtataatagagaaaggtaaatcgactgaagcaatgcaaaacacaacactgggagattctagtatagagaatgtactaggctttctggagaaccttaccatcacatgcttagatcttagctcctgatgaggtggtagaaggagacaatggggaaatgatttaatattaggaaaggcaagtgcctcgagacatttatttaagctaatctgtccttgatttttgactttcagattcattacacccagccacattagcctgcaccattaaaaacattgattcaacctctcttattggcatagacaatacatctgccttgttcactactctatcctcagcttggtatttctctagcacagaagaatggtccagtagatatgctgaagaaatacctgaatgcataaataaataagaaaatgagagactgaatgaatcaattaatacctcaagtgttaccctagataagattctagagaggggagattctattttctttttagaaccacggtgcctgaacctaaggtgagattattcttgggaattcacagttatttgaagagccaatggggccaggaggtccttgccttatttcccaaatcctggcaggtagaacattttctggagggctgagctttattttaaaacaccttcctgactaataaaaatgtgaactttaacaaataaaagcccaagtttcttttgaagatttattcttcttcttaccctttactatgatctcttgctcttatctctcactacgtgatgtgatttttttctctttctctgtctctctctctccccctccctccatccacatctctgaaaaaattcaagtgagtgttgcaaagatgaaagatgctccattggaaactctacagtttatagtttgggaactccctcattatcttaggaaatcttcatatctttatgtgtggaaaattttggcattttgctttctttgagttatatctgggagatgaagtgagggtacaacacattcataaggaaaagaattgacgtttagtgctttcagtcttgacttttgacaacttttctctaatcctctacttataagagttcatttgcattcacatgtaggtaacgtagagtttggggagtttatattgtttgcacagttgttctaattctagggtatttacttgaaaacaaatgtcttatttttcaacctgctgcagccatttgaaaaagaaaacattatctctatgtgtgtgacataagtctttctataaggctaaccctctgatgtgctgcaggttttgaaaatgacataagaataattaatggcacttttaaaattctgggccagagttagtaagagtgtgtgtttgcagaagtgggacaggaaaaggtccaaattcagtagggattttatcctccagttcctgaaaattgcagaaaggggcagggttaaaattattaagaaatgtaataaaagaaacagaggaggagatcatacctgctgctgcttcctcactgatgccaaggacctgaggcataacatttgtaagattctgccatggaaatttatgggttttgccctctgacttctgtttatttatttattggccaaatttttgaaaaataaaacctttataattatagtggcttaaaagggagcaatttttattaattcaattttcaagccacactttgaaagctattaacttctttctcacagatttcttcactcagaggctttagggattagcagcttgtacttgtaaatattatttttttcttttgccatagaaaagtatttgccttgtgattcatatttgaattattagagcttttgatattctcccatgtatgatattcatgttgtataaacctcaatgtcaaatatttctagaataatgttttctgagaatcaaagtactcattctggggctagtgaagtaagaaaagagtcaaaatagagaaatggatttgaatctcaatcttgagattcttcctatatttttttcttttctttctttcttctttctctctttctttccttctttttttttttttttttgacagagtttcgctctttttgcccaggctggagtgcaatggcccgatctcggcccaccacaacctccatctcccaagttcaagcaattatcctgcctcagcctcccgagtagctgggattacaggcatataccaccatgcttagctaattttgtatttttagtagagatggagtttctccatgttggtcaggctggtctcaaactcccaacctcaggtgatctgcccgccttggcctcccaaagagctgggattacaggtgtgagccactgcccccggccttcctattttcttagttaataggtggaccattgccctcatgactaagagtatacatcaaaccagctgagaaaactaagcaatcttagcatgtcatcaatatttgagaaaggaagttggcctcccttagctagatttgggccagcaaggaatgctacactttactttcaaataccgctaaaggcttttcttctttatagttgtctgtgactagaaatggacttcagtttggtgctctgtcagagtaaataatgacataggcatgagtagacagtaccagaatactgcagccctagacagatggtgttaattccttgttgaatgaatgaatgaaaccaaactaaaataatgctggtataatttcttgttgaaaaacgtgaataaaatatttgggcctcactccttatatcaaatattctatagtgaatagaatgtgaaaaaatgcttaaattgtcattggattaaaaagaacacatctattaaaggaaaaatattaatgcgccaacttggagagagaacatatgagcccccacatctgaaaggaggactcttactggggatcctggaggtgcatgagggaaatcccttgtgagtcaatatttgactaagacctgaaagcactttgggtgtgcacatcactgtggagagcaccctggcccaggtaggagggcagctcctgggcctgcctctgctataaccttgaacgaataacagaaacatgcccagcttctgagagcatggaaaaatagaagacattttatgtttttaacttgaacattctgtagtacactggcagctcaaacattcagacaaaacatttgtttatattgcattaatggtgttatctctaaggagagggattacacaggagctttattttcttctttatagtttcatatttttcaaattcttccataatgagaatgcataacatttattatcagaatagaaaactatttgtaaaaacaaatcaatgcatttttttaaaaaaaacctttaaatgtggagaaaaggaaataatcattttctgattatttggcattggcattagtttgacaacattacaaggagaataaattttttctccatttttcagctgggagataccatgtagtaaagcaaaagagaagctaagatgggtgaatcctaatttccaaagcaacatggtcttaacagcaatgcaataaaaaatgttatcatacaggttgatgaggtcctactgaccagaggcttgatgtactgggtattgtcgtataaagtaagtataggtgcatgatttgactttaaccattatgggctttgctcaatggtgatacggattgttacagaaagagcagtctcactaaacactctcaacataaagagaatgctttcttaagtctcttgcaccaagtcagctttcttacattttgagagtttcttatttagcctgagaggtttagtttttaataatcaatgaattgaaatgttccagaatgccaaagaggctaagtttaataaaggggtttctctgggctatgccacctgaaaatatgtgtaagattagataaatcccagaagtaaatttatttggatcagctgtcagtaaggtactcaggactagacatgcagtttctgtcttaaagaagaaacaggtttctctgcccttgtgcctaaaatgcaccttggcccttgtctatgggtgcaaactggccctttgacctttgttgtaattaagagaccagccaactcatttaataaagaactatattccaggccagttgctgtgactcatgcctgtaatcccagtaatcccagcactttgggaggccaagacgtgcagatcacgaggtcaggagtttgagaccagcctggccaacatggtgaaaccccatctctactaaagatacaaaaaattagccgggtgtggtggcatgcacctgtaatcccagctactcgggaggctgaggcaggagaatcgctggaacccaggaggcggaggttgcagtgagcagagattgcaccgttgagtcattgcactccagcctgggtgacagggcgagactccgtcttaaaaaaaaaaaaaaaaaagaactagcttccggacctaaatctacttagttgttgattcttcttagttgttaaaacataaaatagattatatatgtcatatttgtgtttaaaaacataaattttatgtatactctaaagccttttgtactttcatttatctgacttggtaagaaagattaaaaatgcaggtttggataggtctccagagatttacattctttctggtcttacccctcactttctattttccagccccaaattgtgaatttctgatctatttttgaatacattttaaatttaaaatcctaaggcatgcaagaccatctttaatctacgtaatatgccttttcattttgtatgttttaaaatcaaaaccattcaaataacatgaaacgaggtaactggcctgcagaatttgaatgcaaagataacaagtgaatttgtgagatttcccagggtttttaaagctcctggaaataaggagataagggattaaaaaatgttggtatgctctgagtcacccttggacctacctctattgcactaactaccgcagtgcagaacttggtaaatgtagttctgctttggactacttccagcaacattattctttggagttccagaatgcttcaataacaagtttggtttatctataactcctgctatgtcagtgactccaaatataacattatagccaggtccttgtgcaactctctgaaaatactgatggctccttacaacctatttctacaactaaaataaaaacctaccatcaaacctccttactgaaaagctgcaagttttctctagacattctgctaaataacaggctgtcagtatcctccagaaagctaaacctaaatactaatacctaccacacagtacataatatccatgtgtgaccatacaattaagcccacaagtgcttttcctggtcctgagtgtaatataggtgaaaatgcccaatctctaacctttatttttatttttctagaaattatctttattttttaaacttgatgtattcgtataaggtataaagatcaaatgagggtaattgggatatccatcactttaaatatttatattttctttatgctagaaatgtagaaatctttgaagtattctagctattctgaaatgtacatacattgttgtaaattatagaaattcctcacctttaactccactggtttatcatgtttatttctttttgtaaacaggccagatgcaagacaggataaactcttacgtaaaaaatattatttttctagatttaaaaaatttattaggctttatagtggatccctgtgagttaagttctttctggattctagacctttgcaggtagtgggttgtcgttctcttcccctgcttcttctctttctgtcttttatttttatttttatttttatttttatttgagacagagtctcgatctgtcacccaggctggagtgcagtggcgcaatcttggctcactgcaagctctgcctcctgggttcacatcattctcttgcctcagcctcctgagtagctgggactacaggcacctgccaccacgcccggctaattttttgtattttttagtagagacggggtttcaccgtgttagccaggatggtctcaacctcctgaacttgtgattcagcctcccaaagtgctgggattacaggcatgagccaccacgcctggcctgtttctgtcttttaaacttcactttcacctggaagtcttcccccattagcccagactagctaatgtgccctggtttgttctccccaaacacctaccagttatcttcacatggacttaaagtttactgtggttgcttagttcattaagtacttctccatttggtctgtaaaccctcttagtgcagaggctgtacctgcttcattctcctttgtcatccccaaaacccggctcagagcaaatactaagatatttctttgagtaaatgaatggtgtcgtcaagatattgtgcatgtcaaattaacttaacctgtgccaaaaaatgagtttttaactgcctatcaagaatgtaacctctttcttgtgttcctaatgattagaaatcataatgaaaagaaaacgtgacctctaaaagaaactctacaaagcaaaggcaagagcaagtggagagtacatctaaatacagaaaaaaaatcatactatttacgagttagaatgggaaggttgatctcccaacggaagaccagcctccaattaatgggatcattccgtcttttttttttttttttttttaagcactgctgcacttaacagctgtcagcgataaacttacctgtgttctggaacttcaagggagaaaaataaaacaaatttcccaagttactctagcttgcaattcaacagagaagtgcaagttactgcttggtttcattttgtttgctttgttttgtttctagctatttctgctctccaaatatccccagcttccaactcatacaaaacccacacgtatagttgaaaaaccactgtaggatggccaagcaagtttccaacataaaacatggctgggaatgcttgctgctgtgtgagctaaggagcatgggatggtaaacagaatggacacttggccaaggcacggttattttctactgcttttttttttttttttctacaggatgctactattgcctccaaatgtctttttaggctttttaggcagttaaaaaggtcatactgagattccgaggtttagaaggtgggtgcttaagtcagaatctttattgcgagtatggggcagataaaaagtagaatgaactattagctgtgattgatagtaaagagactatgtcagtggtaatgtctgggtgctaatcataggtatgtgttacagagatgtgggaagcattttcttttacaatcagcacagtgataagcgaaactatagagtaaactatggcagtgcttggctccccagggtccaattaggaagcatgataaatgacttgtaaggtctcttccccactgatctgtggtggatataagctgacattctccgtggagtcctagtgagtagtctgcctactcccatcatacatctcagtacataggaacaccttaaattggaattccaaactcattatgccatgctgtgttcttacttggcaggtgtgtttcttcacagcagtatacaaggggaggtgtaaggtgggatctctcatactgattttttccccatcaaggtgcttttttagtttaatacctacaaataacttgtgatgatgaaagaatatcatgaggctgcaatgactgtataagggaaattgttaactaagcttaatttgtatcttgcctcttcagaagtcaaagctttctccagataggtgggataagggcttggtggtgcttgcatggctagtaaccagtgtttagaagtgaatgtcaatactatcaaaaccttttctttggttttgtctgaaagatgtcaaagagaacatgcatacgtaatgcctggtaaatatggtggaaaatgtagagaaaggagccaaggaacaggttaaaattaaggttcatactttttgggttatcataagacatttgtcaggggctggtactatctcgatgatttaatacttgggagagttttttttgctgttgttttttgtttgtttgtttatttgtttcctctatgtactaccactttttaaaaaggactctcactccatacagtctctgaacccagaactaagttcccaaaggaaggacttccttcctgtctaaacacaacaatgtttctcacagtcgactgctatgcccatgttaactggcacatgaggcagactcgagagcaagcagtgctgccgtgcactctaaagaccagaggagcctgtgtcagttttctgtccatcaagatcctggtcttctcaccctttggggcagcatgccaacattttctgctgcaaaatttcattgagctcctcttaggcagctttattccttttaattaaaaagacaagactgccaattacttaaacctaatccccaaatgtaactgttactttgaaaatttttttttctataaagctcatagaagagcaatatttctatcaaattaaaatttagtggaagcttggatttttgttaaaaaaaatattcattttcaaatccctgctggctctagacatctaaatagcacagcaaggcattaaggacagggagctcaccaggaaaggctgactggtgcaggcagatccagattcgaaaaccaggaagaggcattagaaaggagttctaggcactagaaaggactaaacattctcctatctttaaattgactctgtaggatttttagtcatttagcttgaagctaaatgtaaattttgagagaaataacacttccaagcccttgttgaacatttaaataatggtgtgaataaattttggatttattcttgctagcaacttttagcaggggagagaacaacagtttaggaaacagagtagaaggaagagtaaagaggtgggggagataagacacagaaatggggagaaaacctccctattacactgtgtcaaaatcattggattgatgagtgaaccattgattccacatgaaatattggtacaattatcccgcttgagtctctaaccactaaagaaaatcagaaggaaatcagactattgttcccataaacgagccagggaattaggtatgaaggtcaactcaataattttcatgtgtattaatcagagccaatcattttgttgtaaattggtgctgacatgtctgcctaaattctatttgtagtaacaaagtccttgtttctgctaaccagtgggaaggagagacatatttaaaaagggaaatctttcctaggacatactttatacccttgaccagcaaaaagggcaggtcctttaggctgatgggttggcagtcatgtggtactgtgtatgaagggcatccgctgaaagtgtgtgagtgtatatgtgtgtgccacacaaccaggaactgtgtgcaattttgcagctcttcttaaatgtaatattatgatattggtaagaaaataatgaaaaatattttttatttggccttaggatgcttctacattaaaacttcagcagtgtggggatttcagaaatctttagaatccataatacatcaaaatataataagaatacattgaacttatatctagctgatgtccatgcaacatgataccagtatacctgcaaatatcagtgcttttaaaaattataagacacatgtgtatctgaatatgattattttaaattcaatatgccttctaggaacttgaagctctcttttgtatattatttaaaataccactttgagcttgtaggcatgaaaaatataatttctttcccatttcacagttggaaaaactgaattacaggaacaatgcaagtaattatccatgattaatagaggtgtatatgtaaatcagcctgaataagtgtgtgaaattagatgtaccgatgccagatagctctgctcaagtttttaaaaaatgaatgctttcatataaatctgtgtgagttgggcatacatctcactgtgctaagcatatttgaaaatagattttgtaaaaatgtacagacgttaaagtaactgagtgttataagcattgcaatacataaaacaaattagatgaacatttaaaatccattgaaaagatgcatatctaatgaacatgaatgtatacacaagggtgattattaatatactatagatttgtatatgtgcctgggtgcaataaggggtaggttgaaatgtaggtgtcctttgatcattaaaaagtgtgggagaaaggtgcacgtttctttcttagggttttgggagttgagttaatacaggcaaaagccctttaaactctaatggtacatgagaaggccgttatgtatgttagctgttgttattattaatattattaccattattaaacaaagcaaaatactgttgtattaaggagctgaaaataagctttttctttttaatactaaggatggtattctacagaaaataaatgaaactggaaattattcagtgatcttcacagcatgggatatgttcaaaatttttctcccattttacctctcatccttttggaatttgatttcaagaatgtattactgggaatgccaggtgagggcaggtacgccctctcctctaactgtagataggatatggctgttctgatgccaggcctgcctgtaggaacatgagtcccccttagggagaaaacatgccaggacgacttcagatttctgcaagcctcgcttgtttgtggtttggattttaatttctttctaaactttaattttgggagtgggggtttgttttgttttctgaaaaagctttggacagctgtattaatcatgcaaacccagccatgtgcaatgcattttatcaatggaaaaacagggatggaatggcaagcagctgtgaacaaacctggtgccatgcctgaacctgaaagataatctcaacatttcccaaacccacttgccacacggggttagtgaatggaaaggctgttcacttgggataaataatcagatgggaggcaaacaagtgagacacattccaggatttgttttgttttgtttcaaagtggcagtgatcagaaagggataggctgattgagtccagagagccccacgctcaagggaatttttcgcttgagagttacataaacaaaacggttgtttgcccttgtctttgccccttgtttcacgtctttttaattttctgaggctggtttcaacacttcattctgaacctacggtcctcaatgtgagaatgtctctgggtgcacttccattatgaagaagagctaggcacaagtaaactgatggggagaaatgttatcattgctcagtacccagaaacctcaggaaacaatgtcaacctcacaaagtgagaaaagttcccccagacattgagagctgactctttcctcattttgcaattcagtggattttctgcagcaatatagtaggaggtatttatgcaaatttatgcaattcaggactcacttcagaataaataaacctaaattaaaattaatggaagaaaacacctatcagaaacagatcaaggatagaacactattttatttgtatcttttaaactaaggaggaggaaagcaagctggttttatattttgttttgtttttggcagatgggggaaggatatttgaaaatttctgattggacacagccaatataaattacccattggtggaattccagtattattattatcactgcagaaaatcaagcaatatgatgaaggaaacccaagggaaatgcatttgatttattgaggcttgtttttgtttaatcacagcttgaaggggttaggactacattcctgctgcgactctgctgtgcatccccagtcatcttgatgagccatgtagagtggggataggagggaagatcctccaatgagagatattaataataaagcagctgaaatgaaacatacatctttgtgaggttggaaattaggaaagaaagttttcctttttataatgggaaggcagaaaaaatctttgtaacttttgaaacacccactttcaaaacaccttaacaaaattaattgccttaaaatttttaggccattttacgtcaaccaatctctaagagacaattgatattttaggaatgaaatttaagagttcataaagatggtgacaatatatgatattcaattaaatgaagataccttgcattatagctatgaccacagtgaggcatgcttctcatagatatttgggtacttaactggcaccataaaaatgcttaagcatcctattgttagtatttctttcaatgggaagctgcatttcgcttgggttaacctcgattggaaagaggagaagaaaagtgattcaatccctaagaagttaaagtccttgtaaagaacagaaaacttaagaggggactatctttgtatagcaaactctcacgccagccatccgtcttaatgaacagcttttcaatttccactagccgaagaccaaagtattagtataagataaactatattctctaaaaactattggatctaagaaagctaactacagtctacctacaatgtaaaatcaaactagggtcattctccaatcaacagttcagtttgtgggaaatatgaagttcaagaaaatccctcgtgttccatccctagtccagactgtttttcagtatccgacagctgtcttttgtgaatggtgtctggcttcactttgttgaaagttacctatatcataatgcacgattagataaatacttgagttggtggctgcagaactgctctcacaaatgatacctagagtcacagtgataatgtacaaagctcatctcagatggggcacgacctctttgaaaatgctatccaatggtacaaatgcgtatgtgtgtgtttttcatatcaatatatttgcaagagggcaacatgataaagtgatgtcaatctctgcagcaacactagaacataaatgtgttaaaataattgtggtatgtcaggaattcaaaatgggatattttccatgaacagtaagtatcatgtcaagtctaaaaaacaggcacattttaacagtcttatttttagtggctgggattagaaacagatttcattgttttagggaagttttttttttttttttttgctattcaacagagttattctaagctttcatactaaaaatagtttgtcctctttttaaaatttgataataactcttattaaactgtctagttgatccttgaaaccttgcaatccttagttcgaaaataattaaaatatatttgcatatgtgaatgcatatacatgcaaaacattgcattattgacactgaatatctacacacaagtttgcaagagtttatagtttggacaaatgttaatgaaacatgattcatcttcaaacttataaaacagcagctttctacctttaattctgagcacattgcctttatggtgtgtatgataatcttgcttaattggatttattttttccacgccaggtcccgcatggcctagtttccgtttttttctcaggtctttgagtctatttgcaaatcacttttctggaatttaatttcaatggtaggttggtttcatttcagattttttatattgttttaattttatttgccaatttccctttaaatagccttaagctagaaagttgtggctgcaccttgcgtctaaatacgatgtaggaggcaaaatttaatttgagtgcatagaaagtttatgaaaaggaattctgaatgattatcttgttttttcatttatgttttctaagacaggtacatttaaaaggaaagaaaaaaaaaccatgaattggccaagattttaagaaaaaataacatctttgttataatccggttgagttgattaacctttagcaatatatacattaatttttataagtaataccaatgacttcagattcagactgtataaacttccaactgtgagggtagtcagtcagagaattggtatttttgtggctagagaatttaactggctgtgtcccaaatatgtgagttcctagttccttgtaataaatattgactgtagaaaaaaattgcttgctgagtttagtattgccttcacagctactgaccaatttgaagatgagtcagataatagtcttgttccatgcctattcaactggtgttggaagcaactaattggctttttaaaaaaggtttaagggaaaaaaatgatttatattgtatgtgaattttttgaatgtgttttcccccctttgtgtgttttgcatgttaaagatgatggagaatgacccaggaagagagctacagtgataaaaatcatactgaccttgaatggggtgggggattgtgggtaaaacacgttctaaaggggaaaaaatagtaatcatcatggagattttaaatattatatatatgtatctttctcatgtttagttattcaaacaattatacaacagatgaatttccatgcttacaggatcatatctctcataaaacatttgtctgtacttcctattaacattaaactatcaaagaaatttattaacaaaattaaaaatgcagagcctttaaaaagtttagctagtataggaggacaacatcagattgtgataaccctacatacagaatcctactggaaaaaacccaccaccaagattttagatcttttagagagttgaagttgagggtatttataatcgtgatcaaattcaggtgatacatcttggtcttggttctcgtctctttagctcatgatagatgaacgtgtgtcagctacagacttctttcctctctctaagccgtatagttcacatcagctttagccaagcatttgaaaaatttactgtggacaatactagctcaacttttcccttaggtttttactttacattactgataccagtataggagtaacatcaaggtaataaattcttagcatgttataattttatttttagtctattccttaattccccctctttttataatacattcttacccgaaatttgatcaaccaatcaaatttgcttggtgatacatcctgttgagtataataagaagtacttttcttttgaacactgaggtcttagcttaaaagtatctgacagtcccatacataagctactgaccatagatagaatgtactgacagagttcagaatttaaggtggccttcatttatctcatgaaagacctaagattaaattctcttctggggctttttcagaaatatagaatggaatagtagggataggatgtattatttgctaactcccaaattatatgatagtgtaacataattagcacacacttttctatgtttctcctagcagcttgattaaataaagaccaatgagaaatgaaaatcaacaaaaatcaaaaccacaatgagaaaggcatatgtgcatattcaaatctgatagcctaccatcttgtgccttatgcttaaaaagagtagattttacctggactttgggcactggatacatctggacactgagaaaactcagtctccttgcagagtcagcttttctccagcttggctgaagttgtcacttaaatatgaaagtttcctaagtccattaagatggagcaggtcaacagcagcccagtgaacaattgtgtgttagttacacaagtgtcaagtagaaaaatggtttaagcctccactggttatttggtattaagtttctagctttgaaaataaatagctaaactgcttttagcatttatgtagcagttggagaccactgttccatattatactctttctactgaattttatttttattattactattattattagactgtttaaatgactcagcttaatattttctcatcatgctgttcacagctgggtaaatgcactctgcccttatttccacatgaccatttatattgctaaaccatcttacccaccctcctttcagtgcctttcaactgcttctcagcttgttattaccgtcttagctccaccctgttatcatcgtcttaggcctatcacgccccattagttattctcattctcttaattccatcctattcacgtatctttccttagatgcttctccatcccaatttttattcttattctttgagcattattctgctgctgttttacacttcatgctagggtttgcaggatcttgtaagagtgtaaagtgaagtaaataccacttataaggaaaacgaaactttccaacttttgattttcaaactaagggagggcagaacccttggtgctatgcacttctcctttggcagctgctacttgaggaggaaaacacacttagcagctgattgggagattttgggaacagaactataaggttggccctatatatgctgtggctatatgcacagctatatgctgtggctcttagcaaggtctcttaactctcagctttggtttcttacctgctaagtgggtgggcgaggggaggcgagatgtatccacagagcccatttaaggagtttgcatctagtgcttcaaactacatgtgggtagatagcagcttaagctgttttattgtgtggcatctaaaagtagctggttaaaaggctttgccaagtcttcattctgtgacccaggttagagtgcagtggcctgatcttggctcactgccttctgcctcccaggctcaagcagtcctcccacttcagcctcctgcgtaggtgggaccatgggtgcacgccaccatacctgggtaattctttgtatttttggtagagatgggtttttgccatgttgcccaggctggtctcgaactcctgagctcattacaggcttcagccactgtgcttggcctaggctttgccaagtcttgactagcatcatcaagtgctgtatgtttaaacagcaagcctttccgataataaaatgctttttaaagaaaatggggaggccctcattataaagactccctctagtggtggattactcaggtagcacttgaaatttagtcaactatggctttacaacttaatgatattttaaagtttaaaaagaaaattaaaaacacctcctacacacggatgcagcaaagcccagtgtagatttttttttttgtatttttattcttttgtactcaaaagcctcaaaagacctttataatccacacatttttctaaagtacaaggtaatcaatcagtgggattgttctttaatgtgtgggaatattctcctccttattctcctcctagaccaaacgctgactactaggctaaacgctgactactaggctggaatattcactgagaacatcaacatgccaaagagaagccaatcatcgaactaacctggtggtagcaggctactgggagttaatgaaaatggaagtgggaggcaacacaagcagtgcccttgggtgggaagggatggagcagtataaagacagtggaaaggcctcgttgagtgaaaaaaggagaaaaaaaaatagattctgctcacctcctaacttacaagatatatctcctaatatttatgcccacatacacagatgcagataatgtgttgatttagggcctagactcttgaaatagactacctgaatttaaatctcaagctcagccttacttagttgcactagtcacttaacttttctatgcaatggagaagcacaagtacatagtacggttgttgtgatgcatgcctgtagtcctagctactcaggaggctgaagcgggaagattgctttaactcaggagttctgggctgtagtgtgctatgctgattgggtgtctgcactaagtttaatatggtggcctcccaggagtcagagaccaacaggttgcctaaggagggtcgaactggctcaggtcagaaatggagcagatcaaaactcctatgctcatcagcagtggaatcatgcctatgaatagccactgcactccagcctgggtaacatagcaagacctgtttctgacacaaaaatataatttttaaaaatcagatcatgtatctgaaacatttagcatagtacatactgcagagtacattgcactcacttaataagaagtgacaacctttaaattatcacccatcaccctttcttcctccatgtccgttattttaaatctaactcaacaagagcatgaaacaagataaacctatctatcacctttgtgggtgaattttagttatcagtctggaaacacagtctgttatgttacttatgcagatggtggaacttgtcttggtatcactcgaagtccaagttttcatctatgtcatgcatatccccgtctgagaaagactagggagctgaatccttggccatacattgtgccattggattaatgtattcaaaactttaatataaggtaatgcttagcccaaggatgaagaaaaagatatacaaggcattacttggttataccgactgaggtagtgtggatctttgacaaacacggtgctagaatgtgtggagaactagatgaatgagaaaggaatgcttccaccagctcaggaaaaatttactatgaatacaatgtattcttacaccctcattccatgattttgacccctctggagatcagtatttgaatagagagtggggaagtgtatgtatgcatgtgactgcaagtttacactgtgtgaaaagtcagctcatcactgtggtggatacggctgaaaatgcgctgacacaccaatgaagatgaataatcgccaactcttcaggggctctggctctgggtctctacctgctgctgccgctggctggcagaggctcacgagctgcctgttcttctctggattggcttggtcagcagagcaccccgctgcccacacagtgcttccgtcagggccgtggccacagacacctgcccccaagcatttctcccctcctgactctgttctgtggaaaattacctctgctgacacttgcacagtgtcttccttttccaattaatcccatttatttgaatgtaagtaatagacaattgacccacacgtgtactgttatcttttccctccttccctccctccctcccttccttctttccttccttccttccttctttctttccttccttccttccttccttccttccttccttccttccttccttccttccttccttttttccttgcttttatctccctccctctcttttcctttcttttcttttagaactctgtgaaatataaagttctagctatgcaggttgtaacaatagacctcccaaaactaactggtggtgggtgggtggatgggtggagggagtgtcattcctgctacaacagaaggagagcttctcccccaaaatgtttgttcttaggccttggatctaagaaatagtgcaatagattcaccaatattctgcaatttgaatagttcctttttgcctcaaagcttaatgatctttcatattctattttttcagtaagtgttatacctcctaactttcccataaaagtgggacatctattctaaaccaaatgctgatgcatgtggtgcctctgcatgctgccaaagacacaactatggtagtgcctatgtgggaccaccaggaagtacatcattaatcactgcaccacacaatcctcaaatgtataatggagggtgacttctactaaatcataaagggcagtgtgataggatacacttgtctgatcattccctgattctcagtatacaaacagaagctctgtaagattcttgacatttctcaatttttctgggttaagtcctttaaatggacttctgttatagggcattggtattgtagggcgtgatgttaccttccatgaccacgagcagtatctcattgcctttgaccaactctatgctcactttcccttctccctcaagtattccatccttctaacctctttctttttcctctctctcaggctatagatgatattttatttattatttgaaatatatcattagcatagttcttagtctaggttaaatagaaagaaaatatactttaatgcaaatatgtaattgcttgctttctgtaactcatccaattgttctatcttctctttactaatctctatacaaccttctttttaagtttttaagtgaatgttgttctgcttaaccaggtcaactcagatttggtaaatcttaaattcccagttgaggctggttccccccgcaccccccctctcccgctgccatttatggaatccttaatgttaggaatgaatcaagtaactacagttcttaagaagtatattctcaagcgtcttagggatattgatgtctctagttgaggcaaagaatacttatgtttggtctttggagacaagtaaacatgttgtgaattttaaacttcatatggaggcagcatttgtataactgtatctcatcaaactgtcacagactgaagtcaatgagagttacaaatgagaaactaaaggccgaagttagagtcatttgtggttgtttttataaacggagttggatcttaaagagttttaaaatggctttaacactacatttcaagagaactctcacttaaattgattttttttctaaaaatatttttttcttgaaggctcatctaaatggaatatagcaagatagaaacatttcttctggtcatagtatttccagtttttccaatagaatctgtgcagaaaaaaaaaacttagtggtttgttattccaaaataataacagtactttttttagacttttccctttagtccaaatgaactttctgattcagcatgggctaacttttcggtttgttttgcttattctgacaaatgtgtctctattccagatgttatcattttcctgtgactccatttagcatccttctgtttctcagagggcatcggcatctgcttctgtgctcatagtcacctgcccaacaaggcagggtgttagagacttgactctaacttgctgctaaagagcaggactccaagatggggtctcctattaacatcagtgtctttagaatgaccattctccccttgttctactttcaggatcttctctggtcttcagaaatgttcctctttcctaccattccatctctgttccaaaaatatatcagaaaagtaatgtctcttactgtcatacagaaagctttctgcaaccatttttcctcctttagattttacattatgtttttatcatttattccacccttcctcttgtgttgttaaaaatatactttctttttccagcctctcccttctctcagcaccttatctattctcactgaatatttcttcctcaatcactcttatcactgccttcaaaacaaaaaacaaaaaacactgttatccatttccaggcttttacatcacctctgcttcttaaaggaccactgccaaagagacttgtgttctctgcatattatttcatttaactaaccaggaaaaaacaaaaaacaaaaacgaagaaaaacaaacaacaaggcagttatcagaagtaagaaagactatagagagaagttgttccatttataaatctctgctatgcacaggagttgagaaccctgtatttttgtttcagtgcatatatccttatttgtttttaagtgaacttttaatagctaagggaatggttttcacgtttttcatgtgaaaagtcaatttaattccatcaagttgggccctgctttggcatacttactgaaaaggactaggctggcattggtgacccccagcttgttggcagccacacaggtgtagttgccgtagtgctcctcagtgacgttggtcaccgtcagggaagactggccctccgtgctcttaatctcaaggccattggcactatttatcctaagagttcaaaaacagaagaatagaaaggatcactggtgaagattttagcttaggaattctttccccatcctgacactggaggaaaaggagagaaaggaagtagctagagtttgttgttccatgcccaattcctattttaactgtgcaatgccatattatcagaatcaatgtccatcaacagagaaaactagggaatgggtttgagtttctgttataggcaagaaagacatgcaggtgaaagctacccattgaaccgtttttatattttacctgactgcttttgggcttcagcttaagagctacaggccccaaagaatttgataagagatactaaaaaggaagagtgtgagaatatagttctacataattacaactggcttggctttggctttgttgtggggattctggtgtccccaggcccatgcagtggagtcatgggggatggtaggtttggcacatacctagtgtcatcccggtaccactcaaagtcaggtgcaggcactgccgaggcctcacatttgagtgaagcttgtcgtcctgtggtggcttcattgctcttggattctgtgatagtgggaggatctgtaggaaggacaggcacacaagtttacatgagggtcggggtgcttagaatttctattcaggaaggaatgaagaaggacaatctgattagagagaggcaggaagggagccatcttaaagctccatttgtatgaattatgtgatcagctcaatggggttgatcaccaaaaaagtaaataaaaataagagataattaatgaaaacatagacttggtttacttaaatgagacacttagcagggttttatggaaatggaatctagaatttctttatccctcctccagtaggtcatggtattacaattacagattataaatatttgtatagttttttctttttataaatgaagcaatgataccaaaggatttaggaatctcaacatataatttgaccatttttctttttcttcttgtcattatagtttgagatggccttgaggagtctgatgaaaataatagccagctaaagcctttccaacccaagtttggtctgatattgttgcaggattcagaaacaaacaaacaaacaaaactaggattaggtgactaccttcttttattttatgtgttcccttatcaccacaacccaggtaaatttagcttttatgtgtgggggtacggtttaaagtctatcctggtgcatagaagacttactggtatatcagccttctattctctctggcagttgggcccttgatttttatgcccaggaatgggcctacaaaactatcacaggcttgaaatcagctgggaaacacatttgacgctctaattttccatgactcattcaaacattcatatgaggatggaaagagtgtttgcatgtccacttgactttgttaggattatagactcaagctcctgaactggatgatgctgtgtttgtgcaggttatgggccttcaaggagagaaggcctttcctgtccaaaggttgtttgccagaaaatggcaacttggctatgtacacatggggaaaacagacccagacactctgtttagactctgtagaggaaaaagctcatttaggaaaattagtaaagtgaacgttagtgggtaaattcatttaaaccctgcccttcagcacctggtctatattccttgtttctgatattttttttttgtattaaaaaactattgcctaagttttctacctatagaagactgcaattctctgagtttaaaagaatgtacgagaaagcatctgatttgtctgcaatttccttcctgattttatcttcccataagcttagacatttttaaatcactgtcagagttacagcacatttgaataaacacttgtatgtaaacaggcgtgctaaatggagttttgttgttgtactgctgttggtattgttgttttgctttagacttactgccttatttccgtataagcactaaatgggaagatgctgtcataaaacgaaccctggattggaaactaggagtcctgggacttagtttgagtttggctgtttggacttctcatcatacgttttctttctgggccttggttttattacctataaaatgagggaatcctattttaatgatttatagcatcctttccaactgtaaactatcccaattctagttaaaactgctcattcttttcaaatgagtggttggcataattatgatccaagtgtattttcaaacccttaactaatttaactcttaaattgctaactttccaaattataactcatttatctattccatggcttaagaaccaggattagcagtcaagaagaggaaatttgaggtctgattttgactctacttctaaccagagctgtggtctgggaaaacatctgtaccagtttgagcctttttcttttttatctttttaaaaaagaagctagcttctaaaattggttatatagatcattagagcacatcagttcaaaggataatgcaatagttggtaatagtggtgctgtgggggagatattaataaagggatgggacacagaatagaggttctgggcttggatttaaaatttggcagacatgagctcaaatccaggctctgttcctcattgtccttcctcgtttgagagtttaatactttgccaatagtcacattgcttccatttccttatctataaaatgttggggctgggcatgatggctcatgcctctaatcctagcactttgggaggcccaagtgggtggatcacttgaggtcaggagtttgagaccagcctggccaacacagcaaaaccccatctctactaaaatacaaaaaactagccgggtgtggtggtgtgtacctgtagtcccagctactcgggaacctgcggcacaagaattgcctgaacccaggagatggaggttgcagtgagccgagatcgagccactgcactccagcctgggcaacacagcaagaccctgtctcaaaaataaaaaaatgttggaacccaaggcagggaagtgcatttgaaggctgagagatattaggcttcagaactgatgagactagaaatggatttcataagggtgaggaaaagaaggagtgttgaaaaggtaacactgtgatttctggcttgggcatctgggtaatgccatccactgagataagattcataagtaaagaagtaagacgaccagcagtagaatactcaataaatattagtttccagtcctcatttcttctcactgtattgtgttcttaagctgccagtgactccataatctgtagcacattggcccattgatgttggctgaagataattttgcttatgaattttgtttgttcaatttcccaatttgtaaaataaattttaactactgtttgtgagtttctggagccacatggttataactgccaaatagtgactatttacccttggtcccctaccactttgggacccggggaaggaaataaatgatttttctgattgaaaaatttgggaagaagaaactgggcctgtttggctcatatctttcctttcttccttttgggaccaagcttctggccggtagcagaggttctcctcttttctccatgtcagaaggcttatttgggctctctcctttctgctttcatgtgggcaggcccgtcccaccccagggttgccatgcatgactggggaggtaagtcggccacactaagctactatctctagccaccttgatctctaaaaatgggaacatttaggtctccctgaccactcttttccttacttctcaatttgtttggaacctgaattactaagcagcaagctatttattagcccctcagagaccccagcatggggaagctggcagcaaactaggattgagcacttacaagtgcattaatctagtcagttacaaagaccaactacttgcttctctctttgaaaacttaggaattttcttgtaccagggtaaatatatgaatactgataaatatacaaagagctcattgtttctaatatttttcaaatgacaccatggtgcaagtttattttttcatggcttattgaaatgaacatttcaaaattcatttgtaatgaattctgcataggtgaggctaagaaagactattacaaatcatactgcagcatgctttgtgtagttaaaataatagatgtccttattcaaaatatggttataataaaaatgtggcatcataaaaatgctgcacagagaggtccattgttattctttatgtgactttggaatagcttacaattgtcaaaggactcttccagtttatattaattcaaaattccacgttctgaaaatattaatagggcctttcttcttctgacatcaccaataacaagactctttcaatcagaataaatagggtaacaaaacagaggactaggaaataaaatatcattcatttaatcttactaatattgggaatattagtataaaagaataatattctgaatagaaaatttaatgtatagtcatttactgcatgtcggcactctaataggttttagatatcctctttatccaaataattagccctaggaagtaaatatgattaaccccattttatgaaagagaagacaagtttatagagggttagtaagttgtccaaattcacatggtcagtacttgacagaccatggatttaaccccaggtttatcatgctctgaaactcatgctctgaacctctctgctctggtatgtctatttgaatgaattcttttggagaacaatgaattgctaataggaaaaaataccattcaggggagggagcatgctggtagatggaaaggtaaatgttgcatatttctattatttacagggtacaaacaatggcacaacatgcggcgacacagtggatataaacctgtattaggaatcaggaaatgcagactcaatctctgctattgccacttggattgttaccatgggacacaatgctcccttgcagcccctcacctaggaatatagacaatgatgcctgcctgtctatctcacaggtttgaagtaaagatcaaatgaaatcagtaatatgagagcacttttaacgcctaaagtgattgcacatattattttatagtattattattcacttggtatcatggataaagaaaggactttggagttagacctgggtttgagttccaagtctaccactcaccaaagctgtttgattttgtgtcacagcatgcttacactcactgagctttatttttgtcctctctacgtggggatgatatagttggtctcccatgggtagtgtgcagtggtataaaaagcagcagaggcagaggatgtaggccataagaaacacattgtctgtatagaatttagaaatgataataaaactgatttagaattgcttttttgtaagttaccatgtgccagcaatattaaacaatgtatattaaataatgccagtgataaagtaaatacttctcactggggcagaccaggcccaatacaccttccaatttggttggtgatatggtttggctgtgttcccacccaaaatctcatctcaaattgtgatctccataatccccacgtgtcaaagaaaagaccaggtggaggtaattgaatcatgggggcagttcccccgtgctgttctcgtgatagtgaatgagttctcatgagatctgatggttttataagagtttggtagttcctcctgcactcattccctttcctgccgccttgtgaagaatgtgccttgtttcccctttgctttctaccatgattgtaagtttcctgaggcctccccagccatgtggaactgtgagtcaattaaacctctttcctttctaaattacccagtcttgggcagttctttacagcagtgtgaaaatggattaatatagttggccactgttggtgtgatgattacagtgaattgatatgaaatctctaggagagtcttggtactctgaaggtacttagaaaattatggttcttgtccatattgcaaaattataatgaaacattgtagtactctgggttgttactgaatatttcctctgaagacctcataatagattcatattaggatatgtctttaccattacctacccacaggcaagaataaactaaagatgagcatggagactgaataggtgtaactatgaaaagctagagaagctggccagtctggttccatattaaacagttattttcctggccaaggcaggcagatctcttaaggtcaagagtttgagatcagcctggtcaacacagtgaatccatgtctctactaaaaatacaaaaattagtcgggtatggtggcacgcgcctgtaatcccagctacttgggaggctgaggcatgagaattgcttgaacccaggaggcagacgttgcagttagctgagattgggccaccgcactccagcctgggcaacagggtgagaccctgtctcaaaaacaaacaaacaaaaaagttattttcctaatgttttctcattaggtgatttttgaatcaaatcactgaagataccagttaaaatacacatacattatctggaggcaacaggtgtctccagtcccaattgggtattctgtggcaacctctgcttcctctaaatacatggctatcaaatgtaaggcaagctcacatttagaaatgtcagctccccaagtgccccagcatgggtgttggttgggttgattagctctagacaccagggtggaggcagaactgaattcaaagagacagacaaataaagggaaaaggagttgtgagaagtgacaatgtgaacctatttggagagagacctgtgggaaagtggaaggtgggaatgtcagctgttcaatggggcggggacaggcttgagagctgggagcagcttttaagagaaatttctccaggaataggaaaagagtccaatattgaaagagtctagataaaattaacagtttgtatttgttaaacatttactaggtgctagatattattctaggtgtactgggcactaggatgagtcaagctcaaaagtagttacatttaatgcactgtgaactgaaattgaggaactgcacctagaacctgcaatgaaagaacagagtgtccctaggactggtatctgaaagaaattaacagctacattgtgggtaagatacagaaagctgaaagtcctgtctattgtctaaattatactaagcttatttaattgaagagattttgagccaatattttagctttccgtaaattccaggacctcctaccacttagaaaacagattttgcatgtaaaagtggctatgtgtaatgctatatgcctactgcagagaagtgctatccaaaagaagtaaaaaggagagaccatagagtccagcttgtgagctcaacaggagagactgttatgtctctcttctttactgctctagtctctcagtgccctgcaacaaacatctgttggcaactgagtaaatgagtcaaggaagtgctgatgggagaaagttaatagccctgagattttttttttttcttgtagtggtactcagggtctgttcattacaataatctatttggccagtagttatctcaaccatcctgatcccctgacctaattccaaagcctgtgttttgaaaaggaagcagaatcagtttaaataatggatttcatggccggtaggattagatgaagtgacagaggtgatcctgggcatttctttgcatgtaagagtgttgctaggcagacttggttccataattcaatctgagaggcttcatctacttaatacaactatatttaagttggattaattgtttgaacaggataactctgtgatgactagttttaatataaacacagctcatgaggttttggtaaaaggtgattccaaaggaaattgataaaatatgtttcaagatttgtgaccatattatttgcaaaatttggagaaatgttgagggcagagtttatctgtgaatttttcacctacttattcaatacacatttactgagcaatttttataagatcaggcacatgctaggtcctgcttgttaggacatactggatatgtgactaaactcattatagttttccatataatttgttatgaggtatctttttagaatctcaaatttctgtccatattctgtggttcactcatcactagcaaaagctcacattttcataaaagtcttttcttgaaaattataagtattttcttctgctttaaattacactttggggacagtcaagaagaagcaatgtcagactaattgcactaataataataggacccaggtggctagctttgatcttgggaaccatctgcaatccagaccactttgatgtttcacacaatggaagcataaatattttctatgtataccacgattggactttcagaaatctaattaagatgaaggtcaattaagagaaaatgaaaccttaactccaaaagtcagggaagagatggaagatgatggcatggttgtgtgtacataaaagaagctaacctaattataaacttacacaaacagccagagaagttgcctttcatgtgacaaaaaggtcctaaagcattctataacattgcgatcattaatgtgtctttgaaacacacccaacactagaaaataatagtaataactggcatttcaaaactctattactaaaaaattggaagatagctagggatagaagcacttcagaactcatgaaatgcaaccccttgcttcttggaaatgagtgccataaactatagcagagtcatttgtttctattagattcctctaggtttgatgtgaaagagattttgctgcttgtttcagaggtctgcaaggctggagaaggtcacaggtaatggtgcatcccagcataggctgcgtaaactttagcgagtttcctcagctctccaagcctcagtttccatatttctaaagtaagactaatgatgcttatctcataggtttaaaatggctgtggggattaaacaacaaatataaatctctctctctctctctcttttttattttgagacagagtttcactcttgttgcccatgctgaagtgcagtggcgcgatctcggctcactgcaacctccaccttctgggttcaagtgattcttctgcctcagcctcctgagtaactgggactacaggcacccgccaccacacccagctaatttttgtatttttagtagagacagggtatcatcatgttggccaggcttgtctcgaactcctgacctcaggtgatccgcctgtctcagcctccccaagtgctgggattacaggggtgagccaccatacctggccaatataaatctcttaactcaatgctgcacatagtaggtatgtggaattgcaaagtccttatcttcctcctgagagtgtgggctttagaatcaaatggacctgagtctgaatcccttttcttacatttactttctgtgtcactttgaatgagcagttttacctccttgggttgtggtttttcaaactctaaaatgatctcaattatatctaccttgctggggttgttgagtagaaaagagagaatttatataaaatctctggcacataggaagacatgagatgacagaaagtactcgtcatagcctaaaggatactttcaaatatggattaagatgtttgtacatgtatgcctgtgtgcctatatgtgtgtatgtaggatgtgtgtgcattcaatgcatagaagagaagaactgtcaaagcttccctttgtccctgacactagccacagctgtgtgatgtgggaacttgaatttgaatgatgcagagtcagtgctaactgaacagggtaaacgaattctctttattcctttgctgggtgacacacatcatatagatcctccccccgcccaccctcttttgaactacatctaagaatcctttcatccgagaagttcaaagtatgcccacttacctatgcatcttagtgaaatcttcctttctaatgcccatactttgggacaaataggtaactgaaattaacttatcagacattcctgttagccatcagggacacatggtgtctgaccagagtggctctaatttgttcccaaggccaattatttaaatagcagaggataaaatataatcttgaggcattccctcctgacaaacaatgcattaagatggacattccagttaaaccagatacaaattgttgttttttctaaagtagtatgaccttgatttccacgaagaccagcatagtgaccgccagcaatgttagtgctgtctgatcatgttttcttaattctttagtctgagtagaaaagggtactgttaaatgtattatggattacatttagagttgatttaccaaattcaaagaccaagtcctgcccttggatgtgttcaatgtataaatgtgcattcctggccagaggagcatctgcttgaaatacaatgttcttttgctaatggaatctttagagctcactggaggtagaggtgcaccctgggcacctagcacctgctggctcctgccgtactcacagttcacagtgaccttgacttgtttgacatccgccgaggagacctcgttggcagctttgcactcatatttgcctgactgctccctggtgatgccaaggatctccagatattcttcttctccttcaaattcccttcctgaaaaacagaggttttcatgattcttttttaaagtctgaaataggcagtagatcctctcattattctttttaaaagccataaatccacatttcttttcaatgatttgaaaatgtactttgtctgacatcagattccacagaagcagacctcaagacaaaaatcttatgaaagtgattgagtagaaaatactctcaggaaaaaccagaaagaaaatgggaaaatggaacttggaagacaaagaagccaagcaagggtgcaatgccaagctaagtcccacagagagcaactgtggctcagtctttcagggaggcctgaggacagctcatgtcccacttcaaaattattctgatcatgaggctgggagctggggtgttcataggtgcatgcactcactcgtcgctggttaagggtttcgaacaaagtgggagctggcgggaggtacatgcaaatcataaagtgctctgaggggatatagcaccaacatcatctattacaccatgctgcaaagcactctgttttttgttgttgcaaagcactctttacaccaacattgttattagacaaagtggcttccttttgagaaaccaccactcttcttcagattctgttaaattctgttcacaaggattgtatgctaaactgtcttggcagttgtgatctctgttctatatcaaactacatcatcctagaggcttttaggccatgggccagatccatgagaatgtgctgctgatggtgtgtttgtgatggactgtgtcatctggggtttggggtagggagttaaatattattggcttaaaagttgggattaggtatagggaggtcctgtttggaaagatctacatagttgagtgtgtgcattttagtaaagaaatctcaacttaagaaaccttgtttaaattcccctatgtggagaataattgattaaaccattttcttcctgaagagatggagagagaaataaggaagaagtagagagggagaaaaatgaaaagaggaaaagaaggtgattgaggaaggagaaggtgaaagaggaaagagaagaggaaatgagattgggtagcaggaagagcctagccagagcttggccagaaaggcccaaggacttcaactctagctaaactgaaccccctcaccccaaaatttcaaaactccactgttacacgagttaggatagagcagctggggagggtgttaaagaacacagtcctgcaatcacgatgctcctggtcattctctactaaatggtaccagtcattagctctgctcaaatgctataagctgttttcctttttttgggaattcctcaatgaccaaatcaacgtaacagacagttagcaaggagacaaatttactctaaatatgtcagctaaacctgttaactaggcttccgacagaacatggggcttctttgctagcattctataacacaactctctggatattccaagcttcaagtcttctctcaattgtcaatatcactagttttgaggaaactgtacaatcttgattaaaaaaacaggcaagagtaatataacattatttggttctgaagttctgcacattatctttatctagcacatgcttctactgagaatgttttagaattagtctatagcatatagttaaatattattattattattattattattattattattttttttttttttttttgagatggagtcccgctctttagcctaggccggattgcagtggcacaatctcggctcactgcaagctccgcctcccaggttcacgccattctcctgcctcagcctcccgagtagctgggactacaggcgcccgccactgcgcccggctaattttttgtatttttagtagagacggggtttcaccgtgttagccaagatggtctcgatctcctaaatattatttttaagaggttaattttttcctgtctacatttttctcttctcctttgccaacatttaaagcaagtacttagatctgattttacatgttatagaagtagaatgtagtagagaagaaaacagtaatctcagaaagggtaactggccacttttctggattaattgggcaggatttaggattgaaggggtaaaaagatctttcctgcatattgtttctatgcactaagtgtcatgccaactatttgatgctaagactcttctagctgaacataaataccctgaaggctaatggcaactttgacaattagttttttatttagcaggcagaaataggtataagctcattgaaaacctagaatgcagaggtagaatagaaagtaagatagcattatttattttgagaataatggtaaattttaatgagaaaatagttaataataatttcagaatgttttagtatttcttctcatactgcatatcccccacccataatcttaatcttggttggggacagagctgtcagtagaagaaggagagaacaaggataatcttagagatggttggcaacactgaattctttccaattcccatgaaatacctagaaatggtggattatgggtccctacttcgctttttgaatttataaaacaaaaacaaaaactaaacagttgcaggagagagaaagattatttttagctgcgccaactaaagccctaccaattctggaagatggcacctatgaaaggaaatagtaagatgaatgacagaaaataaaacaatatttattgtgtttggggcctgggattcttacataccaatataagtattagtaatctcatttgttcctgataagcagataataaaacatatccttatcagataaactttcaatctcatgtctctagaatttcccctaaactacctgaggataaaaggagagttttcccttaagtgacccacatgggaggcagagacatcatttttgcttctcctgtgatagctctcctcctctctgatggcagcctctgtctccagcacacaatgtgcatagctatctcaataaagtgggagcaggctcaaggtgcaaaccaactatcggcaggggaaactacaccgtattccatcatccaaccaatctcatccaacaattctcctgctcctttctttcctttgccccggtgtgtccgtcctcatgagagcaaattttctccagttctttcagttctgactggctgctctcaacccaagggtcctgccaatatttccttttattctctcaaccttaagaagactctcaagccagaaactgaatttaaaacattcagagacacccctgggccctccctgttgtcatgcttcctttccctattccctggatcctccagttgaaactcttgcattccctggcccttcctgattagtctgttctagtcacacccaggagacttttcccacaatgcattatctctactgcttcacttgagaatttcttaccaattcacagaaatttaacaggaaatgggagcttttctgttgttggaaagccaaagctccagattgtaagtgttgcagggaccatgccttactcataatatcctcatgaactagcacagagtttggctcagattagtcactccataaatgtttgttgagttagcttgctacagacccaatgctggtgcttctccaaaattcatatgttgaaacttaagccccaaagtgatgacggtatttggaagtggggtctttggaggtgattaggtcatgaagatggagccttcatgaatgagattagtgcccttataaaagaaactccaggctgggtatggtggcttacgcctgtaaccctagcactttgggaggccgaggtgggcagatcacttgaggtcaagagttcaaaaccagccaggccaacatggtgaaaccccgtttctactaaaaatacaaaaaaattagcaagtgtggtggcatgtgcctgtaatcccagctatttgggaggctgaggcagcagaattgcttcaacctgggaggcggaggttgcagtgaactgagatcgagccactgcactccagcctgggtgacagagcaagactccatctcaaaaaaaaaaaaaagaaaagaaaacagaaactccagagagttcctttgcctcttctgccacgtaaggacacagagaaaagagagctgtctctgaatcaggaagtgggcccttatcagacagtaaatttgctggcaccctgatcttggacttcccaagctccaaaactgtaagaaatacatttccattgtttataagctacccagtctatggtatttttgttatagtaacctgaatggactgagataaagctgaactgaattaagaaattcaaagagatactagagtcattgtcagcacttcatgtagtttaagagaatagagctaagtattgaaaagtggctaagtatttctgtcagagaagttggcataaaactccactgccttttaatgaccctaatagagttctcttttactggggaagaaagggtgtgctgcatactctgctgttgaaggactgcacaggggcatctctggccatgtcctgaggaattatctgccatgtggagttatcgttttggaaaccaacagagctccctgtggacacaggcacgatacaatcttagcaagtgccgtttcttgttttaaggcatggaatacaccagctgaatcttgagtcacaaaattctaaaatgcactcagattctcctgttcctttctttccctttgcccccacgagcctgtccccaagagggcaacttttctccacttccttcagttctctctgactggctgctctcaaccccagggtcctaccaataatgtcttttattctctcaaccttaaaaagactctcaggccagaaatggacacaaaacctatggtttaagttctctggtagacgagttctatggccacaatttgggtctttctcttgtccctatctattattttttgcccttacagaaatgtttacttgaaatgcaaatttcagtattttggtattttaaacatctcaaccaatttccacaagcctgctcacatcgctgagtgttatgtttattctgggatctagtgtttagtttaaatctccctttgcttaatgtgtttttgtgtctcctggcaatattcagctaccaggctaaataacttctcatcctcctcagtgtatgcaccttttaaactcttgcacataattagcatatcccttcttagtcactgtttactcaagttgtacatattagttcttttaatatttcttcataagtcagaaagaagggcctagagctaatggcaagagaaaagtgttctctcctgtgttccccaatgtggaggcaaatcagccaggaataactccaattaaagcatgccaggtgctgccttctgagtacagtgccttcggagttccatgctttagtgagccctgtagttgctatgcaaaatgttgactgatttagatttataaggtcaaccaggcatttgtaaaaaggagccatttgaaattaaatatatttccatggtgctgctttctctcattccctttctttctctcctccctctccctccttccgtcctcccatctctctctctctctctctctctctctctcacacacacacaccccacaaaaagctagttatttacatataagattttactgttaaatgtgtgtgagcagcacacacatttcctcaccctcaaatatttgctcactaagcagaacaggactagcctcaaaaacttcccaggacatgacaaccagccccatatttggaattaaaaatttttttacagactattgctctaataatcattatagtacctgtctttccttttatttgagatacaaagaatacaatttaggaaacttgctaaattggagcactttgtgactttaaaaatatagaattccaaggaaagtatgttaggaaatgaatggatcatttttttcactgttctgagaagacttttataagtatagcatctcggtagatcaatctttcacagataggaagatgtgcttgaaatggggttgctattccttttactcacctacgtttgaatatttacatgcaagtggctgtaaacacactagctataaacacaaacatacatacagtttaatgaaaagcaaagaactagaatttatcttgcaaggtgtatatgtgtgtatatttgtgtttgtgtgggtctgtgattggaaatgtgagtgaagtaagtaagcaagaaaagcaagctatgaacttctacctaagaaaattaaaggaaaaaagatcacgaatcagtgatgccatttgaagtttcctgtgagaacttcaaatgctgtaccatgtttctgttcttacagtatgtttcatgttttgcttttgttttcccctaaggacatgctctcacctattcctgtttttgctttcttccctgctttcctgcacatcacgttctacacaaaaatgctaaggaaaggaagagagaaagaaacacaagaaatctagaaaagatgcctgcagtagggttctgtttgtatttccagccatgtgtctctccagattatttgaggtttttgcttctccgcttcacattccacctgagagaccccttagtgtttgacaatgttgctgtccaaaggctgaaaccacttctcatcctcacttttcaccactggaagggaggggtgaagagtggtaaaatgatccctgattgaaagaaggcagggaaggggtagatgcagtcgtcaaaagcaacaaccacaggaggataaggagacacagggaagaacaaggtattgaaggggatgaagaaaacaaaaacaaaaacaaaaacggagagatgtgatataatgagaacgattttagggaagagttggaggaatggaaatgaaaggagagagagttttctgaagaaagaggcatatgactgtttagacatttgagctgcatgcaagggaaggggtgggttactctgctatagaaatgttccctatttgaataataagacacaacagggggtggattatgcaaattggccccatgccttctgcaaccccaaaggatgtagttagtacccagaaaccagtgacaagaacaatgccagggaagattcacaactggctttggctctatgaatgagcatgggccaaatgaaaaagaacatcctgggattattcttcctggcatccagagagatccaattcattatgatttgcatttttgctttcacatataaaaaataagccagctgaaatagtttgagctgagtttccagcctgaggctgccatgcatgcatccttttttcagtcctgggccatgacattcttttattgtatttatactaaaccattaccccctacttggtgtcagtttttagaaactgccctgcccttctaaatgtgatgcttgaagtcagaatcccctatatttagttctctgaaggggattgtactgagaatagctatggttacattgtaaggctttaccactgtaaaaaccacatttggttttgatcatcactgtatcccttccctagtgtgtagcacaatgtcggaacctattaaaagtttaagaaatattgtagagtgagtgttgtatgagctacctcttaataaacacttgctaggcactgtgctaagtgacccagatatattatcttatttaattcacgatagttttaagattgcttacagatgtgtaacacataggaacacaggtttagagtggtcaagaaacttgcccaagcttataatgttagtaaggaagacatgagctttgacccaggtctgtggacgtttgggactcatgttccgaactaagcatgcctacttttatcattagaatgctgaaggatgctacagttggctggattcttagctctcagaatctgctttatttctttctttcaagtatagagtgggagattgagaataagacatgtgagaaatttccaaagcaatgcagctcaattactgataaagaaggtaaaaagacaggcttcatcttttatgaggtttgtccacttcacttaacttccttattgaaaagatcaaatgaaccaataaatgaggggaaaaaagttgatctttaaaaatttagcctcttaaccatttatttttaggagtccctccattagcaataaaaacctattggtacacaaaaatgccagcaaccagcaaaggagctacagagacagtgtagagtagacttagtactagagaagatttctgggagaaataagttttcaggaacttaagaaatgcaagtggagaaaaaattagggctggcaaattgcaaaagggtgtggcaatctagaagtctccgagcaggaaaaatgaggatggtgatgtgtgaggacatgcactgggatgtgacgggtggtttgaggactctggatttgctatgtgaggtaccactacatctcctttaagcctgccagcacccacagggtactgagtacaatggcattattttgtaatttgttttcttccttttttcctcccctcctcccctccctccctccctctctccctctttcctcccctccctctctccctctttcctcccctccctccttccttctttctttccttccttccttccttccttccttccttccttccttccttccttccttccttccttccttccttccttccttcctttccttcctccctacacaccatataggaaacatgatgtgtaagcataaaatcgtatgaaaattctatttgtttaaagtcctttatacaccaacactatttactctcagtgcctgtttcttgacactgagtactaacgtgtattttgatgagccttcctgtgaattactgtgaaagtggagatgggctcttcaaagatttcaaaaaattgtgatcaaccttgtttaactgacggtggctgcctggggaatgatgttgagaaggattctgaggcggtgtctgggctcaatgagagagagtggcactgtccccctggcggtaggagaaggaatgtggaccctgtacacagaccctcacctgccctgaatttcctgtagtccacttggttttctcaggtatgaagaaatgtattctaaatgcagtgtgtaggttggaagctaatgacttcctaagtgtgaatgcaggtggaatcacttggcgaattaggagggggtacttattttggagtgaagataatgagttccattctaatatggttggtattaggttttcctgggacatactgtggagtatattctataggtacttggaaatatggggttggtaagagattttagctaactgtggatttaaatttgtaatctacacgagttgtaattcaaatcactggagcagggactgcagaacatttgtaggatgtagctcctaaagccagcacccattctcctacttcatttttatgacctcgggtgcggggaagaagagcaaaactgaaaacaaaggattgaaaaagccccatatacttaaaagagtcctttgggaataaaatagaagtaaagattcctgcagatgttaattgttttttagactttttcttaaaacctgggggcagggggttgtttggcagggacaaatattagaattgctggacagagtcagtaacaaacaagatcactcaccattgtcatcagaactgtgggggtattaccagacctgttattagcaactctgccatggctcaggattaaatatcaagagagatgagagcagcagttgctgtttttaagagtcacataaatcaattggcatttagtaagtgaatgtgttaaactcagcagggtgattgcactatggaaggattgctaggcagagttttgaagctgccacagaagcctttgaaatgtaattaaaacaaagcagacaataaccccgtctagcccttcaccctttcttaacagaacctgatgttgcaatgacctcatataggttcaccctaaaatcccagatctacttcttcagctaggcccagtgctgaatgagttatttgatccaatttggagaactgttcttgcttaaagtcaatacataagtaatgaagagaaaagaatggtaaggagtgggagcagggcagaagaggaaaaggtttaagtatgaattaaagtgatgttcttggaatgtttccattcaacataaggtgggtagctcaggggtcaaaacaaattaaagggtccagccattggcttcttcattttgacctaaaggtacaagctaaaaattactccatcaacattcattctaggttgcaggcctctgcttaccagcacccctcaatctgggctcaggatttttagcctttctgtaaagcagatggatcacagtgggagtgggggtcccagctgcagtgtcaggagcgcaggtagaggtggcgtgggagagaaaagaagagagcacttgcctgttcttgaaagcagtccctctcccaggctgggcccatgcgctcctagaaggctatgaggccagtgggccaaagcttaataggaaaacagcagcgatttgtctccactgctatttatgtttcaagtgcttgacaggctgtcagtgcaagtgagggtcactaaatttactgcctttcagattactgctatagtctcgaacttgacaagtcacttcatttaaaaagcgctgcatgaggatgtttcctgcactcctttttaaataaaaacaaagggagaagaaaaggccacctcagaggtttaaatggttgaaataaagaaagtccacaagactctcttaccctgaggggtggacctcagagggagagtgctactttcacacactcacctctaattaaaatggcaagtgagggagagggatgaccccaaggtttttggtttgattgatctgtgtactggatgatatttttatgggtggtggtggaggggtgggagggtaataattgagtttttttatctattgaattggaatgcttaaaggacattcaaatggagattccttctaaacaatgggattcaaataaaggataaaaatgtgttgtatatgtgttattcatatacaacacatttgcatatacatatatattgtatatatatataaataaatgtttacataatgttaacaatcttacttctgggttatgggatcaggaggcccagaagtgtgcggttagggaacttctcttcatttgatgccttcctatcctgcttgaatttctgacatagattatatatatattacctttataatgcaatattttcaaagaaaactgaatttaataattgcagtgtcagtgaaagacatacctattcttctggctgtatcctaagggcaggtttctcagaatgaaaaagaaaatctctacgatttttctatttctggcataagggaaaaagaatgattaggaaaattagacaccaattccaaatgacaggaggcatagtaataagcaagttgatattatataaaatcagaacaattttctaattaggtggacaaaaagttttcatgactatccatgggcattgtgtgttgtaacctacctcctgtactgttcaactgtggctattaaagaattgtaaccacaggtccagtccacttggcccccaaagcagtgagacttgagcctggccaattgttagaagcactttgcccatgattgagaggtgtctggacttaagagtgctgactctgaaggtgacaggtagctgtatgtgcactcaaatgaattttcctcactattctccactccatggcacgttgcctgattgctctttgatccttgttactggcagtcagattgcactccagttcccagctgggactaaagttgagctaaattataaacttgacccatcatttagttgtcaccatcacttttcctacagggctggacccttcttgctgtattttatagctgactaatagcctgctcacattggtgcagcatcattccctagaaatctctgtgctttggtattatccctttggatctgcgtattctgagaacaagcccaacctgagtttccctaatgatatgaactataaatcttacaggaaaggggaaaagttctgaggtggaggtagaaagaactcatcctttgttctagctcaagtcttctaaactccctcagcccaggaaacactcagcttatcttcctttctcgtggggaacttctaagttccctagtgtcctcgcaccacctcctaaccctcccagcctaaacagtgtgaaccgcaaaatgattttcatgaaagtgtatgattaatagagtgtacatggagaattttcatggatagagagagctaactaatacctgccatacaaacggtcaggctgtgcagtatttttctaatataaatagcacagaacttaggatctcaaacaagcacttaaatgtactcaatcatttgtttatatgagagaaatacattattatgcaatgtcttagccctgtgctgaagctatttcatcttattcttggtagttgaccagaagattgaccccctcgcctcctgtacctatcacataagatctcattgcaaccactcagaataactgtccagagataatttgctaatggatgtcaatgtacaacctatcaaatgcttaagacacttaataattgcaaggcatatctatttggtatgctactatcagtttattcaagtctttggattctgtccaagaatcacatatttagaaagcagaccattttgaccataattatttcagtacttcctagaaatggcttcactgaagtgagaccatggacgtttctctaaagactatttaaaaattacccctttgaacacattttctatgcatttcataaatttcagtcaaacatattgtctaacatattactcaataccctttataaaaggattctttagtttccagaaaataagtctctgtagatgtctttttcaactcttgctactattttgaaataaaaaagaagctatgtgaatctatttattttcccttttgctttcactttaaaaaattacacagatatagtatccagatgtgatcagcttatctcaaattctgatcagcatctgtacaggtgtttctcaaactgtgatccatggaccacctatataataatcacactggaaactgctaatacatgcagatcactgggctctttcacagacttactgaatcagaatttcctgggatgaggctcaggaatccattagtttataaaacctaccaggtgatactccagaacacctacatttggtaagcatccttctgatcttactagtttggcattcagaaacatataccttttcttttcttaagggagttaggttaaccccagacacagaagccatcttgacccgggatcagggatcaatccagtatttagatcaggaaagactgaaggagacaagttaaattatgaggagaatcaacattctgccttgagctcaattcccatttctgaactaacaattcagtctccatttgttgggtagcacttcgtgtcacatggattttttacatcttctagtttatctatataggcttcttcttttctctctctgtgtctcttgttaaccaatgaaggaagtgaagtttagaaaagttaaggaactttcccaacattacacagatagtaaatggcagagctaagatgcctgtgtgactctggtgttttaatcaatcatatcatatttgtaaagtctcagctctgttcctgagattgatcctcatttgcctaccagttctagacactagattcatgacaaaagccaatgctgactgctttctggcctacctggaactccaaaaaagcctggatctcaactcccaattgtgggttacccttttctttcctctccatcctacagttctcagtgttgcctggtataatcactagatttccttactgtaaaaatcactgagaataggtcatttacacccaaagttgaataagaaaatgtacgttacctttcttggtttcattatgcatggattttgttacaaaagcacctttgatgggtggataagctgttggtgaacttggagaatgacagatggagggctactgaccttctcaagtgttggaagatcattaagagtaagttaatctgtaaatagatgagaaatgtaaagtttctttgcatcatgctatgaagaattctgagctctcttaccccacactcaagtcttggtttgcaaagttacattcaaatgacatgtggccaacctgaggtgcagtaaagggaagctgatgtaaagtgagcagaattgacaggttgccaagcaggataaattacctcaaagatatcaaactttaaagcttaattattttcccattaagactccttttgcaatgcaaatattaatgcaagtggttataccttttatcagctaacgtcttaattctcaattaacacctaagggatttcacagcctgcaggcaagcagaatgggtacttgtgggaataggttctgtggaactggaaaaagactggaatgaaagaagaggatgctgctaggggaagaggggggtcataaattcattttacacaatgctggcttagtgtatctaactgtttggggtagctaggaattgagtagcaaacactgagacagaaaatcattctcactaacatataagtcttggtggtcttttaaacttgttgaatccaaatattgataagcacattaatgctcagtttttcagaagataattgggtaagttatgagcaggaggccttggaatattttcaataaattcctaggctttcaaatctcttcagccttcccaaccttctatactaatctaaaatactgtcggtttctggaagggtaaaccttattgtatcaatagctcaacatatcatatactgatgcaattttaattttctagtgggaaaaacttcacaatttcaagatgaaaaagttaagccccacaaatcctccccttttgacagatggctttacccgaaggcaaacttagcagtggctctcagggaacattatctgacccgctgtgctgaggggcagaggagacacaggaaaagatgtgaaagcagaaaaacatgagggagaagccctgagcaaacaagaaagtaatagggtgggacacaggaaaatcacagaagaaatcaagccagccaaaccacggggaagaagaagagcaggaagaaaatgccaccagaattgcaagagcctaaagtaatctcacagatgcctccagaaaagaaatcagttttgttggtggtcagggcaaacagagagatttgttttggttggttgagtctaaagtctatttgctaagagacttcgttttgatatgacatataataatcattctaagaagtgctctcctggcactctacatatctgagagtaagtaaatagatgagcatgtgattgcaaaggcagctgagtgaggaaaacttacaattcacaaaacgggagttttcattcctgacaatacagtgataagcttttgtcctctttaaaggactggaggtccaaaatatgtttgtttacttgtttctaaccaatattcctagtcctaatatagttacagttggtctaagggctttagatttaggcttgggcagattatcaaggcatcttctgcacatcagggataatggaaaatttagctcctacattcaactcatagctagtgtcctgtctacctggagaactgttgaatgctatcacagaaagagctgtgggccattggcatgggaaatggggtgctggctacgtattaaacttcatgtgctgtgatgggactagttagccattggttagaggatggcaaggttggatccacactaatcagaagacacaattccaaaacagtcatgtgtctgacctcccactccctgaatccaagcactagccattgagaaatctatccctctctccatcaagttgtcaaaacaggaatattataaagcaacttaaggatgagaagtatttggaagaaaacagaggtatgtgtgtgtatgtgggatgggtggaacacatttagagccagttagagaatggtacctgactgaacttggattttcaggaacatggaattttcccctaaacgagcataaatatatttttcactaaagagttgaagatatgaaacttaattaactcattttaaatacacatatttaaaatgaggttgacacatatttaaaatgaggttgaaggaaagctctaatgtaatttaatcaaaaccataaagatttaatcttctttttctagaaaagatactaacttttccaaaatacaatccaggacagattctcaaaattgttcaagtggtaggtccaaatacaagaagaaaatatttgattgtgcttttttacattagattgttagattttaattgagaaaaatggtgcagacagtaaaaaaactaagaatattttatggtaaacttcaatacacacaattctactcagtaatatttgtcttttataaatcaggaaaaaaaacccatattttatcctagtgacaaagctgttaagctcagtttctagaatatgagtgttttctagcacacagtttgaaaaccatttaactcatttccaggaagagaaatcaatgcaactatgctcaatggttacgctaaaataaaaaattcagaagtatagtaaagaatatgactgctgcatagaccaactgacaattgttcaaactttgatagccataaacaaaaagccagattaggtcaggagatcatttgacatctcttggttcccttcataacctctatcttggagggggagagagagagagagagagagagagagagagagactgactgagagagagagactgcctacaaatacaaaaagaatggctctccctttgaaatctctacttgatgagtaccagcaatttggagtaaaaaacataatacataatttaacttgacaactgttatatgtccagcactaggctggggagataaaacaaggcatagttagacaatactaaaaagcaaagaagatgccactatctgggaaactatcattatattgataacaattaattagtaataaattaaatttgctcttaccattaatattcattacttgcagatgttctagtactttacttttgaatatgatgaacagtgcccagacacagtaggtactcactaaatattaatttcttttaaatctctcattctctttctgttataatcattttcaagagtctttacctcttagactttgagaaacattttctatgtctggtgaatcacttgtaaaatgttagattgtagattaaatgcatacgtcttttccgaacaaaaatcctgtagtgctaggcacagacatttataaggatatgtatatccttatatatatgtgtatacataaaattatttcctgagattgttgtttattttttcccaaatttgggaaccaggagcattatagagcagggcttggcaagctatgtcccatgagccaaatttgatctgagtgattttgtatagctcatagctaagagtgaattttgcatttttaaagttaaaaaattaaaataatattttttgacacataaaaattatataaaatttaaatttcagtatttataaataaagttttacttggacacagccatgcctatgcatttttatattgtctatggctgctttcagttacaatgacagaatttaattgcaacagagaccctatggcccacaaagcttaacatatttactaccttgtttttcatggaaaagtttgttaacccatggtgtagaggaacaagctctaacatgcaagtctgaagaagtgtatttttgattgggctgttgtgcttcccatttttttaagttggggaatatagtagatgagaacaaaagtatatttcagaagtaacattctatgacctaggctccaataaattattttcaaataattacaatatcagtacctgtcagtacatttacatttttagctcttcctaaatatttttctagggctgtggctcccaaagtaagaaaaatcacctagggaactccttgaaaaggaagattctcaggcttacctccaaaagttctaatccattatgtctagggcaagccccaggaatctgcattttaacactctggtggtgattttgatgtacacactcactgcaaaagcttcaccaaggtggcccaactcactggttcctttgctctggcctcaacaaactagccatgctgtaaagaaagctttaaacactccagctgctggtatgaactgaactatttcagcatgtatcctgagactttctagggaagagattgctgcattagctgtggagttgttcccaggagagatgcagtaaaagtttagaatcagactaacagccttatacttgtttctttctaaaaaacctaaaaaggccccaggcatttcttttgcttgctggggagatggtgatcacaaacctgtaaggtgcacagtgttttcgcttcccacagaagagaaaactcattacatgaaatcacaggcaagctcccaacaagaagatgggaaagaaatacataggaatcagccatggagctttcaaattacggaactagaaattatatttgcaatagttgaaaagattttcctctgagaatagtattattccaaattcacagtaaatctctttctcattttatgctgcctgggagttcttaaaattgatagaccatagagaaaatggcattgcattctcatagggattggcagcctagaatggccatgcagtttaaacctgaaacacagagatactcatttttctcccttcttttaaactgtgctctttacccagggtcaagactcaagactaagtttattcagcagagacagaaaaaaaaatggctacagggaatcagaagacaatcatccttagacaggtgtattcctgggaaatcaaccttaccattgaaggtttcagaggcccttgaaggcctcaggaaaggcagagtcagaggaaaaaaatattagcagtgcagtgctgaaatgaaagatacaaagatatgatacccctgtttaaattgtttcagtgtacaaagaacaaagctacctaaagaaaaccaacgtgtagtgtgtgtgtgtgtgtgtgtgtgtgtgtgtgtgtgtaagagagacagacagagagacaaagagagagaggcagagagatagagggcttcaacctcctactcgttgacatttttttctaacctgagggttccctattgctagactttccttggttacttttgaagctttgtaagactctaggaagaactaaacctccatgcaaatgagcaaagcaggaataccatctgagttatacaagctagaaaaagtatagcacacaccagcaatccttttgcctcaggatataaagtgatcaccaactggactcaaaaatattcctacactctgtagcagagggccttgtgggaaagaagaaagagttgcaaacagcttagaacaagtgtacaattcagctggtatagttaagagggtgctgattctcagagaattaaaatattcatgtctagttgtcatttacatctcagcatttccctttttatctcctttttctctcttcttagatttctgttgatttatgggcccagttatttttgatgctctgaaaatgagtgaattagtattaaagataaagataaaaggacccacaagaatgggtgaagaagtgataaaatgcataactcttgggtgggcatgtgtgtgtatgctaatgggaaaggttatggatcaacagcatttctactgttaaatatattttcttgcctccattctcctaaatcaaagatatctaaatcacttatcctttagttgttataactacttcaagagtcctctgggcaggtttggctgccccatgtgccaccctgcggcatcacctgcaccttactatagagctcaaagaattagcaaaggcaagaggaaaggcagaaggggatcaagagggaaaactacagaagagagtgcaggagaaaatagcaggtagaagtctagaaaagaggaggggtatgaatgccgacagcaggaggccgataggagatgggaaagaaaaaagaattgagcctcccgagaatggaagaatggaaagaagtgtttaaatggtatgcagaataaaaatacagaaacaaagaggaaagaacgtaagtatttatttagtgaaaactatgtgctaagaattctcacgtgaattatattatttaaccattttgaaaactctgtagtacaaatatttaatccctgaacaaatgaggtagctgaggctcatagctgttaagtatctggtctaagatcacacaggtagtgggaaaggagaagagaactaatactcattcaccaaataaatatttactgagaatttattatgaactaggcatgtgctaagcaacgtgacacatgctaatactagtttaattaaggaagtataacatatgtatgaaacatatatgatacatacatacacatatatacatatatgtaaacattcccattcataaatgtggttgagacagagatccgaattagtttttcacaaatataaagctacaaattagtggaatcaagatttaaattcaggctgggcacagtggctcacacctgtaatcccagcactttgggaggccaaggcaggatgatcatctgaggtcaggagttcaagaccagcctggccaacatgacgaaacgctgtctctaccaaaaatacaaaaattaactgggactggtagcatgtacctgtaatcccagctactcaggaggctaacttgggaggttaaggcaggggagtcatttgaacctgggaggtggaagttgcagtgagctaagatcacaccactgcactccagcctggatgacagagtgaggctctgaaaaaaaaaaaaaaaagtctatgcttttttagactagggcagaaattctgtttcagagaaaggactaggctaaaaggagatctatggcataagacagagcaaatctagaaaataagagaaaaaaggagaggaaagtattccaaaatatgagctatttagtaattaatttttccggtcattctattttattttactgttcattttgttttacaaaataattaatcctgtatagtataatagagtattagaactcaatttggggaacctgagttcataccttgccgctaacttttaccaagttacagaaaatctctataatttagtttgctgtaaaatcgaggttataatatcagttgtgatgacctataagattgctaagaagttcaaaagagataatacatgcaaattaccaggtatcacatctgtaagtaaatgcccacagttatatttaatagctttcttgtcctagcctgctggagagcctctagcttgcttcccatttgttccctctaaagatcaccccaggatttgaccttccacgtaggaatcagtctatgatggtgcatttctgaaggcactgactactacccatttgcaggatgcagagcctctatgtaataagaaatatattacactctgagcttctgcccttttctaagtttatctttctctcttggagccttttcatagtttttattatatatttacatctaatgaagacttgaatattgcctctgaatattgcaaaacatcagttttgtttgatataacagagttggagcttttagatttcagcacgtagattgattaatgtaaacggcacatgctgtctctcctcctccaaaaagacattcctttctctttctgggttccttctcctcagtctttgggaaccagctccaatgccctctcctttaggaagtctgtctcagcatctttccttctcctgcttcttcttcctaagccctgcttgaaactatccctattctcaacccctaggtttttgtcttgttttgttttgtctctattctctcaaaaaatttgttcatgcggtgattgtagcacaaatcaggctgtactatcatcatttgtatacattttgtctccccagctataccataagatttgtaaagtctctgctccaggcccatttatctatatattcccccattgcttcattgacttgtacatttatttatacatacaattaaatatattattgagtgcctattacaggccagaccctgcactagatgctgagtgaagacacagtggtgaataaaccagcctgtcttcaacttcatgaagctaccatctaaatgtatgtatgtacgttatttaagcctaagttataactctattcagtgtgaagcaggcaagatatctcgagtgaaagagtggataaaagagagttttcacttggttagggaggttaagaaggatcacctaagaaaaagccactgaagtggagatccaaaggagaagtattttcttctcaaatgaggaattttcagcacatagaaggtactttaaaaaaaaaaagagaatgaacgttttcctcaaattaaacagacacatttaataaaaatagctgttatttacctaaggctttctacacacatcaatattatctcaggtaattctcaaccatatgagagaacatcgtttcttttatttctttttataacaaattcaaaagatagattaggaattggatagtgagtaaaaggtaacacaaactatctactactttcaatcccaatcacaaattattctagaggtccttacccaaatattttcctcagaagagatgttatctttttcctttccatcagaagaagcgaggcgagtaaccttaacctaacatttgaatgtatttgtcccaaatatattctttaacttcacttcctgaataagattttcctcctgctctcactcattgctgtaccgaaatatttaattgagtgaaatattaaagtaggggtttgataagtggctgctgcattttattttaacgaatgtgatgggttatcaaaattgctgcactgtagccgtctctctataaatagaaacctattactaaagggttcagaataattacaatattatcccaaatatcactatgtgctaggcctgtcacatagtagatactcaataaatgatgactccttaatgatgaatctcaaataatttttctttgacaagctattgctattgtgactgaatattcatgtgaggggtcacttccagggttaaagactgtggtcaaaggagcaggcaaagctcgctagattagggaaattgtcctcattgttcttacctcattagcattatttccagggttcttgagcccaataccaaaaataggccttatgattgtgttaaaaaaaaatcatagttcccatctacatgaacacaagcttggaagagtggaaatagatatatattttgaaataacttttaaaaatgtgatcctgaatgagctctatacaacaatatttttctactgaaatttagaaacaacatccccaatgccttaagtaccattaacagcaggcttctgatgtatttttataaaggcaaaattctcccctaacttccacaaacaggtaattgatttttttcttttattttaattcttagagcattgagaaatttctttctgttcccaactataatgagagctctgttgaggagatttgtctctgtagctaatttttcatgcttatcagtcatagggttatcttcattttaacacccttactgattcagatattttgcatgaattatctgcattagtcctgtagaggatttcaaacttactcagtaatgcctgcagttcctcattcacttttgctaaaagaaactgttctgatttaaaaaaaaaaaaaggaaaaagctttttttttttttttttaaggctacaaataataccctcagtttgcatagggatcattaactttccttgacagaggtttaatttccatcagacattttacacactctgaccagtaatgcattcagactcaccaaccagtcctgctaagaaatgagtgtgtattggtagtgtttaactgtaaaatgggaccaagaagccaagcactgtctgccactgagtacgaggttactattgatttctatcttactcttttactccactgatttgatttctattaaaattctgccacaggttcattctctgggtcaactctgccatcacaaccatgtgcagtgacttcacccaggtttctgtcatcatgattttactcttaagatctcctcatccagcgctttctagttattctagaattcttgttacaaccacccctcagcaggtttatctacccctctttcattctatttttttcttcctatattcttctcttatccattgtgatcatacatgtgtgaggaaaaatatgttgggattctaaaatgccatctaagtccctgagttatgattctgagaagacacggatagttcttcatcatcaggagagcaatattaatgaattctttcttcttatagtttttcttcataagaactgtccacactctctcccctccctaactcgccccttccattttggaagctttccagcaataaagcagaaggaggcagtctgagaaaggttaggcaaacacaacaatattaccggaataagtaacatattgctcattaaacatttaaaatcaacagttgcttgctcgatctgccaatattttgagaaatgccagttttactgctaggtgccacttggcttgagcttcttaattcatgatttgtgaactgacatccgggataacaaaaccttattccagttagaattttgccatcaagagaaaagctgaaatatcacaacacaaagctccctgttttttttttctccttcctgcctccttcctccctcccaccctcatgcctctgccttcattccagaaacaaatggatgtgttaaaacagtgaaatgtgtttgtggaagataaatagtttatcttaaatatactgttgtagtgtcaaaccgagtctcaaatacatgtacatattttattcacagacataacatttcaaaatgagtagcttttttctttttcaaacatttatacatgagcgtaatgcctacaaaaaataaaaacagaacgacaatgtagctcagatcttatcagcattatgtgctaatctcatcaagagcacgggcccagagtgtagtattttgtttcaaaaaaaggcatcccttccctactagaagcagaggaaagtttctggacttttaacacatctctctcttttccctcaaatattttgaagctttgttttattttcactttgctgccacaaatgtgatatcctggccaaagcttctaatcacgtgggcatgctttctgtgtccttcagcaagggaataatttggtctgttggagcatcagaaactatgcatctggtgctatgatattttggggaggggggttgcaaaaattttttaaaatgtggttcccatccttaggtagatcacaggctactgaagagacagctaagcaagcaaatgatgacacgtagcaataagcacagtaaccaagctgttttgacctactacagtcaggattttaaacttaataggaaagaaggtgtgccatcaggccaatgagctccatctccctgggccatacgcggagacacgattgttctgcagtatatgtgaagtgtgggagtaccaatgctgatttgataagatgaggattcttggcatccacagtcttaaatgtggtaatcagaactcagaaaggggaatatcacagaaaagtgagactcttgatgaatgtcctcccagaacagtaatctcttagcatgaggccatctagaaagatggagaccaagggaaaggtgaaggagggcactttgtaccaagcctactaccactggttatgggatatgttacatttaagaaacacaatgatgaagtattgttgttctggttataaagagtgacaaacaaggaagagataagaaaacgcatctgcctcagacattattaaccaataaaagatttacttgatactttgagaacatgctattcttttttttttttttttttttttttttttgacagactcttgctctgttacccaggctggagtgcagtggtacgatctcagctcacggcaacctccgcttcctggcttcaagcgattctcttgtctcagcctccagagtagctggaactacaggcatgcaccaccatgccaggctaatatttatatttttagtagagatgggatttcatcatgttggcccggctgctctagaactcctggcctcaagagatccacctgcctcagcctcccaaagtgctgggattacaggcgtgagccaccacattcaggtgagaacatgctattctaatagaattgtaataataataacaacaacaatggtggcccatgtcaccaattccaggagttagaattacttgggaatgctatgtgtatggcagctataaaggatatgatagatctgattagttttggtgaattatggggtcaacttgagtagtggagactgatgcttctgaagccttggtatttgccatgtctgtaagttgaatacattactccaaagctgcaggacacatgtctcaaaatgttgatgaaagttacatgacagcaaatttataataggccctacataatcactctcatgcctttggggctgcaagttcagtcaagtttatgtcattattaccattccttgggcttacagaggacaaattttatgatccaagaagtacaaatccagccaagcaagtaaatgggttcagatttattgtgaagatacacttatctacccttttctgttacccatgacacagatctacaaatgtgtacatttaacaatattaatggaaattgtcaatttcaaattacccaagccattggagacttggaatatcataaatacacaaataaaacccaaagataaagtttaaactttatactagtaaagaatttcaagttccactccagtcactgaaacatttattagttatatcaggtggaaatactgactaatatgggttttataaatttatatagatgttgtatgtattggtttatactgtaaataataaataaaaagctgacattagaaggtagaaagagacgtagtcattcactcatccatcaagaaaacatatcattagtgcctataacatgctccattaagcatgggctgtaccaatggagggcagggttcttgtccttcaggggctcacagttgagtgacaattttaagactagtagttacccctgaacaatttaaaattggctaattggctaagccaatgtgtagatgagaaataatggcatcttattaagaaagagactaacttttcacaaaagaggcctgggtaaaactcagagccatgggatataagccctgggtactacaaatatagccttccttttcaggttctttattaaaaatttttatggtaatccctatatcacagatcaaaacccttaatgtgagtttaaaatgttagcataaaacataagcttggtgtttgtgaatctgaattcattcaatttatcattgaaaaaaattctaattaggtataagaattaagaaccagcaaagaaacacaaaggtaaaaataaaaagatcttacagatttgaatacactgaatgcaacagatattccaaggacaaactctaatgcctaaaccaacatacactgggatagcagagtggatatcagtgatttctccggtgaccatttctgtgtcactattctctggacacactgattgatccaagagagaaaaatgacttaggctagactaataaaactctctcctggaaatgtgaaacttgaatggagtgtctcagataacgagtttcattaatggcatcatgttatagagaaactccccaaacaactccttcttaagagttgccttattttgccttataaagaatatattgttccatttttcctttaaatttataatttacttcaaattcttaaattttgttttgccttttgtcaggcgagttagtttctgttgtttacaatcaaagggcaccaacaaatataaatatttgacaaccaaattttcctcttgagatgctcttgaaaacaactttaatatcccagggtctctattttaataaaggactacgctgaaaattctgtttgtttaccaaaacttctaaatcactgggaaaacataaggtcaggattatgagtaaaattaatgtaaccactgagtaaatagagaatatttttaataagtttgaaaatcagattaaaagatcatggttactttgaggcctaaacattaaaaatctgctatattaaaataatgtacataggctgggtgtggtggctcatgccagtaatcccagcactttgggaggctgaggcgggaagatcatttgaggtcaggagttcgagaccagcccggcctaccaacatggtaaaaccctgtctctaccaaaaatacaaaaaaatgagccaggtgtggtagcgggcacctgtaatcccagctacttgggaggctgaggcatgagaatccattgaacccaagaggccgaggttgcagtgaaccgattgtgccactgcactccagcctgggcaatagaacaaaactctgtctcaaaaataaataaataaataaataaataaataaataaaatactgtacatagtgccattatgtgccatttccagtaagatctgtcatccttacacccaagttattaatatcatacttcaacaagtagtgtttttacagtttgccacttgcattcataaatgctgctgccgctaagggtggcatgtgaccatgttcatgaaaagtgttatgcacataaccattgctctttgccagcctggacactcttgaaaacctcctgagcattagtaaatcaaattgtcacacctgtgccttctaacatttgaggactagcttggacccatttagaaaaagcaatccatatttggatgttacttgtctactctgtatttccaattcttttgtgagtattatagagtcattctgcattgttttcagccttgcagtgtgctaggttagtatttcttccaccgaccttgttaatcatctcatccatacagttgcttatgaatagtgttgccttccttgtcaataagagctatattaagagcaagcatccttttactgcttcttgactggttgtgttcttggacttggcggttgtttatattcacttgctacttaagtgtgggttctaaaatgacactgattaagccagatgggatatgtgcagtgtgttgaataagattcattgccataaagacaaattggaaaatatcatccttcccataaaatgtgaatttgttttagagtcagattgggtcatacccatcccttcactcatctaataaatatttattgattattgcagtagatgccttaaatacccagtccagattccctttcctgaacgtgcacctgtctctcagctgttcttagaactgtgattagtaacatccacctggggccctctctggagaattgctggtggatgatagccaatatgtccagaaattcctggctggttacaatttccctgctcccaagtgattaatgatagactgtttcaaggtttaaaaagtgaagccccttgtctcaaggtgagaaaactctgcagtgctatttacaatatagagcatcaccatgtatcaggacaaggtgagagttttcctaaggcaatattcttttttgaacctttcctctttcctatcccacttctctcctgcttataggtttttctgagcaacactcctcaataactcacatacacctaacacactgtctcaggctctgtaattaagaaatctgacctaagacaactacccaccttgtaccaggtgctggactagggctaaatattttaataagatttttgctcaaggatctttttaagacttttataaataagacaatctttccaataagattgtcccttcattcaagggcttgaggtttccttctgaatttttccagatacattctgattcagtaactgctgaataataagtggttttcttgattcacaatttccaatttctctgaatccatacatttttgatataccttactttattcaagagccattctcctaaaaatttgcataatagagttcccatagactcatatttgaaatggcataagagagtatactatttaagtactcttgttaatttttccataaactgaattattaatcactaaactcatctgttttgaaatatgaattttcatatgtcacattgacataaagaaaggactactttactggataatgcattgataccaaaggaattttctggcatcttctctccctcatctctcaccctcaccccattcttatttttggactcctatacctgtttttatggttgtaacaagctggctccaattcctccatccagccaagtttacctcatgctgataaaaaacaaaacaaaaccctagcagctttcccccacttgtatccttatgctcaggttatgtgatagataactatctggacgatagttaactatagttactgtagatactatagatactgtagttacaatcttccatatagataactatatggaagaatttgtgcagagagaatgaagcagatagattgaaggagaaagagaactaggggtcaattcctgttccactaaattccaaagcattatttatatttttctcagttcttaaaactttatttcatcaattgccactggtaacaagaaggcaacggggtaggcctggggaacacattgattaaacagaggattttgtacattgccatctattagaacacatttgggttagagaacagggaagtgactaaaagggataggaagtgtaaaggtaaggaggtgagaagataaacagaaaggtaaatagaagaaaaagtgattgggaacagagagtgaggatcaataataaggaacacagaggagccttagtagatgtagatgccttagtgccaacctgcacttggccagtggtggtcctcagggaggttgaaacagtagtcctaatgtgatatattttgatggaaccagggttggaaaatacgcaataatcactctgaatgcactggaagggatgggcatattattgagctgacagtgtatataatgtaggcagtgtatatagatggtagatgcatggaaatcaggttcaagttgtaactgattgggtcctcaagcaaccattgaatccacatctgtaggaatcccagatctaaatctagtgaaggggagtaatcctgcctgttctctttttatgcattactgtagatgtatttatacacaaatggtagggtattataccataggaaaaaatggaaccttacaaaagaagaatgaatcaggatttggcacagatggctaaaggtaaaaagaaatatttttatcttatgaggggacacagtgaaagataaaataagagagtgaatggaatagaaaaaaatgaaagacattaatgataagtcaaactaagaaactcaactaatttcttaaatcttgctttaataagaaaacaattactgtgtatgattaggatataattaagattctgcaaaaacagcttctaaaagcagagaatgtagtaattggaaaatttgaacattaacaaatcaatgattctgggactatgatgcccacaattgacttgatagtagggtgtcacagtgattgaatttgatttttgcaaagggatgaagaaaagagagagctctatgtatatataaaagatgtagtaataatgggtgaatggaactaatcttcataatacataaagagaatgattttggaggctgaattaagcagtttttgaaaggaacagatgttcttagagaacaatcttaaacatcaagatgacaggtaagcaatattatctcgagaagaacaaatggtggacatcatttctgatagctttaagatggacagaattctaaggaagtaataaaaggcaacgaagggcaactcatagttgaatttcaataaatgtaaaatagacattaaatattctaattcaattcaaattcaatctgaaattaatgctgttggattggcaattagtaaaggttgatcatggacgattagagatgtggttctggtgatctctctagtgagtctattataaggttcatcactgtatagaagatgactacggagggctcgcagatggcactggatgtaaagatattgcaaatatcggggaacagaaaacaatgcaaggaatgccaacaagtttacaaatacgagcagaagtcatctaaaataagattgagctttgaaatatacacgctttagcagaggataaaacaatctaacaaacacacatattcactaacaagatggacctggaagtcaataacataaaaaagaataaacacgaatgattataagaaacacaagtatattctgcatatagcaaatgtaataaaagaggtattcctttagatgtggagtgtaaggaagcactcttcaaaggtcaggcaaattgattttgaaaagaaatgtcattaataggtagtatgtacaaaatactaaaaaaggcgttcacagaagaaagtatattaaatatataaaattgaacttggtatctttataatccaagtaaaaacatttagggaacttacagaagtgaagaggaagggaaaaacacaaatgagaaggagaagtgcaagaataatgcaaactcattcaacaagtacttaaatttaacacctgcaatgtgcagtgccatgtggctggtgttctgggtgggaaaaaggcagaatttgcgtttgtctgttcctgtccttcagtgtttcattcctctttaggagagagatttatacacaacagaagctattttgtgttaaagaattttaagagttgtaagtgtggaaactgcaaaaaggacagttggagtgacagagatccaaggttcattatgattatgagattgtctatgtgcccaggagagataatctcagttcccttctatattacaatttcatggttattagttctgaagaaaaactagaagactagtggggaagctaggttatattgaccaacaaaatatgaggacagactgaaagaggtaagtttaatatcagctaaagtcttgggcagctggtcagaatccagactggattcatgctgtcatcagcagaggtcaatgtgaaaggtaaacaacttttgtgtgtgtgggggtgggtggggggacaagtatctgctgcataaagcaagatagatgcttcttatcaatcaagaagcatttagatgcttcttatcaatcggaatactggaaacaacttagaaatggcaaggcttaagttagagtcaatactcatgcaggctaatgctaccaggatctgaaacagtaccacggacagctctcttaaggctggagagcctgaaaaaaaaccattgcccaatgatccccaaaactacaaagtgagtacttgacctcttaaagcactgaataaaagacaacattggaattttcatctgcaacagaggtttgtctatccagatatgacttttaatggttaattggtttctttaagtctttggcaaagacttattgtttgagagcacagattctctctgtgcttcagagaaccaggagttctagtgtttgaggacaagggaacagctatgtttaagctcaaaaaaagagaaagaaagaacttgcccttcctctgccttttcatactaatccatatcagtgaggaggcatcttctttactggtaatgcaaatgctaatgtcttctagaaatacccttacagacagactcagaaaaaaatgttttaacagctatctgggtacccctaagcccagtccaactgacacataaaattaaacagtgcacgaggtatgtatgcttatccaaacatgtattcttaatttctatatttatcttattgtgaactgttaatagtttaccaattggccatgacccagtccatgggttacacttcaagtggcagtgatgtaaatgacaatatgcactatttaaaatcagaacaacaaaaggtggttatttagttgaaagaatctacatccaagcaaatgaagttccaaaattccaaaactcaactctaaattctccatgtttttctttcagacttgaaatactggtaagtattttattcctaggttttccctaaacaaaattgttattggtgctttcacttctgactttagtgcctctagctaatctagtccttatcctttattgagtgtttgtcaggaacaaagtgggaaaatagagccagctcaataggctaaagctgcatttccacaaacccacttcacttatggcccaagatgaaatggagcagttgtttctgagaatgggatatcatcttaggttaacaatgtgttatctttttttctgtattttggaaattggaaaccaccttgagataccaagtctacttctttttgttcaaatggttgagtgtttcattgctgcttatgtaaacagagttcagcaataatgttctcttggataaacatgctcaactttaattattttttaaaaactattctcccatgacggagacctaatatgaaatgctatgccagcatcagcaataattaacatacaaggcattttatatgttctcgatattagaacaacagattttctttgaacccccttgaccttaaaacatgggacaaaggaatagcctatctaaacaggaaagcctaaataattttcatgttttagcaaattcatttttttcaagtgactcttaatactttctgatattaaataaatattctatggtgagactgattatgattagaggggtgactatgtaagagcaacttttctctttcccattatatatatcattttataattttattatgtctatgtatttatgcatatgtaagaacagctgtaatttttatcttataatatgaaatcaaagtaaagaaatattttaataactagcaataacaaagttctgcatattaagaccactaccttgctcttgatgaaatgaatgaaatacttcaacaagtgtctgccgtttaataatttatttgactcaaatgttgctcttttggttttgcattaagtagaacaactatattgaaagaattcatgcaggaagatgcatattttaattacatttaacctgtttctctgttaatttgttggggtacagagataagatgtggattaaacattttctgaaatgcgtttttcagagccacaggcagaagctgaggccaccctgtcatttaatgaattatcagtttagcaggcattgggtatctatatatatccacaatatttttagtgacaaggagcagtgggaagaaaataggtagaaatttagagcaggcgaccttggggagatttgggaagtcacagaatctgcttcacctggctacagtgagagcataatcccacttaaagaccgcagaatgaagtattcattgatatgtctgaagtaatatgtattttaacatatttttaccattaaatataaaatcaaactattgacgggcagtaaaggaggtcagatccccatgtctcaatggctaaatagtggacacattttagcaaagtacagtgatacctcatcttgtcactgattgaatttatgtcaggcattgatgagtaaggcaaatagttgtccttttatattctcactcaaaatacatttacttgtgtgggtatgtgtgtataactatttatatatacaattactttgatttagaaagcagcataaaaatcattgttccattttcttctcataaaccatgaaataccaccacaagactaaaataagtaaatgctttttaagtgtcaattaattattttgtcattaacataactgtagaaaaacatccatcccttaatacattgctgtttatctttctataaccaccccaggccttttcttttgcttctagtcccatatgctcccaaacctagatttacttggaatattgttgttaattacctctttaacacctctccactactttacacagcatttgacctcacatcatacccagtcttctggtataaatcatcccccatgctgtccagagttccaagcatctccattttcagtcttaaatcaacaccttccaattacattttcaaaaagaagttagggatatactcaaactgatccgaatccactccaatgtttggtccactgttttctctgagaaccagacttccacacttattgcttggtctcttgaagctcataacccttctttttgttgttttcaaaaattctcccagggagtgcctatattgaacaaatttctattttttcttcttagttccttcccatctactatcctgatctcagactgtttggaagtataataagtgcagaaaagaggaaagtcaactatgtggcaaatttggctggtgagattatttagaatggaatcctagtctattctaagtctgtggctagaagaagtaaattctgaggaaaaagagacagccccctataccaaccctaaagatattagtccctctcaggggtaggctctttcttcaaccacgcagagagaatggacaggaagggaaagaaagccagtgaagtggaaccatgccttgtttacgccatctgttgagattcctgtgaatgttctccctctctctaaagcactcagagcacacatgttccagttgggtaggaagttggggtccttttcatccagtacagggctggaatggaaaggtgagcctgaagatgggcaaggttccttgtgtttaaaaactggatatgaatgaagttagttgtcattctacctaacgaaaatactactcttttgaaattaagtataaaacttgaagtggaatatctgtaatctaaatgcgcttatgctgggtgatgtgttggtgaattttcagagacctatgaactcataagaatgggtgtgtttgcctgtgtgtgtgcaggggttactaaagaatgaaactgggattctggtgctccaattggggttatatttaggtaaggcttaagaacttgagaggggagtcatgctgtagagtctggtggtagatccaagtccaggcaaaactgatatttctaatatgaacacagcactggattaaatctcagaaggactggttttcagtcctgctttggcccccagttatgtataacataaatggagaagatggcattggagtatcagcggaatgacctttgagagtaaaaactagcagtgaccttagagattaatagtctgtaattctataaggtaaccctataagagaagttttcctctttactatatctgaattctctataaacaatatggcattaatgactgtgtttaggcatttctgcaaggctaggacatagtcctaaaaattgagcaccgcaaaacgaatcctgtctgtgcttccatcactactaaaacaatgcgaaaaacatacaaatcatattaagagcatcttatattgcatttaaatatagtaacagtggaagagataattttagttactccctcagaactagcaaaaacacactcttttgcaactctcccatttgttattgtttgcagacactgcatacctaacacttgttttatgtaaacaaataaaaaactcaataaacagtatatcccttcattctctatagcagtaaacttctattttaatgagatttgagttcagtacagcaattttgatttcttttcaggttggttaaaataagattttacatgaattcctaaatctcaaaagcatccacggctctatatgctggctcaatacagacaatgttaatgtgatctctctgggacattttgcaaacaagtttctgaacttgtacaaagaatatcggagcatcaaccagctaaaattacagtgacctaacagatagtcatatagtcatgtaactatatgtcatataatagtcatgtaactctacatgataatccaacaagcacaatttactcctctattatctctaatctgtctattaatcaacatggaactagtagttcaggttaagcctctcttacagaccacattactagtttggaatgatgatattccttacttttccagttaagaataagatgttctcacagccggttgaagttgaatctgaattatgggagagatttgccttctaagtcctctcactttctatccattctttcttctctacatttgcaaaacacatattctcctactcttcgcctgtttctgtttccctttttcccaggaaacaaaacaaatgaaaatgacacctcagtaaaagatgtagccagtaagccttcatgtactcattgactgatgaggcttatgttgcatcattccagaggtgcttctatgtgaaaagagtttcatgcagccaaaggatagctattgtggtgaaagccagggcagtctcagtctgaattcatcctagatatatagagatattgggatcctcagcccttagaggatctatccaatttgcattgcatcatgagcatcccatttcagtatcctgtaaaaataccgacattttccatgtgtgccctgatgggaaaaagtttgtgggaggcttagctaggaataaggttgataaggagtgtttccattatgacacaaattgtactatacttctgccttctgtaaactttgctcactcaactgtagcttacccctaacaatactttcagttatatgtgaagggaaggctgggaaccagaggcagatttactggatacctcattgttgtgacataatgtcaggaacagccccagtcttcctccatccatgtatacatattcattgcaatggaagtttgtaggcccctcccacttctgactctaggctcagccttgtgatttgctgtacccatcaagatgctggtaaatgtgatataaacagaagcttaaaatgggcatgcacactggagcttgttcttctcatgctctctgataatgtcatgagaagaaacaagcctgggctggcctgatgaaagataaaggacatgcgaagagctgagccacgtcatcccagtcaaagccttcctacatcatttgacctcacaacatatgagtgatctcaggtgagatcagcagtcacctggcccaccatcagtgctgacacatgagcaatatgcttattgttgaatgccaatgagtttttatagttgtttgttatatggcagggttcaagcaacagaaaatgaatagtctaatgaagcttcagcttcagggccagtcttttgccaaggccctattccaaaccactcaggagagcccttaactatttgttcaatttggtcagagttttgtaaattttgcaaaaatatgatattttaatcacaggattagagttgttgcctcccaccatccctcttctcttccatcacacttctcctggtagtaggtggcattttagtggcttcggttatcttgggaatcctgctaaagggaagttcagttggttctgcatatagttaagtagaaagtgatatgattatgatgttcacagtcggttctttgaataggtaagttattattagtaccccagtgctggaatgtacttacttctcactgtactatatcacttaacattgcaggaacaaaggttgtaatatgatatgaacatgtcttagattacccagtacaagaattataagagtagcagaggataaaatgtataaagtcagaagctggtcaatgaaaaattcttccaagcatcagacctgtaaattttaagcaaaatggttcaaacccttgggaaaattatttggtagactctactaaagcagaatagctacatattttagaatccagtgatcccacttctaaaaacatcataaccaacagaaacaggttcatatgttcattaaatgacatgtccaagacattctcagcagcactatttacaatagtccccaaatagaaaccacccaatgtttataaatagtagaatagactctaaacattgtggtatattcacacattggaaaaccatacagaataagataaactatccaaactatgtgtatatcacaaacactaagttgagtgagagaagccagacacaaaaagaagtattataggtatgattccacttatgtcaagtacaaaagcaggtaaacaggggttacccttctagcaggtagggactggaagaaagcataaggggggtttcgggagtgctagtagtgttctatttcttgatctggatatcagtgtcatgctatatatttgtgaatgttcattgagccatacaattaaaacagacactttttagtatgtatatacttcaataaaatatttgaaaaattataaacagaggatatagctatcatcaaaatggaaaaactttaccttcaggaatatacttgatgaagtagtatatatgagtatgcatataatatacatcaattatattatatatataatatatattattttaatttaaactgtgtgaaatggcatttgtcagaatctctttttagggcagaaatctgtcacagaactacaaatattgggtatgggagtatgtgaagctgtatgtgaaatctcactgtatcaatcaggaaatacttaaatttcttatcaactttatacaaaacataaaaatctcagcaaactaacacaggaacagaaaaccaaacactgcatgttctcactcataagtgggagctgaacaaagagaacacatggacacagggaggggaatatcacacactggggcctgtcggggagtgggagactaggtgagggataacattaggagaaacaccttatgtagatgaggggttgttgggtgcagcaaaccaccatggcctgtgtatacctatgtaacaaacctacacgttctgcacatgtatcccagaacctaaagtataataaagaaatcaacaagaataaataacttttggcttgctactagaatgagaactctgacgacaaactggttaatgaatattgtcaactcaaataatatttaagagtgatcagcacaaaagaaaacttgaaatgcacttagctgttgtagctcatatacagaagagtctcagtagaggtttctttttccccaaattgatgacagtcctaaacatttgcataatattggcaggaagaattataaaaatcaaaggaccttttaaaactatcaattttaacatacaatttttgatcaatcatagtagagaaaaattgagttgtctctttatttgctctataaaatattataaaagtgtagtcttatgaagaagcaatcaaaaatgttcaaacgaaaaaatcaggaataaaagtattagatgtatatcaggcaattaattcataaaatgatggtaacattctctcgattttatgtttaacttctatttttactctaaataaaaatggacttttacacccaatttgtgttcttcttttcgagaggacttacaaattatagaactttcaggtaccacagaatcgagatagatgaccgtgctgggaatcaacatgcatactccgtagccatgtgacccagttgcaagactgtctcctggcagacagattgtcatcacttcaaatcccctttcagcttctgacccctcctgtgtcacacaggtcaaacctccttttcatgtctgctttctcccttttcactttcttactcttaatttagacaatcttattctgcagtattatttgaattagataaatacgcataactctttattccatcaaccatactgcaagaatttagaccatctgtcttctagcctggttggacaaaagtctatggtgcacctattttcatccagggtaaccttgcccagatctctgacttgtcaaatagagctttaacattttactcaccactaacaattccttgcctttggccactgcctatatcctaatacttccttctattagcatttttgtccctatttacatgcaacacctaaagggcaaagggaaataaagtatgtgctcacaatgcatgaactggcccaagaccctcggtactctctggatgaaggaatactcttctattaaaacaccatgtgagtgagatgggagaatgaactcattctgagctctctacctttatgctagaatttggggatgaagaaaacataataaagtaagaagaaaatggcttctttggcagaccatcttattcagaaataccatcttctgagttaagcccactaattcagcattcagatttaatgcattgttcatgaaaaatgaaaaccactgataacatatttttttccatgagatgttcagaaaaaaatctcaagccactgaaagaattaatttgcctgtaatgaaactgacacgcaggaaaaatttaaaatcaatcttgtgcttaaaagcagaacaacactgatggtgcctcaatatttcctccctcttcccactgctagcttgttaccagtgaacacatattatgcatattacccacaaatctctcctttatttaaattttaaaaagaaacaccatgtttttaatcaatctatttgcacttggctgtcaaaactcacaaaggcactttgatttcctttcattattctcaagagaaccaaatgcggatgaatagagaataaaaaggaagaaaaattaagggttaatacaccttgttaaagtcagacaaacaaacaaaaaaaagatgtgtttattcacggcctgttaaaaaattcttgctatgcttccctcccattgacaattaccagaatcatcaggtataaatgcaggcttttgtcctttaactatcagattgttcttccatggttcttagtcacagctcttgttatcagagcagttcaatctcttgactgtgaattgtgagggtttagaggctggacagaaaaatcactgaagactttagggatgtatcattttggtattgttggtcaaagctcttctactgacaggcaagagaccaaacattcattaaaggaccaaacagatggggtcagttgactcctagcaagttttgggtattgggagcaagggtctccacagggatggcagaaacgctgttggtttcacaaactggctgattactagaacttcctgagtgtggtttccagatttagtaaacaaaaatacaaacagcccagctaaatttgaatttcaggtaaaaacaaataatttttcagtataagacccctttgctggaagtgcatcaagaggggaaatatttctttgaacggatctatggaatggaaggagagtagtatgatgaggagggatgagtgcatttaatacataagaagaatatgtgacaaatttgtgatttcctttcattgtatttattcctggcagaatacaaagtgtatctgtaagaccatatttatccagggctccttggaaatgatttattctgtagagaaatgttttgtttgttttcataattgttgaggggttacctctttaagtagtaaaacattttacattctaacttctagggatgaaaatctttcttaaatgtgtcacacatatattcttgccatttcaaaaagaaaacactgctatttatttttccctgaagagccaagtttattattatgaacatctattgttgtacaacattgataccattaaaattaactgaaacatctgctgggctatttgccatttcactaaatgtacctatgcttgtgtgagctttaagtttttgcatctgcttttgttgtttatgtttttatgttgtcatttatgttttctccccagtcaagctattaactgttattctttctcctttctaatttttctaaaattctctaccccttgctaagatttataaataagacagcaaggaaataaatccagttcttaggattgtttgtaaacaaaaaacccaatttaaggtccaaacagggtttatgtgaacaaagtacactagtagctaaaaataatggtctttagctgttaaaatagtttgccacatacatattcaactgaaattgattgctactcagttccaggtaggtgtagttataaggtggccaactcccaggtagttgagtgaggtgtaatatactccttgtggatatatatagtggtatctgagataaaaattattatcagagtagaaaaagatgaaatcagtagctgcaaggcaggtgattctggatccaagatactggggtcatcctgcactgtcaaaaacagtgtagaatgagatctgactcttgctggcttttatgaacttgtaccattcatttaatcaaaactgtgccttgcttttctcatttgcaaaacaatgtagataatcaataccattgatttaggtattgaggaagtgaggataatttctactgttctcctcatttttctaaattggtctcatggtatgcagcttttactatttttacatgtggtccgcacattgttatcctcagtgaaaggactttcaaatttgagggaagagggcttcttttttttatggtcatgattcataagtgcaggatttctatgccctgaacatgggttcctaagttccaatgtgcccatgcatggagaacttcttgtcctccttggaaacacattctgagcaaggcctgccctttggggttgtatctattcccactcctttcttctgtcagtgatgggtaaatgcagtcctagacatttaggtatgaaggctagctgatggggaaggaataagaagcctcgcttatgattccaagattaagcttctcattggtgacccttaccagagaatctctgaactgggtagggttcggctatggtatgtgtgtggcagggggagggaggaggtattgcttagatgctcacccagctattaataaagctgatcatttttcccctcatttggccagggttgttgttgtatataattttctctatagctaacttggaaggagaaaagcagagcagcatgaaactcactaaattccatcaagaaatcttattactgttggaggattatggtgattacatgattttttttaaaaaagcttgacatacagtaggccctcagttatttagttatttacctccctcttctctccatgaagagaagaggagaggaactgaatggagggctatgaaatgggaaaagtggtaaaccatagtgttctacctgatcaagaagctggggggaataactaatgaataattgtaaagcctttcagaaagataaagtctatagaaatgcaaaatagtaatatcagggaagtagagatgtcagttgaatataaagaagacagcttttattcccatacaaatatcttggtcaccatcagcagcggtggacaagaaaacagaaagaagggtgtgtgacagtttaatagtgttttgttaaaaatagaacgtgttttaagagtgtctggactttctttaaaataaaaagatgagcactgactcactttctgttagaacagattcagaagtgcctctggcaaaaatcactggctttcccacctccaatttcctatgttaattaaattgggagggcaaatttggtatatgagaggaacaatgtcaagaagccatgttggcaggcaaaataccgcttcatgtgggagcagttcgtgagctctggccagctcagctttccacgctgaattcaaatctcactccagatccaaaatgctagtccatgatatccctcctgaggaagtcctaggggctaggataagctcaagaaagaccatctgcttaaggatttatattcagaaacctgggacaatggggaactcttggctcattctcagggtgttaagggtttagtgtttccccaaattttggatgatgataaatgctatgcaaaaaatagtttctacatcaagataaatttaggaaacactggatttaaaaaaattaacagatatttttcaactgtaggagttcctaaaacctttcatatgttaatgtgagctgtacatttccaaaagataaagacaatgtgttctccaaatttatttgactatagaactgttttacagagtgttcatcagggcaagccataaggtgcactttgggaaatactgttctggggccacctacagatttttctttttgttttgggcatcctaaggattttctagaaagagctgaatctccagaagagccaagaaagtagatttgagaattcagctgaaatctgaacaacctattgaggttgcatctcagtccactttagtaccaatatatgattgcctcatttgcatgaagatgcatatatatatatatatatatatatatgcacccaaaagacatttctttgatcttaacaagatacaattagattgagactcacctagtacccagccaatggtccagcctccctggctatgactgaatcaggcagacttcacttagcagaaagctcaaagatgggggatggggagcatggtgcttccttgtttgaaggttgtgaggcatctccagtggtgaccacccactacatagccacaaaggaagttcgagaaaaggaagaaagggactagtgtgtggtaaattctctttgggtgctatgagcatgcacacttaagtctgggttgcagtggccaaggggctgtcatgcaatgaccatttgaagccatgcatcaacgtgtacagccatgggtgtctcagatggcaccacagtataaatatagtcaaatcagttcagtatccagaactcaaaggagagaattgtgctgaaatcatggaaaaggataaagaagcctcattttaatatgttaaacacacacacataactaaggcagccaatctgaaacagaagcagatgtattcagggtacaaagaataacatttttagctagctcggcttcctttcaaacagtttttttcaacagtgagagctttctgagaaatgcatttatataggtacaaagcatgtgtctctgtggcagcaggagtccttatttgcatcagattttctttaacacctgtttgtttcagagggcactgccttcctaggaaacactccagaaaaggaattacataaagaaaggatgctttagtttggaaagatgaggcagtgcagagcattcacaattcctataaatcaccaagtctactttccttggtgaataagagaaaggtactttaaaaaactattattataagagctgtgattacccttgtatacataactgcctgatgcctatttttaaaccatgtccttggaacacaatgagtattcaataagggatgtagacttaactcttccaatatctcaatcctgcacatccactaaatcttatatgtcaaattgccataaaatctagatgtgatgctgttttattctgttgattagaatgattttgtatctaactctatacatagtccaaacatcaactttgcacagtcagcaacaatctagattcttaaatatcctgagaaggggacatggcatctggctctgctttaaattgtgcttactgtcgacaacagaagtctctaaaaatggcatcggagtttatatttattcacatctaatttatttcagagggacagacccagtttccaaattgaaagatcgtcttcctgatgaccattaggaatggcctgctttcttaagatgtgaaggaaaaaagaagttgaatggcctctatgtactataatccttcatgtcctcacagtggtgctgtaagcatgataaataattttggatgtagaattacacttaactatttgcttttaggatatttgtttctttacctgtcttcctacattcaatacatcagagaatttcagtgtgggttgtgaccttaaagatattattctctaggtccaaatgctatagatgaagaaactggggcaggacaaaactaagagcttcatttaagtttaaattgctatttcagctgggcgtggtggctcatgcctgtaataccaacagtttgggagcccaatgtgggtggatcacttgaggtcaggagttcaagagcagcctggccaacatggtgaaaccccaactctactaaaaatacaaatattagctgggtgtggtggcccatgcctgcaatccctagctacttggggggctgaggcaggagaaactcttgaacccaggaggcggaggttgcagtgagccaagatagcaccactgcactccaacctgggcaatagagtgagactgtccaaaaaaaaaaaaaaaaaaaaaatgctaattgataccagagtcagcttttgccacaaactctgaccctaaggctaaaagaccagagatttgtgaactctcaatatttgctaatgttctgcatcatgaaaggatggaagggtacatgagcaggcatacaaccaaaaggagagaagttggctgctccatttattttgtttcctgtctcttgtcttcagcatcaagagaaatgttgacagtgaaagaacaatggttaaatggagaaaaaccattattcgctttcaggtaccttactgggcctttggcactcacagtggattctgcatcaggatgaaaacagctgattttggttcatggctatagatcctggagttaaaaatgtctaaagcagcacaaacaattttctcatttatttggaagtattcttcttttctgagattcttactttcttccctctcaattttggcaaaaacaagtttcatttcctccaccaacacatattctccctgcccttcctatattcacctttgcttagtagtgagtagcaggctctgctatacatgctgagtaagagaaggtaaagcagtaggagcatgcttatggatacattctctgctattagctgctctggacagacctttggatgctctgcctctagaatcatttggggtctgagagtctgtgcttaatctgtcagttatggcagccaagagcaacttacataatcactggcttttgacaatgtagcagtaaaatactagataggaaggcatgtgaggaggtaatatgtataataatacatttttgtaggtttcaaagtgtgtccttggctgccttctcttctcattttacctactttacttgggctgcaattactcccttgatgtagatgcttcccgaaatagtgttcaagtccagattacagatacctattttcaactgtctcctacacatattaacctggatgacacactagcatttcaaaagcaacatgtcaaaacccaactttttgttctactcccacaaaccagtttatctcccacaaaaccagcgtatctccctgtatttcctatctcaacgtatagcatctaaatccactcagtaatcgaagtcagaatattgttaaaccatcctggatttttaattgccataatatttaacatccaattaattaccaaataaaatcttccaaataccaccccaatacattctcttcctttctcccttatcaaggctttagttcaacatcttatctcatataaatgataaaatttaattcctgggcatatataaaatatcacactttacaagtaaagaacatagattctcttaaacacatatgggttgtttacaaaaattgaccacattcagaaataaaaaagcaaataccaataaacagaattgttatctacagataactatttctggtaaaaatgcaattacactagcaatcaatgataaaatttaactagataagaaaaaaccctgtccatttagaaactaaataactgaaaggcaacagaaaaaaaatcacaataaagtaagaggaacaataataaaaacatacaaatcaactcttgtgcattttagttaaagcagatgttagtggataatctataacattaagtgtttatattataaagaaatacttgttaaaaatgagctcatgcattctagaagctaccaaaagaatagctcatagaaatatatagtatcatatattactattattctataataaactcactgaaagtaggaagaaaatgataataaagataagtgcccatgtattggaaaagacaacaataggaaacaatataaaaattagcacaactaaaagtttactctttaaaaaggttatgaatcatgcaaaactataaaaccctgtaagacaacctatgcaataccattctagacataggaacggggcaaaaatttcatgacaaagatgctaaaagcaattgcagcaaaagcaaaagttgacaaatggatctaattaaagagcttctgcacagcaaaagaaactatcaagagagtaaataggcaacctacagaatgggaaaaaatatttgcaaactatgcatctgtcaaaggtttaatatccagcatctataaggaacttaaaaaaatttataagaaaaaacaaacatccccattgaaaagtgggcaaaggacatgaacagacacttttcaaaagaagacatacatacagccaacaagcatatgaaaaggagctcaacatcattggtcatcagagaaatgcaaatcaaaaccacaatgagataccacttcacaccagtcagaatggctatcattaaaaagtcagaaaataacagatgctggtgaggtttcagagaaaaagcaacatctatgaactgttggtaggagtgtaaattagtttcaaccattgtgtaaagcagtgtggcaattcctcaaagagctaagaactaccttcaaccagcaatcccattacttggtacatacccaaaggattataaattgttctatcatgaagatacatgcacgcatatattcactgcagcactattgacaatagcaaagacatggagtcaacctaaatgcctatcaatggttagactggataaagaaaatatggtacaaatacaccatggaacactatgcagccataaaaaggaatgagatcatgtcctttgcaggaacatggatggagctggaagccattatccttagcaaactaacagagaaacataaaaccaaatactgcatgttctcacttacacgtgggagctaaatgatgagaacacatgaacacgtagaggggaacaacagacactggggcatccctgagggtggagggttagagcagggagaggatcaggaaaagtcaccaatcggtactagactttatagctgagtgatgaagtaatctgtacaacaaaccccagtgacatgagtttacctatataaaaaacctgtacatgtacccttgaatttaaaataaaagtttcaaaaaaaaggtgtcaacaaagtggttggcttgagagatggaatttgttggaaaaaggcataaagaaccctcacaggaggatggagatgttttatatcttcttctcagagatgttcatttggatacattagctttttttcctgtataaattttaccttattgagatgctatttggaaagaggataaggtaagttagcctctgataaaaatgtatctctaaaaggaacaattttacaggatcttaataggtttaacaggttttaataggttaggcaatacaatatattttatcaaataatatcctatgggattactatgccttaagacacactttggtaaactcttatttaaatggtacttaatatttaaagcagacattatattataacttgtttttaaaaaataaagtcttccctccaaaattcttttgaaaaactgtcttgggtttgcatagctcactgatgagtgattccagataaatgacacattactgcagaaagttgaagatgtggtttgaatttcactatctgaaacataaaactcattctcaaaagtagatgttagtgaatggcacaaattgaaagatgttatgaatcatctgtcgacggtagtcaaaaaaagtgaagcaacaaataaagataggaattatgaagtggacatgactatagatgttagtcaaaaattggatgtcactatagatttaaaaagataaagagctattaaacatattttaggaattatttattggaaaattaaaaatgcttatgtcaaatagttttaaaaatgtaaatgaaaaattttaatttctaaaacaatgtaacttagaaaaagggatccatgaagaaataggaaatatttacagttttatagtaacttaagaaattgatctagtggatacaaatcttcccacaaagaaaacgtcagtcccagataaaattatagaagagttctactcaacattgaaggaaaaaataataaaaacaatacaaatttaccatacaactcctgcgtttataaaaatagcaaccaaacactttacaacttattttattaggctagtaaaacattaaaatttcttcctaacctgtgtccttgtcccttctctcacctctcccagatctacccttcactctcagagtgatctttctaaaatgcgaatctgatcactccagtcctttagggacactcagggtttcttcattatcaccagaacagaacatcaacgttccttcctctggtaacctgtcttactcatttcatctctgcctacctttccaacctcgtaatttaccacttcctattgtgctgttgttgcagtttttaaaagatgcctctgatttttacttacatgtcctctgacttcacactcctgcctttcaaaactaggttttgttggtccctcttttggacccgtagagaacttttgcctgtcttcacaatacctatcccatcttattgaactctgcttattataacagtttgttttcctcatgatgttttaaactccttgaagaatttgtgagtctttagggtccagcacatggctggcacatggtggggtacaggctctacttcagacatatcttggataaaatgctcttttgcacagcttgtcagtcatcatcaagtagaatcctgtatctatgggaaaatacactccaggttacaatgaacagccaaaattgctcttttagaatataacctatttttaagtcagagtctgtctctattagtgatgaaaagtttctcacaagtttggtatatggagagacaataaaagcatcacctctctctcctaggtactttcaaaagacaggaaactcacagttgctctaatatgagataccgatgatattgggaaacattcttcagtgcacagacacatggcatcctgaaaaaaaatcaatgttttaccttcctccctgctgagtttcatttcacaatagagaactatcattataagcccccaaaatgtacctgttcagtttttcatctgtgaacaacactgatttcaattaaatccaaaatagataccccagagtcctccctagaatttttaatatttggcctttaatataaattgatcctttgctactgagtcagtaacacaaaaccaaaaaaaggctttaagaattattaaagtcacaggcagtgcacaggacatacttgagaacatgtgctgtagaaaacacagccttacataaagaagtcacttataaggccgataaaagatgctaagatgctcattcccctccccttgcattggtacctacagttcccagcggaagagggggtctcatcctggctgcttctcaggagcatctctcattctagggcatcaggaactcaaaatacataaggatatttttgtgaggggtcttgatagtggggaattactgggtattcctatttttggagactgctgaagaagtgggatgaggctaggggacactacaatgccaaggacatgagactagtacaagactggaaacagcaaacatgacttttgggattcagtctgttcctctgaccactggaccttgaaaacaggtgctggaaccttatggaaagcaattagagcttccatccagactacaggcttttgccaatgtcaaaaagatgacaaggttaccagcccgaggaatttcacactatggctctcttcttcagtattgtgccagaaatgcatttaatgatggagttctgccatttataatatgtgtcactttgggagagcagaagaaactaatgctacttttatttatgccgtttcatctatctgagaccagcatttattaagcatggtgctgagatgacacttgatttcccctcagttcttttttattgtttttgcatgtaagtcctgggaaaaataatactgctttggacagcaaatgacttaaatgaatcagatattgtctgggtgtaggtattgctaagagaccaacttaattattagttgttatcatggttattgcaacatctagtttcctgcagactagacttcgaagagaaggcagttgacagctctggaatccaaagaagggaggcaaaaaggaagagcagacaaagcattaactttagagtcccatttctctttcctactggctgcatatccaccatcaaagccttaatttgttcatctgtaaagtaaaactaatagttttgtttgctgaaggctttaaataaattgctatctacaaagcgtttggcacagtttttggcacacagcaggtgcccattgaatgttaagtcctgtttcttatttttaagacatactttgctaagagagctcagggaaaagatgtggtccactaagcaggtatttattacatattaaactgaattagaggcagctaattatatctttgctagcttaatttcagagaatgagaagtataacttttggggctttgtttgaattcttggtcaggttctacatagattaaatccaagaggtaaacaacaatcctaataacctaatgttagtcctatactagaataatttgaatatttaaaacaaactccctttcttttaaaaactgcaccagtcagttggttttccatctcaaccctggactgttaaacaactccagcatacccagtgttatttgctacagtctccttcaagccttgttgcttgcttccagcctgttcccacttggatctaattcctgtctagtttctgacattggcttcagtttttcttcctgattttgcctatccattgctaaggtctgaatgtttgtgtcccgcataaaatttatatgttgcaacctaatcctcaatatgatggcagtaaaagatgagccctctgggaggtgattaggtcatgagggctccaccttcatgagtaggattaatgaagaaagaggtagcttgtttgccccattccacaagtaaggatgcagcaagaagatgccatctatgaagcagagagtgggcctgcagcagacatcgaatccactggcactttcatcttggacttccctgcctccagaactgtgagaaataaatttctgttgtttgtaaatcacccagtctaaggtattttgttatagtaccctacacagactaagatattcatctcctgactttgatctcttcgggctacttccccagtcagacccatctgaccctgcatgaaagaaaattcacttaggaacagccaaatagcaaaaagtagttctcaaataattgagaaatggtttatgagtctacagtaaactcaaaaataaaaagttttcattgtaattatttagtttttaatcaaagtaaaatcacagatttttgtgtgaagtatcttgctgaagaaacagagagttgtatgcaccagctattgctgagtaaaatgtgacatcatttaggggcttctcaaggcctttttattatgaagatcaacatgccacttactgggcagtttccaaatgggcaacatagccccatctcatgtcacagatgacttcatctatctaaagtaggatctttaatgttgaaatagtgctagtaatctacacttaaatcatggggagatttgagcccaatgtatgaaatcctggtgtttgaccatacagggaagataagaaagatatatatatatatcttataatatgtgtcactttgggagagcagaagaaactaatgctacttttatttatgccgtttcatctatctgagaccaacatttattaggcatggtgctgagatgatacttaatttcccctcagtttatatatatataagtggaaaaagatcacctgtcactgaaaacctacccctcaatatccaatcaaatgattttagtttaccctaaactttacaaaagaatattgtagcaagcttattcaactgtagacttagtacatcttatcttgctattatctagctaacagagaagctttagtatatctgtctacctgcaaggctcagaacaaaactttgcagatggccagatttgcaaaaacctgaacacaggaccctaccttggtattcagcaaagtggaagatgaagtggagtcctgttctgatcctccaaaagcctgattctgaagttgcttataacctgacctttttactctgtgatgttacagatatgcagcctctgatatttatatagaacttattcctactgttatcagagcacaaaggaagaacataggaggaaaagcacaagaggtagcattattactctgattgttgttaatccattatacctctagtgcaaaaagcattagttttaagtcatcttagacatggaatttgcaggaaataaagtataggtgtcagagactttacagctttctttacaaaagcctctcttatttgcagcttgcctgtcgtcatctccaacctgtctagatgtttgaccttctgtccggcacttctgtcttcagtcaagagtgacataagctgttctaggtcactctttaggattccaaaccaagtcatccttgctgtttgtcttgtatcccatgatcatgtacttaaatttagataacataacttttggctttttctcaaagtctcaacttagagactaattctgaaaaataactgaattcctatgttgttgctatactgccttccctgtcctaatgcccgtccggttcaatatctgtctagggctgggaattggctttattatagatggtctttgctcctcctgcatccttagctttgatctttcttcaggcatcccaaagacacagatttcagatcccagatgccttctgaaattccacgttttgattctagagttttgattctctgcctacctgcccaggcatcacatctctgctagttctccatctaggcttttctgagtctgcacagtcttgcaagtggtcctttcatgcttgtctctgtcttgagatatgagtataagaaccagttggaagagctccaaatgaatggcaaatgctcaggtatcttctgtggttgttgttgctgttcccttggtgtcatcattcacctagcttacattagttcttgtcttttcttcagcagcaatgtaagaatcctgcttcttccaatccccgtccagtacatcttggtttgggaactcctattgctagatattggtttaatctgtgggtttctatttcctcttttttcttttatttaaatcaagaaatgcatcacttgttaaaatagggagcatcaggccaatattttgaatgtcttcttctattggagttttgagggatagtgccacaaagataaagcttgacgtgttgcaaattaaagagataatataatctgtgctctctcagttttgggtggggagtagtaagaagccagtcaggataatatactttaatgagaagtttgccttattagtgaggtgataattttgctctaatctagctcctttacataagtttaaaatatctgtgtttcactcttctaaaaagaaaacaaaaatttatcctgtttctgcaaatatgtttatggtagttattttgggcttgcaaattcgtgtaagtcattgacgcaatgtgctcatatcagtgttgttggtctcaatcataacaatatttttcagattatggatttttttctcatttgatcattatatttacccagggagaaaggtaagaaaacattgttcttattcccagtttaaagtggaagcagaatatcagaaaaattaagcaaagtgtttaaagtcccatagctagtaagaagtagaatccaggtcttttgctcaatcttctcttttttccaccaagcactcctcaaagtttttcacctgggaaacagagttatgcaaatatttgctcctaagaatttggaatatagtttgaaagttctgttgcaaatgtaaaatttctttgatgttttatattttattttgaaaaaccaggcaagttttgctttcttcccataatgtatcagtgtgtgttttaatataagtaatgccttctctagctaactactctacccccatttgattttttaattaaatttttctattttgagacagcaaaaaagacaaaaattcacatgcagttttaagaaataatacagagatccttctgtatcctctacctagtttctcccaacgttaacatcttgcataatcataagatcaggatttaaaaagcatatattgagcttgatatagttaagatacagaatttccatcactacaaggatcctgcatattgttcttttatagccacaccacttctctcctgtcctcacgccctcctcaacactgcaaaccactaacctcttcttcatttctataattttgtcctttcaagagtattatataaatgaagttatacagtatgcaactgttggcatagactctttttctttcagcataagtcactggagaatcacccaggttgctgcatctgtcagtagttcattccttaatgaactactcaatgttcaatagtagagtagggtgactatacttaacaatgacgtatatttcaaaatagctagaagaaaggattgaaatgctcccaacacttaggaattataaatccttgagaagatgatagcctaaataccctgacatgatcatttacacattctatgcatgtaacaaaatatcacatgtatcccataaatatgtacaaatgtcatgcatcaatttttaaaaggaacatgtactttgaagagttgtgaaattaaatgaaattatatataaagcattttacacatggtaaaagctcaataaatgacagctatagtaaaaatatatacagttgtttcttcttattgctatgtagtgttttgtggaatggatgtaccacagtttcttcaatcattgagaaacatatgggttgtttttggtttatagctattatgaataaagttgctatatacacttgtgtatgggttttcatttttgtttttctgagacagattctcactctttcacccaggctggagtgtagtggagcaatcactgctcactgcagcctcgacctcctgggctcaggtgatcctcccacctcctgagtagctgggactacaggtgcctgccaccacgcctggctaattttttgtagagacagggtttcaccatgttgcccaggctggtctcaaactcccaggcttaagtaatccatcctccttgacctcccagagtgctgggattacaggtgtgagctaccgtgcctggcctacgtatgggtttttgtgtgaccataactctctcatttatttgagacaaatgtcaatagtacaactgctggagcatatagtagctgtatgtttaatttttaaagcaaaagccaaaattattttccaaaatggctatacaattttacattcccaccaacaaagtatgaattattcagattcttcacatccttctcatcatttggtgttgccatattttttattttagccattttgataagtgtgtggtgatctctcattgtggctttaatttgcatttccctaaacggctagtgatgttaaacatcttttacttaacatctatataacctcgtcagtgaaatggttggttcttttgtccattttaaaattagattgttttttgctggtgagtcttgagagtcctttatacattctagctatcactcctttgcctgatttgtagtttctctcactctgtaccctgtcttttcatccttttcacaggtcttttgcaaagcagaagtttttaattttgatgaagtcaatttattgacttttccttttacggaccatgcttttgatgtcaagcctaaggacactttgcctaaccctagatcatgaagacttttttctaaaaagttttacagttttacatttacatttaagtctgtgattcatttgaagttaatttttataccaggtgttagacgtaggtcaatgtttaattttttctttttgtgcatgcatgtccaactgctgcaaacctctttgacaccaaccccactgggaggaggagggaccccttgttactcttgggtgggtgtggaaagccagactctccatgtggactctactgaaacccagagtgagaggtggctccttactggtcaggggatatgaaaagctcagctccatccttggcctcctctgacaccatcttggcaagggatactgtgttgcgtcattgcagccacatgagtgtagaagtctgggctccacacttgacctttgctggcacgagtggagttgtagccagttttgtttgtttgtttgttttcccctgtggtatttggctggtctagtgtggttattgtttaaaaaattttttgtcttcctattctgcctcttttttggtcttttggctttagaaggcaggcttttgttgaggcttcctttgtctgtgtccattggcattttcagattgctggcttcctcaactctgggatatacgagacaaaaagaacacccagggaacttatggccatgctgttccttacatcctgaggtccctacctagtctgttcttctctccaactttcagaatctttttgggtttgttttatatggaatattcaggggttttagttgtgtttttctagaagtatagggacaaatatgtgtattccatctcctcaaaagtggatttccccaagttagatttttaagtaaaacttgatggtctagaaaacacgtgatgtttattctggcaggcaattattattttaatatgctcttcaaagtccatagcacaagtctatagcgaagacagatgcatcaataaattacagaattttaatgttgatgattaaattaagagaaaaaaactggtctttatcagttgtataatctgcctgtataatgacacctagtggagagaatgtaaatgatactatgtttctctctgacttcatattcctctacatttgtagtacagtgtttctcatgcagttggttttattgacatctccagctcacctggctgcatgacaaagccatggtctttttgacctgcaagcttctgacaggctacaaatatttattgaatgcaccacagggtagagacttttgctgggtgcttagcagactagcaggagccggtgtactatggccctcagcctccccagggcaaggactgtcagagagctaaagggtgtacaggtattttaggttagaagaaaatgccccggaaatgcctttcttcaacaaagttcttttgaagcttggtttgagtattatcttaagaaaataaaaataagtacactcaccttaattgatgaggaatctctctttgacatggaaatgaaagagaaaaaagagtaatgcctcagttttgtgggctctgtgacaaaacctgagttttcccatgaggttcttccataagaaggggacctatgtctttttcatgcatgtgtcccaagtgcctaccatgatgcctggcacagagtaagggccgaaatccatctatgtcacgctgaatgaaccatgtattaaacgaatcatgtattaaaccctgtgtagaccttgaaaagagagttccagggaactgtattttgtaaatccaaaagaataattaaatctttaaaaaaataaaaagataaaaagaaaagaaggaaagtcaagatacagaaaccaaagaccattaagaccagtaagtttcataagataatcataggactgtggcagctccgcagatacaagttagagtgatcaaaagaaaaataggccctcaaaaaaatggaagacctagagatccttgaccaaactttagtcaagctcctctgagccctctttgcgtcgatgttgactttgctctgccacctccacaacccattccccttgcagggcttgcacagatcacttttagcaagaatcttgctaagccagtttagagggaatcctctaaccctcactatccaatcaccctcaatagctgatcaaatttctcatcccgcaccacctcaaccataatatctgttcactctggcttgtcttcagcaggaatcctgttaggttagtttagcaagaatccccctatcgttggtgtttcctctcaataattttccatacactgactgtgctttccacccagtgtctctaaatctccacttgttcttgttgcattcagagttgagcccaatctctcttccctattgcgatagtcttgacattgttttaacaagtaccgggataatttttttgtttactagtggactagagaggcttcctctttcctccatccctctcttattatatttctttcttttacctctaatagttagaaaaactgaagagataagcatctctctcatcaacaggcagaactgctccttgttccccatagatctttccttttagctgcatatcacataaaaccctacctgttgtgtcaggaagaatgtggtgctaagtactctcaagcacacagattttagaggcttcttcattcttcctgactttttaggattcttttgcactgctgggaagatggaattgggaagtacatttttatacttaaaaggtctgtatcctgggttagactccaaagggggtgcaagaataatcacattgaaagaggcaaggtggggaggggtgtgttaggtacttcttttattttcctggaagccagaaagcagccagaggctggcatcttgctgcgatatagaaacggtttgaaaagggatgtcctcttaccctttccttgctgttatgtaagttaaactaaaattggggcacctgggatttgctgcacctttccattccctttggttttcttcagtggtgaccaaacactccagtgaagtttgacattcctaacttttctgagacaactcccatgctattcaagatggctaactcagctcacttatattgggcaatatcttgctgatgactgaggtgataaatatagaagtagagaaatgagatggagtttctccagtgtctgcttgcctagttgtaaaaggtgttgttgactacagaatttttctgctggaaaagacctttgatatcaactaggtcagttccttccttttttatagatgggaaaaagaattttagagaggtgaaacaatataacttagatttcccagcagttaaaggctggaatgatttaagaatctgtaacttcttactcaggattttcttcccatcggtgtacataaagctcctgagttcacttgctgcagccttttaagtggcagtcttgggatatgatctgtggatggaaattaggaatatccttttttttttttgacagagtctcgctctgttgccaggctggagtgcagtggcgcaatctcggctcactgcaacttccgcctcccgggttcaagcgattctcctgcctcagcctcccaagtagctgggactataggcacgcaccaccacgcccggctaatttttgtatttctagtagagacagcatttcaccatgttggccaggatggtctcaatctcttgacctcatgttcttcctaccttggcctcccaaagtgctgaaatatcttttactagatatagcccctagaacactatgctgactttggcctagaaggaacagtgcttaacatataagttaccagaaatgccttgcaaaggccatcctgttttcagtcagactcacttggcagagcatgagtgagatttttttttactttatagatgaataggctacatctgaaatgtggaatattaaagcttaagtccaacaccgatcattcaatagagagataaatgcaagcagacaaagaaggccacagagagtgcttggccccaccttaggggatatctcccacctgccttttctcttcaaagcctgctgcttaatcagctggggtgtgagcagtagagggattcagaatgaaaaacaatggagagctgcaaggggctcagcagccaagataaaaacagacagatgtttatgcaatgggacatgaaattcaacacatatgaaacgtacaataagcagatagaaatttaatatacctgccaaatgtcacctcttcacctcaagtgtaaattcccatcatttaacagatcttaactgttctgtatagctcagatcaagagaaaagaggcccaatcacttataatactgatatataggtatatcacattaagaaaaatctccatggtgttttgtggtagtcacctttaccttctcttgcacttatttcattcactcatttattcatccatccattctttcattcattttaaatccaactttccaggtattgtagcctataggaacttgaaaatatttcttgagtaaagaaacagatgaatgtaatttcatttatttctcatgataacaatctgatcaagtagatactattcttctattgcagatgggaaaattaaagctgtgagattttgtcacttgcctaaggtcaggaatcatattcaagtctatctctctatctctgtcacccaagcgttacacacattgcatgaatgcctttatatttctgaaatcctggggaggatagaaatagaaagtagtaggttggaaagtaagtggtaatagtctccttacaaaggctagcttcatttttctatgaatgagatccctaatgtgtatattatgaaaaagtctaagtaagaggacaatagttctgcaaaataccaagcagaggaacaagggcctctgctaatcagttcctgaaacttgcctggggcttgcagctggaaagaaggaaaagattgcatcccaaggcacaaaatgacttactgcagatggtttcagatatttcctaggttgggaaacttaagagaaaaataaaatattaaggtgagggttgaactaggacattaaacaatgctcaatagctttgggcaatccctcgacacttgcttccatacttcttacttgcaagcaacctttccctttctaccactttagcctattgtttattacgtacctttgcttctatattgttgctgccttctgaaataaaatgtttcagtccagagatcatagaacttctggagtaacaggacccatctctcagtgatttcctctttatcacttttccagaggtagctccattaccacccctgattccttccggatacttttaaaacttacttttacttttactttttcctactctcagaaactgcataactcatatcttttatttttcagcatccctaaaggtcattatatatttaaatattttccaatttattccatcccttcccattttgcatcaaacactcttttaaattaatgaccttttttttttttcaagttcataactactaaatatctgaaaacacgctttggaggaatatagcacccccagtagggagatgggttaatttggtgccttttagatactcaaaatggaatgggattttcttcactttttccatttttacaatttgcttgaaaaattataaaacactttattgagcatagtacattaaccttgcaaatatgctagtaaatctgctgcctcaccaacttccataaatataaaaattatctctgtccttcagaaagattttaattacatactattattttctgaaagcacctcctgtttcaaattgaaacagtccttaaaatgcaagtacccttcagttaaagttccatgagaagcagagcagaaatcggggccagtgctgtggctgtgggcaggggtcaggtcaggttcaactgcacatttttatctactgacctctctggccctctgatccttcaggtcactggccattgcttcttactgggggacaaagaaggatttttatttttccagtgccattaagaccctgggtctattagtagcttcttacgtagggagattactagcacatatctaggataagaccacattattccaaatgatgcaaaggttatggattattcttcttggcctggataaaaaatagccaagggaaatgaaatgtacaagatttctcccaaagctgagaaatgaatgatgttatctgttatgatatttacatgttctttcagtaaaacaaatccagattcaatcattcaggcaacactttctgaaatcatgataacctcttagaatagcctgctaaattttgaggtgggagaagggggcattttgttatctctctggccaagactgttacctacatcagtctctcactggcatggctgtgatggaaagcacaggaaccagccccacagtcagcccaattattctggccctgactatggctttggctgagtgatgatgaactgcaactctcagtggctgctttgctcagagtaaatccctcgatagcttcatttttagattagggacaaaatcttaaagaacaggtttttttttttttttttgtccctgcttcatggtacttatagctcagagagatgggaggtactcttaactgtctcaaaaagactttggaatgagttaaatttggccagatcagataatgctatcatttatgtagcgttttctgtgtgccaacctttgtgctaaattccttacatgtatttttctcatttaatcttgtaacaatcctatgaaatagaggctaaatgattgcctgaggctacaaaactggcatagggaaaactcagacctaatggactcacacctctaatcttaacactatctacaatatctcttgggagatggactaagagagatgaaatttctgctctagaagagttgatgcttctctacttcctgtagggcagaccacacagcacttgaaaaattatgcttcctccctccccactcctcacccccactgtcctgccggatattgggttgtcaataggacattctaaatttagcttcctgaatctagaaattaaatgacaacatgatccattcagagtcctgtttctataggcctgggcttttttggccctaagggcaaaagagttgcaggtgacgtttcttgtgcttgccagactcatgaatgcatagtctaggaagatttaataactagatagcttctcaactagttaaagcagcttaatcataccagctgagaaagagggtataagtgccttacatcaggcccaggcttctgctggccaacactttgttttcactgtaattctagaggtcaggtttgggttgagcatgtatgtgcataggtaaacgtggtgtgtatgtataaatgagtgtgaatgggggtctggggtgtgaacattatcatctcttgcttgtttctttcttttctgcatatgaaactgtgacaaaacaggttatttatttatttatttttgagacggagtcttgctctgtcacttaggctggagtgcagtggcgcgatcttggctcactgcaacctctgtctcccgggttcaagtgattctcttgcctcagcctcccgagtagctgggattacaggcaggcaccaccatgtctgactaatttttgtatttttagtagagacggggtttcaccatgttggccaggctgctctcaaacgcctgacctcaggtgatccactcactttggcaaagtgctaggattacaggcgtgagccacccaccgtgcccagccctttgactactttagataccaatataactgaagtagcatttgtcattttgtgactggctaatttcatttagcataacatcctcaagctccaaccatcttgtaacttagaatttccttccttgtcagtaactgaataatattctcttgcatatataccacatttttcttatcctttcaatgaatatttagggtgtttctacctcctggctattacaaataatgttgcaataaacatggcagtagagatatctcttaaagatcctgatttcaattcttttgtataaatactcagaagtgagatcactggatcatatgataactcttaatttttacattgttttgaggaacctctttactggtttccatactggctgcaccattttactttcccaccaacagtgcacaagttttctaacttctctacatcctatccaacacttgttattttctattttttcctctctctctctctttttttaatatgaccattccaacaagtgtgggacaatgtttcattttggttttgatttgcattttcctaattattggtgatgttgaacatcttacatatacctgttggcttcttgtatgtcttcttcagagaaatgtctattccagttctttgcccatttcttagatcaggttttttgttattgagttcaatattcttcaatttgtgaaggcttgtttgtgacatattatgggatttatcctggacaatggttcatgtgcacttgaaaagaatgtgtattctgttgctgttgggtggggtattctgtatatgtctgttaggtccatttgggcaatagtgtctttcaaatcctctgttttcttattcatcttgtatatggatgttctatccattattttaagtggagtattgaaatgccctactattactgcattgctgtctatttctcccttttgttctatcaatatttgcttcatatttttgggttctctgatgttgggtgcatatatatatatatattaattgttatatcttcctggtgaattgacagttttatcattatataatgttcttctttgtctcttttgacagtttttgatttaaagtctattttgactaatataaatatggccactcctgctctctttcagttactattttcatggaatatctttttccatcctttcactttcagcctgtatgtgtccttaaatctaaagtaaatgttttgttgatagcatatagttagatctcatttttctatccattcagtcattctatattttttgagtggtgaatttaattaattaactttcaagtaattattgataatgaactatcaccattttgcccattgttttctgccttgtagctcttttatccttcatttcttcttgttgttttcctttatgtttcattgatcttgtagtgacatgcattgattcttttctcattttcctttgtgtatcttctagagatattttctttgtgcctacaaaaagcatcttataacaatctattttaagctgacaattctattgcatacaaattctccatactttcatttctcccctccacacatacgcatgttattgatgccacaaattatatccttttatagcattattcattaatgtatttttataattataattattcttatacattttaacttctatcagaataaaaagtgatttatgtactgccattgcagtattacagtattctgtatttattaatatatttacccttaccagtgagctttatactttcatatgctttgatgttgtcatatggcattctcttacttaaacttcaactaatttgaagtttttagctttcttataaggtaggtctagcactgctgaactcccttaatttttgtttatatgcaatgtccttatttctgtttaatttttaaggaatatttctgctgaatatagtattctttactgataggatttttttctgttagtacttcacataggtcatctcacactcttctagcttgcaaggttattgtcaagaaatctgctaataatcttatgattactcccttgtatgtgatatattgcatttctcttgctcctttcaaaattttatctgtttctgacttttggcaatttgcttataaaatgccttggtgtgaatttttgtttgtaaaatactgcagtgtgaatttctttgaatttatcttagttgaagttcattgggcttcttgaatctggatgctgattttttcctccagacttggggagttttcattcattatttcttttaacaagctttttgcttccttctctcctccttctggaatttccataatgcctatattgcttgatgaagtcccataagtgccttaggttttctttacttttttagttccttgttttctttttgttcttctgactagatcttttcaaataacctgtctttgagttcatggattctttcttctgcctggtcaaatctactattgactatctctaatgaatatttcagttcagagcattctccagctccaaaatttgtttggttttcaaatatatatatttctatctctttgtcaacattctcattttgttcatcattattattttgaactcatagaacattttcatgatgcttattttgaattctttgtcaggtgattcatatacttccatttttaaattattaatttctgaagatttatattgtttctttccttgggccatgttttcttgtttctctgtgtgtcttacaactttttatttgggtccacacatttgaaaagacagccatcttacccagtctctatagacttgcttttactggggaagatcctcacccatcagtcaggctgggggttaagggtgcctctgaaatcttttggggaagatgccacttctctgtgcttgtgagtttaatttctcatgtgaagaggagagaggtatgctggtttcttttgcaggagtttataatctcttcctccatctggtgtctgttggtggcactgcaagttccctggttttatagcagcagactaccaagctctccctttttcttagtagctaccaaacatccaaagtatgctgactttctgccagcactgtgagtgaggcattatacctatcaattcctcaggaaaccctctgaaaacttgaacactgaacacacactctgttactctctcttaaaagagaagcctcaaattgtgttctctttcctgactacaaaagctgtagcaagctgcctctttccatgcttctgtgttctcagttgcccaagacactcaaacaaggccagttctgttaacactctaggtgagatgagacagaaaccaatcatttgggcagcctccaaagagccagattgttggactcacattccacttttccttttccccttgatgaagaaattgcgagccagtgtgttctcttctgggggttctgagttgtgttggcttgtggcaaaggctgatgcatataaaatgaaattcttcttcttgaccatttgagtgcatctatttttggctttgtgctcacctatggtggtgcaacttcttaactggattctggatttctcataaagatattttggtgcatatattgttaaatcagtgtttctgtggaagacaaggactggtacttcctattttgctatcttgttgatatcactcctatgtaagtcttaatttagataatctatgtgagatgcttaacatatttttgatatatagtatctgcttagtatatcctattggctaattactattatcacaatcatcttctcctttaaagaaaatgtatatcattcctgaatacactacacttccattttttttattgtctctcctacctggaatgacttttccttccttttttgcccagtgaactcctacttagatttctagaacaagcctgaatttcacctgcattgtgagttaccagagaattactcccccttctaaaatattcatagcacttttttcatttttatattagcattcatataacattgtattataataggtttttatcattatgtgtctccaaacattttaaggagaggagcactacataaatttatctgtttctattcatgatgcctatttttttttcttttcgtccagtatctagcaaggccatcagtataaagggcttattaaatgtttactgagtgaattgtgtagagcagttttgcaactttaacttgaattcctaggaacctgatcctaattcacattagcaaagatactaaagttttgaattttttagtttgtttgttttttctaatctggactttttgactttaactaaaatttttagctggagtgaaatggtaagctccttgcccttttaaatcaccatttgtgcagccttattctaattaccttaggcctcttccattgtggccatctaatcttctttatttggatcagaagttcatcaatacatatagtttcccttttcatcgtctcttctggttcttctgtgtttcttctacttatgtctttcattaaattttacaattgccaatggacttattttataggcctctaggaaaacagtgaatacatagggtcacagagagaatgtttgattggaagggaccttaaatattgtccaaatgttgccttcatatttaccagagggatagagaaacttgtctaaaatcacttggacatttagagacagagaagacattgcctcattatatgtttaaaagggaagccacttttgaaagattatttccttttacataagataggctgataaagtagggagaaagtttgttgtcctgcagaattctttgagttttttaggaaggcattacagggaaatacaatatgcttaaaaatacctacattaaaaattatgcttaaataaatgtcgggtcaaattggggataatcagaagcccattttatttgagtctttgcaactaaagtcctcctaaacatagggtcctacttctcccttagtactacagtgcacttagatccaggctagaaaatcccctacactttgacaggccctgctctggcctttctcttgctatgctctttcttataagaaattcatgagaccattgggacattccctcccacagccaatacccactccacaatacattctagaccatgttctaggtatatgagactccaaaattccctgcctgtggggctcatagtctgctccttggttctgcctgggtttccttccaagtccactctttgaggggtaggccatatcccaggtatgtgtgtgttcctaggcctggggggtgaacaagggggagctatttttggagagtgtagagggagcttggacacatgggctacggtgtccacacatgtgttcacaaagcttcttgtgctgtgggacaaagtcaaatgtaaaaagaggagagggatcactacaagccagggttcagaattcagctgttaacactaccactttctggcacagaactcaaaggtattcaagaattataaattcaaacctgacttctatgccattttggaataattttataagttagaagatagaattttttaagcttgatttgtagttttaaagtatgaggcagttaaatgatgggcctccatttgcaattttgctccaagattcacaaatgttatagaaggccctatctgtcttggtaatattaagtattataaaaatactatatttgatattgcaaactgtataacaataaaattatttgagaatgatggatcagaggcattgcaaaaatttttggagtgtaactaatatgaactgaccctgaaacacattttgaaagttctttgaattaaacactgagttattggcttatttattaaaatttcatttttaattctaaaagtggaatgccactgattgagtgttccagttaattgggtcaattaacctttttctgaataatattatttattaatgcatagaatatgttgacatgcctagtgcagaaaaacaggaatatgatggactgaataaatggaatgggtttaataaggcaaaccaaaattgtaaaatagcatttaaccttgctatttgggagagaacttcagatccaaagggaaaaacaatgaaagagaattgaagaacattaatgatgattacatgtgatagaaagaaacagtaacagagaaggataacagtacatcctagagagcattaaaaagaaaaaaaaacatgtaagggagtttgctaaactgttatgtgagatgtatgaagaagtacagaaaacaggtgtctggagatgggcacatgctgcctccatgatcataaagggaacctctgtcttaattctgggcacggcacttaaagaacagtctggacacatggggcaaagctagatgagagtgaatggaatggtaacatgtctgatatctctcatacagagggattaagggaactcattggaacaagtgctgccttcaaatacctgaaagactgccacatgcaaggggattgaactttgtagtcttagagaacataagaacagaggacaggaaatcacacggaaatggttttgaaccaacatatacataaacatttttctagcactgagagctcaccaataaagtgtcatgagaacagataaaatttttgccgtgttcacagttggatcgccagtgcaattgttctcaaacatggatgaacatctggtggagccttttgaaaaaataggcacactcagcttccctcatgagaaattcagatttgggagtcctgtgggggtgtgctcctctggagtcctgaaatgctccacaaggatgcagacgtgcatcaggagttgagaaccacagtcctactgtgaaatacaggacctggcaaatgctaaaggcttattaatttcttgattctagacctttgaatttgttctctctgtcaagaacattattccccaggcttctgaaagttttactccctcacttcacttggtctaaaataggaccatctcccatctcttcttgacttttctttctcttttttgtactcattctttatctaaaattctattcatctatctgataattggtctccttgccactacaatataggctccataagcacagtaactttgtcttattcttcgctgcatattcagtgtttagaatgaagtctgaaaaataataaatgcttaagaaacatttgttgaattaatgagaagataaatgtatgaatgactgcttatttgttgactgtttgactgacaaattgaatggtactcttctttatgggaaatatattcaaccccacgcttgctgaccaagcaacggtgctttgggagaaatcacacatcataaaggacattgatctcaaaagtttcccagccacaaagaatagatagggcatggtgaaaaaagaagatgaggagagacttggcataaaagacagcagaattaagaaggaactagagagcaatggagtgaaacagcctgctgagaagctggctatggcagctgacttgttgaaatattcaccacactctgaaataacagatgttcattgagggatctgtgagagcatttgtaatctgcagctttctatgcctcctcctcctacctgcctcccacacacagcagcttgctgcctggcctggccatctattcccagaaagcccttcttctttccaaaagaaagagacaaccccaccccacataaccatggttatgtattattttatttttgatggaaaggttctgcattcctccttttcttaactctttggcgtcctatctcctcctctggtactcctgcccttgctcactctgcttcggccacattggacttcctgctcttctttaaacatgccgggcatatgctcacttcagggctttgcacaggctgtacgtgctgccaggaaaggcctttctccagaaggccgcctggccccttcgtcccctccatacactcccgctgcttcaagtctttgctcaaatctcaccctcttctaaagtctgactttgacaacaccatttaaagagcaaccttgctccagccacatacctcgagaccattactatgctctacatttttcatttctccaaggaattgttacttgataagcatacttttaaatttcatttactgtgcctaattgattatctgccttcccacaataactgctagaatgtttatgagggcagtgaaaaattttcgttttgtttaaaattgcaatccccatgcacagaaaagtgcctagcatatagtatatgctcaacaaaatttgctgaataacaaaatgaataagtgatatatcaaaattaaataaaaccaagaagaaattcattaaataacactaattcaaatgaaaaaacctgggaatctctggtctttttactttttactttagcttcccctttcccccttagctttcgcctttacttctcatatttgcttctcttctttaatgattaatttattcaaaaggctcttatttaaaaccactgttcatagaacatctcactgagcttgtgaaggcggcaaaagtaaaagaagacagtgcctagtagttcacaatgtggatatgaagagaagacattgataaaaatgtctccttctcaaagactgtgggttataaaaaaggcttacaccgtatttcctttgctaaaatgtaaatgtgagaaacaaaatagctttaatggcttaatggaagtcagagatttgggggagaagatgagaacttcctttaaaatgttaagtgcatattgtgaatctctagagatgttttataggatttgttgatttatttcccagtgaaatgatccctggcaggaaagactgcagagtcctgcagagtgcagggggtgaggaggggctgtaaaggaaaagggtgagagaaagaagagcataaatcaagaatgttgaggaaacttaaccccaaggtgtgggaattatattctgtaaccgtggatcccaggtcacaggccagtgaaaggaaattgagagaaaatgggaattctgagggaatgttaaggtattttcatttgaaatgctaagggcgtagggaagaagaccagtttcataaatgttgggatgtcaagataccttcttttttctatgtgacttatggcttatcatgcaggttttttgtttgtttttttttttttttttgcttgttttatggggctagttaggtagcgcttagctgtaataatattctatgtgaatattggctgattaatgtgggccctaaatattactagatagaggggtgtccctagagcctaccaggaaagcatcttggtcttttagtgcatcaaatgaggaaaataaatgcaattgattaactctgcaatgaagagtagaaagataggaagactagtcaaaacaaaaaacaaataagaaaacaaaataaaactccaaactaacaaaacaaaaccccaccttaatcctaaagagccaggagcagaggcatagatatttcaagaggcaggaaatgtctgaaaggattggtgagaactataaatctaggcaaggttagaaggtcacatggaattctacttgtgacactactttgatcctcaattctcaaataggtgatatttcaacaaattgaatatcctgtacataagtggagaaaataaaaaaaattcccttctttagtttcttggtggtagctctaaagacaaaaaactttcttgatctactgagcaggcaggtgaaaatacacatcaaacagggagaatatggtttctaaaatttgttggcagcaagttgctcattaaacaagtgtctaaccttagctaaataaattttacctgttgaataggtggattgtaaattcctttcctactcataaatgctataaaattctaaatatatttataaagaaaaacaatgtaatgaaggcataaaagagcccctcctgagattcacagggctagttctaataaaagtggcaaatttcaaaataacttgaaaggactgagacattcccttctaccatgcaccctctagcttcttggagttctactctttgtttcaatcttttgtgattaagcatagttctattttagtgaccaccttaaaaactctagcaaaacttctggaagagacagtgactgacagataatagatacatacaataaatgtttattatccagatctataaatttagcagaagttttttttttttttttttttttttgacacagcagataggtcttgtgaagtattgaagcctatgggcagagaattagactggggaaaggattagctatataaccagtgactttgggtggaactctataccagctccatctgttttacagttggttctgatgccataaagaagggcaatggtatgctcttctcagcacattgaattaccaaaataacctccttcaacaaaattacagatttatttttgagagtcagaatgtaactttttaacctgtagatccacggctaaaagaaaataataaacacccaataagcatgtattatgggccaggcacagggttaggtactttcacttttattatctgagcccctccttgaggagggatagtaggaaattcaacagtaacaatatgactatgaggtggctaacgtggctaatttgctactagggaaaggagaataagttttcttagctaggttagtctcctactcagtatattcctagggaaatcaggctgggaaacccagtacacagtaagtagaaagaagaggtatatggctgaagaaaatccactccaaccaaatgagactagcattaattattatcacttcttaacttctggatcatccaacagcctacaatccaaatgaaacatgcacctgtataaatctttagatttgaacgactttaaagtgcagtaaagcacttcgttagtggtcaaatgctaacctttgcatttttcactttgggagatgagaggagattaacagcaatttgggtctttagaggttcctctgcctaacaccctgacaccacagggcttcccaggcttgtttggtggagatcatctggtcttccttgggatgaggatctaagcctgaaaatcttaatggcatatttacttttattttttctatcacattttataaaaacaagataaaaattacataaattgtttgaaaagaaatactcgtaaattgaagccagtcctaggtttgttaatgaacacttctatttttacagaaaatgtcataaggtcattgttgactgcagatgataagcaacccaattgggtgtttattctaaatatatcactgccagtgtaacccttggcagcaccccacttcctccttccacccgggatttcccaccagatggggagagagctcattactaacccagaggagagaactgacgccaacacccacagcagcagttcagtcaaccccttcattactcttccttctgcctaaaatcccagcagcctctggtgaaaaccttggccatagaatgctgtaaatctcaggatccctcactaacgcttcacttttcatggaggtcatgactaagttgagaaagactttctttgcctgcccccagctgagtgacctgctttctcagcagcatgatttctctaatgagattgttccacaaagagaagaatgaaatcaagtgtcagggggttggatcaaagtggctcttattctctgaggcacagggtcagactgcaggtacaaatgagccgttgggtcagagagggtcctgtttagagcgtgtctccacccccatcatgtctcttctttctccttgtcatgacctatctttaaaactatggaaaagatctctcatgcaaatgtttaaattgatttcaggaaagatgcatggaatatctaatatgtatagctattctttggagcacttagctcatcatatatacattcctatcacagtcatcctgtacaccttatcttattaacagtaatcccatgaggtagactgttacttttctaagtttattgaagagaaaactgtgactcagaaatgttgagtaactgtctccaaaacaaaggacgagtaaatagcagaagggagatttttacccagtttttaatctgtcttcaaaatatataagcccaaccctctgatacagcaaacaatagatacctagcattgagctgggcgatgtgggggattcaaagatgaaacaggccatgttatggactcaagcagtttacagtgtaattgttgagacagacattaatgtaaattatatattaaaaaagagagaatgtgaaaagtgttatgccatggtaggagtacaaaaaaatgctttgataacattaaggttagagtaagatgataataaaatagctatcatttattacattattttaaacctgacaagaacttataagaaagatacaatgactgttcccatattatagatactgaacttgtgtcttactccaaatcattaagaaaatgggagaaaggaaatttggacttttgtcttctgaccacagaacctgtgcttttaacttttacattacactaattcattgtcagtgaaagaaactattttgtagagaaattgtaattttagttaggcatgaatggatactttttaaaaaaataaaaacgttttctggtgagaaaggggagtatgtcattccaggtagtggaaaaaatgtgtgcagaggtacagagggataggatagcaaggtggattccagaatcacagaatagacaatgatgtgaagagaagagaaacagtccattgctaaagctaaagctgaaaagatgatcacatagattttttggcatgtatagtataacttatacattacagaaatcataaagtagtcaatttgaaggaagaattataacccatggaatggttctcttgactatctctagttattctttttttactagtcttttccaacatggtagtcattttaaaaaatgatatgtatctaatgacttcatttagtggagaaatattattcaattattattcaattgttttccaattcctaatgatgttcaagtaactcaataaataagagagtaatggccaaggaatatagaatccaaatgaagagaatgcactgtcagaaacatctcttcctgctgaacagtgggtacgcagtggaaagaggtggtgacttgggtgttagaggagggaagcgaaactgaactagctcttgagcatcaactcataatgtttcagggggaagaaagagaaaataaagtggggaaatggaataagcgaagtgagagctagcagtcaaggaaggtcggagcatagacctcgcgaaagggagtggtttcactcgacaagtatggagagaccctgttgtggtcaggaatgtcaagcttttaaaaaggcattgggagcccattgaaggttgttcataggatagtgacaataggagaccagcaaagcattagaaaaacgttactctacagtggtgattttgaatggttcaagaggggagatactggagatttgaaagactggttggaagcctacagcatttgctcaggtaagtggtaataatagtgacaatgcaaaggatgaatgggttgagagatgttacagagcaaagatccacaggctttgtgaatgactaaatttagggaataaagaagaaaaaaatcaacttaatgctggatgagtagaggaaaaattattaacattaagagaaactagttgtcacaaaattagaagttctattggccatgttgaaattgagacccgtaacatgagcaggcaccaaataacatggccagcaggcagaaatacttatatctagagctcagaacatcctgttgttaagccctggtctgcataggcataggagcacccctggaagagtgtgcagagaaaagatcagcggcagaaacgtaaggagtatctccatactgtggtgacaagaaaatgatcagccatctaaggaaacagtagaaccttagtaagatgttattgaaacaaacagaggagagtcagcagagtcaaagctgcagtgccctccgcgagaatgtgcctgttggtgttgtcagtcttctgggaaggaaatactatagaagagtgtttgggatagaagtcagcaggttagacttaacagggaacaagggggcagaagcaataaatgtaattcattcttttaaaaatgttggcattaaaaggaaaggaggattggctagtgacttgaggaaatagcactgataaagaaaagtttttgctatggaaaacataattctatcaatgtgttttgatagggaccttgcaactcaaaagcttaagtttatttaccttaaaataatttcctcaaatggtttctcaaatgtatagttgatgtggtgttttattttttatttttattttattattttattttatttttttttcagtcagagtgtcactctgtcacccaggctggagtgcagtggtgccatcttggctcactgcaacctccgcctccctagttcaagcaattctcaagcctccgcctcccaataggttggattacaggcgcccgccaccatgcccggctaatttttgtatttttagtagagatggatttcactacgttggccagggtggtcttgaactcctgacctcaagcaatccacctgcctcggcctcccaaagtgctagaattacaggtgtgagccactgtgctcagtcctgtagttgatatggtgttttaaaagtgttatggggctgaagaaaaatcttatgtaaaatacatatatactatattttatttgaacctctggatcatgataaaatggacactgtattatgtaagatagcagtacttgatgaactaatggtttgagtagatagaacatgtgttttgacattaaatgagaaaatttattttcttttctacacagattgcttatatcagcttcactccatatgtagaagaatgattctgggtttgtgactgaccagatttgaagcctagggaaaattaattgacttttctgggcctctgtgtcattttctaacaatcaaagtttcagacttgaaaagttcttaggcatattacatctaggaaatgttatgtatcttcccttccttgctctagctctattttggggaagattttaaaaacactgtgtacaagtgatgagtaagattagaatactggtcaagcttcaagaaaaagtttcaaaattgagtactaaattatttattgggaaataaaggaagggcatgaatgagacctaatataaacaaacaaacaaaaacaaaaacaaaaaacaaaaaaaacctcaccaaataatgagaaaaaaaaaggtgagataatgatggcttctgaaatgttaaatataatctggaacaagaaaatgaaagaaaaaggtaactcaaggaataaaatatgaaaggaaggaaatagaggggatagaggtagtaaagttcatttcgtacaggcagttttgtactgtgctcagttttagatggaaggaagacttgatcctgaggatgatgaatgaacttgagggatcagaagccctgagggatgacttctctgctttctgaaagaggtgtggccgggtggggggataaagaggctcttgagagagtcaagtggaatgaactacagacaatggcaaaccacaatcttgcctttatggtccttgaggacagtggacagagcctgagtgctgtgcttcacacgctgctcgtcccagcagaatggaagtccactaggtatcggaggctctgctatttactactgagttatctcatcctgttctctattctcctgggaaatgatttaaaagtcttatcttacgagagttgattgggtagccactgccttatttctttctgggtttgagatatacctctgcaccttttgtcttttagatgaaaagaaactctcatctcagagtggcaggatgggggtatgtcttcagggaagcagaaaaggaagagacaaaaatttttcacatcatgacaattccaagaaatagcaaaatgttttagtgtctgtaaaatctagcaaggtgtcatgacacttcttggctgtaaatagcactctttcagaacctggaacgtaatttgaagcgtcctgccaatctcttccctttccttcccaccacacatgctgtaatacctgtcccaggcaatactgtcagctgtgactttatgatctgaccacacttctgctattttggtattaaattggatttgaacttgggtctcaattcaattcagttcagttaacatttcttgaacacccataagccaaggtcattaacctctataagtgacatccaaacctctctaaacaagcaaatcaatctggaagtccgagagaaccacactttcttacaacatttccagtatctttcagtgttttcctacttaaagtatctcaggtttgctttagcgagtcagtattctttggtagctagaatagctaagggactagatttcatgtggatctttatttgagtagggagagtgtatcctgccaaatattctgtaggtcgtatttaaattgttagtaaagactagcatggatttgggttgctgcccctgacacttcagaaattcagaacaaaataaatcctcagcttgattgcttcatgcttttattaatttggtgtgctttttctttaactatttattaatccattctgaaaatgcagacagagtgaggtgtcataaaaagagaatcctggattggccatataatgattgtgggactctgggagtaatgctagaaggttatttttacttggacctttcagggaggtgacaaagacctatcactattcctgagttaaggaggaaaagtgagacatttaggtgataagagaagtagcaatctaaaaaaaattagcctttgggaacctggagggaatttttaagtcaaggaagaagtcatgtccaaagttcattttttcaactcattcattaaacatttttagattaaggtcctgcaatattctgggcacagttgtgggtgctggaaatacatataatggagcaaagagcagagtagccacactaaagtcagcaaaagtaagagaattctgactctaggaagtttggggaaatgcacagactagatctgagtaacttcagatttagatagagctgcaattaatagtagttttcatttagttaagtgcataagctatattaaatattttaattactttaaaattgtctttacattgtactatattgctttcatatactcatgaattataataaagttaccattaaaattgtagtattctttaagatttatatgttgcatcgcaaggtcctattaaaaaatacattgtttagatcacaaagtataatttaacctgaaaacatgtgctctatctgtccaactatctactttttatgttttatataaaaaatttttctttgaagagaacctaccatttaatcgaccaaaccattaacagcagcacctagtgtcagcttctagaatttcaggcacaatgaataaaggatatagtcaatgcaataagattttatatggattgtagtttaaaaaatcaaaacatggtggcatagaaatgtaatgtcttggccaggcatggtagctcatacctgtaatctcagcatgttgggatgctgaggtgagaggattgcttgagcccaggagttcaagaccagcctgggcaacaaagtgacactctatctttataaaaaatcaaaaaaatagccaaacatggtagtgcacacccatggtcccagctactagggaggctgaggtgggaggattgcttgagcccaggagttggaggctacagtgagccatgattgcaccactgtactccagcctggcgatagagtgagaccctgtctaaataagaaaagaaaaaaaaaaaagaaatgttttgcattatgtaaaaattttaaatacagtggttcatctctttacacatgctaacttaacaaacatactattcctttgttaaaagggaagcccgcagcatgctaaatgatattggctaatcctgtatggccagctaaatgatattggctaatcctgtatggccagctacttcttccacagtgaagatgtatacttactatgatctggttgtgtttactatgaaatctctaacagttgtactattaattataattaagtaatttaatttactattgtgtggactgttgaaatatatgtgtggaagaaaaggtttttatttaaactatagtcagtagtttgaaagcattcattaaaggcaagtagcttaaaaagtactcttgtattgaatgtgggcaagacaacagtaaaagaatgaaaacaactaacaatagataaaaacactgcattcatattattttacaaaggtctttagattttcactgcattcaaaaaagtccaaaacagaaaatgaatagataatttattatgagtgtggtttatgagagaaaaatgacccagaactctactgagcagacccatacttgccaaaattaccttgattctaaatcacaaaataaatacatcattgtacactcatttgcctacattgaaataatgaaatgtttgtggaataagttttttattatttccatgtttgaaatgacttttccaacatttaaccatttagtttccccattacattctttctataatgagttccttctttaatgagtatcacctaaagtatttaacaaaaaagtcaagcatcatatttatcagaaataatattttgaataaattgtaaactatgtttacgaccttataacatggaagtacaattttaactaagcaaaataccaatccactccgtctttggtagaattaatcctgaataacatgagttttgatttagaggagttttaagaaaaacttcccatgtataaaattcaggtacgaaagaagatgcataatgcacacaaattaaacaaaatctttttaaatgtagacatgtcaatatagaaggacaagtagtgaatttcagtatgtcaacagttgcagtcatgttgttgcataaggccactgaaacaagcatttgtacacgtcttcattcaaactgaagtgcattttttgtttacataaatatcttcattaaaagacaaggaattcatccatttcagtactatgcctaattttttgttgaatccctagcaccagagagcaggtagttgggaaacgtcagtttattgtaacaataaaggacttgatagtttttattctatgtgtttcattggctttcagatattgggtctatggcttttgaaacatgtaggaacataataacaaagggaatacactttgaccttagaaactggtactgaaagtcataaaatgacttgttacctgtcacaagattagtttattgtatatgagtagaaaagtccaactaataaaaagcaggttctaataaataataaaataaatttaccatcgagatgtaatttttcactgaagctccagtcttagtttccccatcttaagaagattttttattttataataaaaaggggaaaatatataacctgaagtagaacaaaccaagcaggcattgacctcatctagggatgcagcattgtactttattcacaacattagatggcagcctaaagggtaatagtttacttctgtttaaaaaactatttttgtttgatgtagtcctacttgtttatttttgcttctattgcctgtgcttttgatgttatactcaaagactcagtcaagatcagtatcaatgtcaaggagctttttctttatgttctctttctctttctttctttctttctttctttctttctttctttctttctttctttctttctgttaagagacaggctggagtgcagtggtgtgacatagcttgctgcagccttgagactcacttgggctcaagtgatcctcccacttcagcctcccaagtatctgaaactataggcacacactattatacttgattaattattttattttatttttgtagagatggggttcttgctagctcttccaggcttgtcttgaactcctgggctcaaacgatcatcctgctcctcctctcaaagcactgggattacaggccctatgttttcttctaggagttttatggttttgtgtccagcattggttccttctggtgggttcttggtccctctgacttcaagaatgaagccacggaccctcacggtgagtgttacagctcttaaagatggtgtgtccagagttgtttgttcctcctggtgggttcgtggtctcacagacttcaggagtgaagttgcagaccttcgcagtgagtgttacagttcttaatggtggcgcatctggagttgtttgttcctcccggtggtttcgtggtcttgctgacttcaggagtgaagccacagaccttcgcagtgagtgttacacctcttaaagctagtacggacccaaagagtaagcaagatttattgtgaagagcaaaagaacaaagcttccacaggtagaaggggaccctagtgggttgccactgctggctggggtggccagcttttattcccttatttggccccgcccacgtcctactgatgggtccattttacagagtgctgattggtgcatttacagtcctttagctagacagagtgcttattggtgcatttttacagagtgctaattggtgcatttacaatcctttagctagacacagagcgctgattggtgcgtttacaatcctttagctagacacaaaagttctccaagtccccacccgacccagaagctcagctggcttcacctctcagtttcagatattacgtttaaatctttaattattttgagttgatttttgtatatgatataaggcaagggtccaatttcattcttttatacatggatatccaattttaccagcatcatttgttaaagagattttcttttccccagtgtattcttgttgtccttgtcaaagattagttaaccacatatgtttgggtttacttctgggctctctgttttgttgcaccagtctatgtgtctgctttcatgccagtattatgctgttttgattaatatacctttgtaatatttttgattactatagcttcgtaatatagtttgaaatcagggactgtgatacaaagaagctttgttcttctttctcaagatcactttggctattcagggtcttttctagttccatttctttttctctaaaaagcttttgtccataaaagggaataatcaacaagataaataggcaacctacagaatgagagaaaatatttgtaaactatatatcttataaggggttaatattcaaaatatataaggaactcatacaactcaatagcaaaaactcaaatgacccaattaagaaatgagcaaagaacctcctgaatagacattttttccaaagaaaacatacatgtggtcaacaggtatatgaaaacatgttcaacatcactaatcaccagggaaatgtaaatcaaaaccaaactgaaatgtcatctcacacctatgaagatgggtatcctcaaaaaaacagtaagtgtggaaaagggtttggaaaaaagggaaccttgcacaatgtgggaatgtaacttggtatagccattatgaaaaacagtatggaagtttctcaaaaattaaaaacaaaactaccatatgatccagcaatcccacttcttggtatgtatccaaaggaaatgaaattattaccttgaaaagttatctgtaccgccatgttcactgcagcattaacaatcaccaacatatggaaacagcttaaatgtccatcaacagataaatgtatttaaaaattggcgcacacacacacagacacacacacagatacacacacacaatagaatattattcagctaataaaaaagaataacattctgccatttacaacaacatgggtgaaactagacgacattatgctaagtaaaataagccaggcacagaaagacaaatactgtacgttctcacttacatgtggaatctaaataagtagaactcatagaaacagaatagaatggtggttgccaggagctggggcatggataaatgagaagatactgatcaaagaatagaaactttcaaatatgagacaaacaagttctggggatctaatgcacaacttggtggtgatagatatgttaattaatttggttgtgataatcagtatacaatgtataaatacataaaatcaccacattgtataccttgaatatgtataatctttgtcaattagatattttaaaataagaattattttgttttaattatattttttctattaattgtacaattacttgacaattgtttttaaaattttactaaaagaaatatattacaaaggggaatcagtaatctggctagttggctagttaataaaggaaaaagtactagatacatgctataaaaagacaaaaatggaaggagaagttaaggaagcaaaacaaagaaataaatagctttgcaaacaaatgtagtgtctcttttgagttccatcataaatgttgcccagcttcaagtgtgtgtccttgctgatttctcctttatatagaaacctgtatcccttttaaaagtgcaagtatttctcatcaccaacggtcataattcaaaggagcaaaaggtgtctacttgtaaagactttgtcatcagacaaagccagactgtgatgactgggtcagtttctcctctctaagctgataattatctcacactgttacagaaacactgtggagtgaaaaataagtactttaagagactacaaatgtgagaaaagagttcctttctctaaaatttgaactgcaatgtttatagtttcattcacatattttttgctacattttataagcataaacatgatgattccatcatttcatgttttagtatgtactagatatctctgatgtgctaatgttgttaaaatgcatatttccaggtcacatccttagagattctgattcggtaaatctatgggaaagcctaggaatacgtatttttaaagcttgccagtaaattttcatgcaagtgatctgcagaccacatttgggaagctggataaaaacctatcttgaatgtgtaggtttatgtcgacggtgaaaacagaatcatggaagcatccatggctttaacagactgctcacattcaattgtcaacattagtgctttatcagatcaattttataatgtagtagagggagatgagctaggctcaaataaaaacaatacaatgcaataaaaaggtattagtgacttgcatggatgaacaacatacgttaagaagaactcagatgaagaaaaaattattttcagttataaggaaataggacttaaaagatgagcatttatgaggggggcacatttcagtaacaaagaaaactatgaacaaacatcttgaagaaggtttcaccctgtggtacagccaatgagctagttaggcagcagcactggactcgtgtcagagagtactgggaagaaagcctggggaggtcttctgggctgagttactttatgggtctattctcatgtctcctgatttggctctcacttcttttcagaatactttatccagtttggctcttccttgagaccagctagatacatctttcttgggagttggggagctggtagttccttcctctttcatagggaagtcaaaatggacctctcttcctcttcactgaggtgaccaccctcaattagagaataagatagatgctggtttcttactgctctgctcctatagttaggctaatttttcctataatcagggagaccatgagcacatgcctgacaggctatctgttctcaactccctgtgatcttagttccttaaactcctactgagttttcctgtaactaggaggcatctccatgtcctgattaagctattgtcacttaaatgggcatttgcccaagagatgctacttcaccttctgaaatctaatccgaaacaggaactaaactgtacacgtggagatttagaacttcctgctcttcatcagccctcatcactgcctccagagagcctttggtaggaccctgggttatgagtatctcttagaggatactgcttcaccaaaaacacctgaaccagtcctcaaacaagcctttggggaaatccccaactgctttcgaactgcttctctctcaccctctaggaaaatacatcttgtaacaggctgatttagaaacaagtccccagaagctatcctggtggctcaaaatccagggattccttaagaagaaaatgatacataaccaaatccacagatttacaatgcagcattaaaaacaatcattaatgcagttttcccacagtacttaatgaggatgatggctggtggtaatgataaatttctgactgtatactcttgccaggggctctctagggaagaaagctgctgctagctaagacatttagaatttctgctaaactcttctcagtaggaatgtccttgctgatgctgctgaggagatgaaggtctgaaagtgaggtattagctctcattgaaagtaagaacatatcgaccctaggcaattaaagacaatctctttggatacatgcattgttatcaataacatgacagttttgcctatttgaaattcagcctcatgtttcacattgaacctttgggtgactgtcgattgaaatctttaaaggggactacatcagttaagtattagctccctgaaactccatcctcttatagtttaattgttcctgatggaaaaaacaaatggtgggtttgaaagtctccgaggtcctagtgtaacttgttctgccaattctgaaataattttagctaccatttatgcagtaagtgccatttactccattttatggagcaaaactaagtatgctttttactgtggcaaatattttataaattatcttagttattaattgcaattgcactctgtgttagctatcattattcacattttatgaataaagtaattgaggcccaatgagttaagatcctgttcaaggtcacatatcttagaggtggctgagctagaattaaaacccaagaatatctaacaccatagccagagatctttaacctctatggtatagcgcctctctccagtctactgggagggcatccatgttccctctcactgtgcatttgctcagtttatttgtgccacccaaatagtttctctatgtatattcctttccttccccttatctgtctatcaaaaatttatatgttgcttcaaggctgatattaagtaccattttttttctaggaagcttattctaattttttttcctcttctttacatccctctaaccagatatggattccatctttgagtaatctcagtaccttccataaaactcatagggttcttatcttatttgcttagttttcttggctattcaacataaactttcgaattacggctcacataccttcccttatttgctttgtttactttgctatttaacataaactttcaaattatggcttacatacattcccaaaagacaaatcaaatatttcccatagggtaggtgctcacaaatatctatgcaatgtaattcactgaaagcattcctaggattaatctaggtcagagcttggactaaggacttgccctaattaggtattcacatatgggagcctgggattataggtctgtctccgatgtgaaggacagagggttgtgatacgagtttctgggctctacaaggctgcagatattgtaaaggggtgagaaatgggaggtaggagaaagtaaataccaaaggtcacacaactttgaagcttcagggccaccaaactgtaattcagatcaccttcatactcctgcaatattcttttcactacatcatgctgacacaaacagaatgaccagtgacatttagaatatcttgtcatcaatttttctggtcctagcatccaaccacttttcccttctaatgtgactggaaactgaaggaaatcagaccttagctttaagaaaaaaaaattgtttaacagcttttaaaaagaagtttcaatctaacagactgtactgtcactagaactctgctcaactagacacctctcaattattcacagatggatcatcaagaacaaattttgcttttgagttcttattgacattattacctacttagttcagttaaatcctttgttaaggcaaagctagtgtacttttcaactgaagtttttaaatacaataagagtttgaaagaaagactgttttaaagtcaaactcttaaatagagcatcccttgaaaactctgcttacatatttaacacattttgattgaacaaagcatcacagtcaatataaaaaattaataccgtaaggagacttcccatttctaggtatgacaaagtaattggtattacattaaccctcccactgaggaaaattataaaagctgggttaaaataaatacaatactgcatgatctcacttatgtgtggaatgtaagaatgttgaaatcatacaaactgagagtagaatgatggttaccaaggggctcagtgggtaggtagggtggcagtattggggaaatgcaggtcaaagaataaaaactttctgttggccggaaagactaacagaacaaaaggaatggagtgttaccaaagcagccaaggcgtgggctgtgatcctgggatctacaagaaattttccctataggcagatgtcaatttccaagatgtctatgtgagggcaagatgccaagaagccaggcagaaaacagctgctaagaggctagaaaatataaacagagattttgcgccagtaaattaaaaaacctgagtgaaaataatgtattccttgaaaaacaatttaccaaaattggcacaagaaataccagaaattctaaatagcccagtatctatttacaaaatttaatgcataattaaaatctttctacaaagtaaactgcaagcccttcgttggaaaatttttgcaaacatttaagcaaataataaaaatctgaagcaaaatctcttccagagaatacaaaaaaaaagggaattatttccaaaattattttttgaggtcactataatctcaataagaaagcctgaccaaaaatatacgaataaaataaagagtaaaataacaggcccatttcttttataaatgaagacactaaaatatcagcatgtcaaacatatatgtttagatatataggtatgtataatggtatatatatggtaacatgtcaaaccaagttagattctttcctaagaaataaaaagttgcattagcatttgaaaaaaaaatgtaattcaccatattaacagaataaataagaaagacaatatgatttttctctacagatgcaaaataaggatttattaaaatgtaattctcattaatgacagaaatctttaacagctaggaatagaaaggaatttccacaatctgatatagaggattaaccaaacatctacagtaaatattatatttgattatgaagtattgaaagttttcccttagaaatcagaaatgagacaatgatatctgctattccttctaataatattatactgaaactctcaaataatgaattaaggcaagaaaaatagtgaaaattaggagaattataaaggaagaactaaaactcccatgatttgcagatggtatgatgctgtgcatgaacatatacagaatactactgagtgaaagatgtcaaacacgaaagagtacacactatgaatctcattcatattaaaataaaaaggtgaaacctatttatggtgacagtatttatgatagtggttacgttgggagaagtgatactgaccacaagagaggcatttgggtttctggtaatgttttatttcttgacatgggttgtagtaacaccagcatgctcactttgtggaaagtcatcaagattatgagattttttatttttattgtatgcacattataattcaataaaaaaagtttacaaaaataattcataaattattcctatataacccatgctgaaagactccaactggcaattaaatgtgatactagtttgtgcatgagctgatgaaagagtaagagagggatgaacttgaatgagccagcctcatgggtaacatattattgactgtgtttctgtgcattcttgtgatataacagcttccttaggcacctccaaccaggtagctggctgatgggagggccactttctggggtcagtctcagaattgcacacttgagagaatgttaagaaacaaactcagaaataaagtacatctatgtataggtgaaacctttgattgagctatgcagaaaggtgataatcttattaccctagcatgagagtgtgcaataaaaatctggggacaaaatagtaaagtccaagaacatttcaatctcttctgaataaggtctaaataatatacatgccctagtcgaaatgatgtgaatttccagatacactcatcctcataagtaacaaatcatataacaaagacaaaattttattgaatgaagatttcattcatttggtttccagttcatttctgcctcccttcttctctatttatttaagaagtcctgatttacagaacattctacccaacaactgcagaatatacattcttttcattagcacatggaacattctccaaaatagaccatatgataggccacaaaacaagtctcaataaatttaagaaaaatgaaatcatatcaagtatcctctcagaccacagtgaaatgaaactggaaattaactccaaaaagaaccctcaaaaccatagaaatatatggaaattaaataatctactcctgaatgatctttaagtcaacaatgaaatcaagatggaaatttaaaaattcttttaactgaacaataatagtgacacaacttatcaaatcctgtgggatacagcaaaaacagtgctaaaaggaaagttcatagcattaaatgcctacatcaaaaagtctgaaaaacacaaacagacaatgtaacatcacacctcaaggaactagagaaacaagagcaaaccaaaatcaaacccagcataagaaaagaaataacaaagatcagagcagaactaaataaaattaaaacaacaacaataccaaataataatagtaatacaaaatataaatgaaggctaggcatggtggcttacacctgtaatcccaggactttgggaggctgaggcaggcagaacacttgaggccaggagtttaagaccagcctggccagcatggtaaaaccccatctctacaaaaaataccaaaattagccaggcatgatggcacatgcctgtaatcccagcactttgggaggccaaggcaggtgaatcacgtgaggccaggagttcgagaccagcctgtccaatatggcaaaaccctgtctctacaaaaattacccaggcatggtggtgcatgcctgtaatcccagctacttgggtggctgaggcacaagaattgcttgaatctgggagatggaggttgcagtgagccaagattgggccactgcactgcagcttgggtaacagaaaaagaccctgtctctaaataaataaataatatttattataatatcttccatttagtttctacttcagtttatttggatcttttttcttcttttcttggttaatctcactaatggtctatcaattttgtttatctcttaaaaatagtttttttgttttatttatttatttagatttatacaaaaggtcattcaaggctactatgaacacctttatgcacacaaactagaaaatctaaaggatagataaattcctggaaatatacagccctcctagattaactcaggaagaaatagaaactctgaacagacaaataacaagtagtgagactgaaacactaataaaaaaaattgccaacaaccagaaaagtccaggaccagagagattcacacctgaaatttctatcagtcattcaaagaagaattaatactaatttcattgaaactattccaaaagatagagaaagagggaatcctccgtaaataactctaagaagccagtatcaccctaatactaaaaccaggaaaggacataacaaagaaaaaaaaaaagaaaactacagatcagtatcgctgatgaacatagacgtaaaaattagcaacaaaatactactgaatccaacagcatatcaaaaagataatacaccatgatcaagtgggtttcatatgagggatgcagggatggattaacatatgcaagtcaataaatgtgatacatcacataaacagaattaaaaacaaaaaccgtatgatcatctcagtagacacagaaaaagcatttgacaaaatccagcatttatgatggaaaccctcagcaaaattgccatagaaaggacatagctcaaggtaataatagttatctatgacaaacccacagccaacattatactgaatggagaaaagttgaaagaaatccccctgagaactggaataagataaggatgcccactttcaccacttctattcaacatagtactggaagtcctaggcagcacaatcagacaagagaaagaaataaagggcacccaaattggtaaagaggaagtcaaactggagctgttcactgatgatataatcatatacctagaaaaccctacagactcatccaaaatcctcctagatctgataaatgaattcagtaaagtctcaggatacaaaaatcaatgtatacaaatcggtaccactgctatacatcaacaacgaccaagctgagaattaaatcaaaatgcaaaatcaatcttttttagaaaagctgcaaaaaaataaataaattgcttagaaatgtacctaatcaagaaggtgaaagatctgtacaagaaaaactacaaaacattgccaaaagaaatcatttataacacaaacaaatggaaatatatcccatgttcattgttgggtagaatcaatattgtgaaaatgaccatactgccaaaagcaatccacagattaagtgcaattcctatcaaaataccatcataattactcacaaaactaggaaaaacaatcctaaaattcatatggaaccaaaaaacagctcacataaccaaagcaagacttagcaaaaaaaaaaaaaaaaaaaaaaaaaaaatctggaagcattacattgtccaaattcaaactatactacaaggctatagttaccaaaacagcatggtactagtattaaaacaggcatatagaccaagggaacaaaatggaaaacccaagataatatttacagtcaaataaagccagatacttacagccaactgacatttgacaaagcaaacaaaaatataatgtaggaaaggagatcctgttcaacaaatggtgctggtataattggcaagccacatgatgaataagaaactggatactaatttcttaccttatacaaaaatcaactcaagatgatcaaagacttaaatctaagacctgaatccataaaatctccagaagataacatcagaaaaactcttctagacattggcttaggcaaagagttcataaccaacactacaaaggcaaatgcaacaaaaacaaaaataaatagatgggacccaattaaactaaaaagcttctgcccagcaaaagaaataattagcagagtaaacagccaacccacagtatgggagaaaatattcacaaactatgcatctgacaaaggactaatatccagcatctataaggaactcaaacaaatcagcaagaaaaaaaatagtcccatcagaagtgggtgtgatggttaatatttagcgtcaacttgattggattgaaggatgcaaagtattgatcctggtgtgtctgtgagggtgctgccaaaggaaattaacatttgagtcagtggactgggaaaggcagacccaccctcaatctgggtggccacaatctaatcagctgccagtgtggccagaataaaagcaggcagaggaacgtggaaagactagactggtttagtcttctggcctacatttttctcctgtgctgcatgcttcctgccctcaaacattggactccaggttcttcagctttgggacttggtctggcttccttgctccccagcttgcagatggcctactgtgggaccacaccttctgattgtgtgagtcaatactccttaataaagtcatatatatatatatatcctattagttgtgtccttctagagaaccctaatacagtgggcaaaggacatgaatagacaattctcaaaagaagatatacaaatggccagcaaacatgaaaaatgctcaacatcactaattatgagggaaatgccagttaaaaccatagtgagattaccaccttagtcctgcaagaatggccataatttaaaaatcaaaaaataacagatgttggaatgaatgtggtgaaaagggaacacttttacactgctggtgggaatgtagattagtataatcacaacagaaaacagtatagacattccttaaagaactaaaagtagaactaccatttgattcagcaatcccactactgggtatctacccagaggaaaagaagtcattatctgaaaaagacacttgcacacgcatgtttatagcagcagaattcacaatggcaaaaatatggaaccagcctaaatgcccatcaaccaatgagtggataaagaaaatgtggtatacaaacaccatggaatacaactcagccataaaaaatgaatgaaataatggcatttgtggcaacctggatggagttggagaccattattctaagtgaagtaactcaggaatggaaaaccaaatatcatatgtactcactcaaaagtgggagctaagctatgaggacacgaaagcataagaatagtgcaacggactttggggattcagggggaatggtgagaggagggtgagagataaaagaccacatattgggtacagtgtacactgctcaggtaatgggtgcaccaaaatctcagaaatcactactgaagaacttatccatgtaaccaaaaaccatctgttccccaaaaactattgaaataaaaaaactagaagtcctggtgttctcttaggctcaataagcttgtatagggcctgatctcttgcagaaaacatttgggaagtggataaagtgatgtcaaaatatgtaaaagtaaagaacaacaggaaaaaaatcagttcaagatgtaagaaaaattattgtaatagtaaaaataattactgaatgcttattgtatactgtctccttgtaaagtgctttattatttcatttaaccttgtcaaaaacactaggcaaaggcaatgttaattccatgttacagatgaggaaataatttgctcaaagtcatgagagatagtggtagaactgaggcttgaacatttttcagtctgattcagagcttcttctcagccactgcacctcatcaacctcctcatcaagaagagatggccatggggtatctccttcgtgtttgcatctcagatgtcctcatctaattgctgcccattttttccacatgtacacctatttttgaattttatttttgctgatacagtgtaaccagctttgattatttaggtgattttccaaggcaaattctcattttgagccattttctacatatcctagtcatgaatgtatgtatgcagtagaatcagaccaatgttagttagcaaaactgattagtgaaacaaatttaatgggatgaaacaaaatgtagtgtgcgtacacacacacacacacacacacacacacacacacacacaatgtctaaaatacaccaaatataaattccttgtagatcagcaatttggggttttctgcaatattatctgcagtcatgctttcccttccccaaacttttccctcatcaggataactaagcttagtgatgcactgagcaaaatgctggtgaccaggagagttgctgccattaacgtgatctgaagaaaactcggagattaaaagggcaaggttttaaggaatcctaatgacaaaacaagatcttgaaatttgcaaaattcctctgctacattcttctaccctgcagagtctggcttctgcctacttctccaaagtctttttcataagagggagtcctctcactgtgctgtaaccacattgtccagttttccatttctttagtcatttcctgctttaggacccctttggtagtcttgatccctgtgcctggaatgctctgcccagttctttccctggttggttggttcttacctttcatttctcaggtcaaatgtctcgttctgtaagaggccatccttgtcctccttagctaaagcaaatgcccctgcactcttgactgcttcttataacatcctagtaattttaatttttttctgtcacatatgatgatctgagagtatcttgtttatttgttttttaactgtttattttctgccttcttccccactccctcatcccgattcccagttggtatgttatatccatttacttatttatttttttactatattttctgggtctgcttatttggaatgtctgcaactttccctcattcatctctggcatatgggcttctacggacagccagcctgggagcacagttttactgtggatagcctacattgggtctgctgtttgctgaaggacaggccctacctccgtatctccacgcttagccattcatgcacttagctctgtgagatcatctgatgagatgaaactgacccatctactcctctagatagacaggtacagggatactaccatagggagcaagaaaaattaagttctgaatttgcagggactttttcagcaagaagctacagaagttgaaatggacatggcaaatggaaacagaaaaagtacaaaagtctgatacattcctctttgacacatcagctgctgcactgagatagagcattcatttgcactaaagccaagctctttcaatgttggggccaaatatagattagaataaaagggcaatgtgtttttaaccaaatgtgattttaagatggctggcaaggaaaaggcgttctctctctagagcccagcatttattagatgccacttttctagtagtttttaatcaggaagatattggctcaggcttttaaaatagctccattattatttatttctcagtgcacctgatcctgttccagattggcttctgtggattcctgagcccatggatccccttagtctttggtaatttttgccaggctttctgtgcttgaatttgacaccacccttccacctatttgcttcctaatgttttttctgtttttgtttttgtttttttttttttgagatggagtcttgccctgtcacccaggctggagtgcagtggcgagatctcggctcactgcaagctccgcctcccgggttcacgccattctcctgccgcagcctcccgagtagcaccaagccaggctaattttttgtatttttagtagagacggggtttcactgtgttagccaggacggtttcgatctcctgacctcgtgatccgccggcttcggcctcccaaagtgctgggattacaggcgtgagccaccgcgcctggccatgtttttgatattttatttgtaacttgttggtaaacctaaacctcatgctaaatccttacatcctaaataggatttttcaggtttcatatttctctagtattataatttgtttttccctcactcctgattttttcctgatagtttctttactaaaatatcccagcagaccgtgttcacttctcatgaaaatagttgtggtattagacttcattcattcctttccaaatatttattaagcacctactgtatgctagacactgtactaagtgctagggatataaccatacacaaaatcagcatggtacttcttcttagggaacttataactggatgtaggagacaggtatttaaacaagccattgtattaactgctgatgggtaaagaagggtctgctagcccagcaggtagttgtgtgtgtgtgccctgtgtgttatcagataaaacttttagtcagaattacccaggtacttttaatagacagcagcaaaagaaaacctctctagttgctattcttacagcacccacaccctacctgcttagctgggcagggagctcatgagtctttagagttgcctccaacaaaaatctctaacatgaatgctattggtcctgagaaggtcattggtatccctcatttaaacatttgggcagatgaaaggagtgaagtcctatgaataaactcccaaagccctcattaggccagcatcaggcatttttttaaaagagtttttatagaaaattcaagctattgccaaggataaaaactttaactgagccctagaagaggcttaccagttcagaatgtgactcagttcaactgtagacgaccatgatttacctctttgctcaaaacttcacctagagacatactattctttatgataacttttagagcttgtgtgctctcccatgattattatctccatatagctgtaaagggaaacttacagtctgaccagagacgaagacttgggaaagcactagggtatctgaggttatcaggctgggacctgaacctgcatatacagagttctgcaagacagatctgatctcgtaggcctcccatccaggaatgagcagctgtgcatcactttgaccaaacaattatagaagagagaagttccagttgtagtccatctagtcacttctcagtgaccttaatccccatagaggagaaaaactctgacatggcagattgacacaactgagaatctacccctattaaatccactccttctgtaccatggacttcaactgacttttaacatctggttggttgcccacctctattcttagttcagactattctttggtagaagatactcatgttttaaagatgtcctccctgagagctgagacaagtttacttatcacctagaaaataattcactaaagatttggatttaggtttatgtcagtttattttcaagataaaaatccaaaaggcaacaaaggagagaaaaaattggaagcttatatagttaaaattttataattctttaactatttccaaataagagatatcagcatatcaaaagtcctcaatatcaacaatcttaaatgaggatttattgtatataacctagcatgttaaggtgttcaagggtttcttggatttaggatcttcatctcttcagccctaatctccccttacaggcttcttgaagaagtcattccaacattcttcaggtgccagaaggcttcaagaacctgaaatctagcttttctttgactttttgtgaggacccatttagtaaaccccaacaatgatttatggtcaaactaatacctcaaagttttatatttgtcacatttttaatgaaagtactctgattctatctccactcctctttgtgaatatcttatgaatttaactcaaattaactgaataatttatgtagtaaagatatccatgataggcatgagaatcctggcattttcatttgaagaaatcaagtacccatagaggtcaaaacttacatcagacactcaggaagcccctctgattatagatgtagaagtccctttcataccacatccatctccaagggctaaagccactacacaaatggctcgtgttgaaaaacagagcctgtttgtttcggaaactcttataagcacgttgtggccatatactaatatttaatgatgtctttcaatactgtccttgccccaaacttcatcctgaccagcctgaggccccatcacctattttttttttaatctcttatttgagaagacctaaaccccagtgcagctgtggcaacctaatggaaccacatgatcctcaaagggacattaggacaacagctaattcatcagtattcttgctatctatgataagtatgtcaccattgtatgctttgagctgagacaaaggagctaggaaatttgtatcttccacatcagcctcaaatgcccgcatggtataatttcaatgaatgtaatgattctcttgcttccatctcaaagctctggtaccattattgtagttttagtgtatacagcaagaccattttgtacctttcttggaagatatgatgacccacttatccagaagagctttccaaaacatgctcttctcaaaccataggatttccaaaggtgagttatcaccttgttgtagaggctttttgtctactagctgtataccacctctattttttatccaacatttctaggtgtttgctgctcaggtttcccaggagtggagtaagagaggtggaaggttttctggccccaaatgaaaggggatataaaaaatcccactcttgtcaggaatgtagtcataactagttgtgagcctgttttattttttagatgagcatacttacattaaaaaaatctattcatatatgcacacacacatacatacgcacatagtttggctcattttaggaaggacttgaggtgtcacataaaaacattggtataggggttgcaaagtgcctattttgatgcccttttaattgtgactaatataacttgaatttcttaatcaagattaatataacttgaacttttaagggaaaatgtctatctataattattgagatgctaattttgacaaattttccaaatatatgcttaattttccagctagattacaaataactatagggtaaagatcatttatttaaggctctttgacagccttacaactgtgtttttaagtagaggttttgaattgtaaacgtttcaaagatgcttgtgaaattctatgccaatattcttagtatttttcttcagtttgctcagacattataaatcctgtgtgagaaatgaggagaaaatggaggttgatatgaggttgatataacttgcccgaaggtcagccagcaagcgagaggaaaggatggaattagaactcacacccctcaattttccaggctgttgcttagcccactgaaccccactgcctctgactcagtgtattaatatagactgaaacacagattgcttgaacatatggcagagaggatgagaagataacattctgtggcaggattcatttctccaggcaagtagatgtaaaggctgtttttctgcacaggattcagcaagtgaagcgttaagcacttaaaaaaaattgtctccaaatgatacaactttcccccttgaatgagatctgtttctgggcattcaatgtcaggagaagccggtagacgtggggccaggaggactgtaggccacccataggctatggtaaaaaataaataaggatcttgcagagccccagaattgtgcctagagggaggagtgcctaataaatgtcagttccttctccttcctcagcaaaccataccctatagttaggacacaaattatagatttgtctcctgatctagatgtttctatcctctttagcaataatctgcaatattctatgttcttaataagacctagatatttcttttctcactgttactagatgccactaagggcttccttcagtacattgggcaagttactgtggattttagcctgagattttttcttgtgagacacagcagtatcaggtttgtaaggagacagagctcaatgcattcaaggcatagagtctaaaggtccaaaattttaggcatgatttagggtggtggttttcaaattggtggatccaccaagaagaggaaagtgaagaggctgcatagggaaggttcagtacccctcttcttttcttatatgttgtaaatctgtgctgtataagagtttaatataaaactttggttggaaaaattgaggattttataactgaaagacacttttaaaagcctgatttaggaaatggttgcttttatacaataaaatgtagtagttcggagcatgtgtgttggttataagaataatcttactttgcatctaactagccttgtgacctcagataacctgcttagcctccctgtgcttcagtttccctatctacagtaactgtgcctatctcacaggtttgtaatgaggcctaaatgaagtaatatatggatgtgcttgacattgagactggcacacactaaacactcactaaaaggtagctgctgttataattttatcatcactattactattatttttgctattattgttagatctattccaaagtttggatttattgcctttttctagtttgcaatttaggtagaatggcatgggatttcgatgatctgaatgtgaatggcaggccccccaactcatgtaaagggaatataaaatgttctggtggcaaagggaatatagagagagtccatggggagatggtgtcttggggtctacgccatgctgactggtgaacatcccttataccaaactgaagatttgtgtcccttactcttatgagctgaattgtgtcccctgcaccccaagttcatatgctaaagtcccaacccttagtacctcagaatgtggctgcatttggaagtgaggtgtgtaaagaggttaagttaaaatgaagccattagggtgagccctaatccaatataactagtttccttatagaaagaggaggtttggacacaatgcctacagaagacgaataatatgaaaacacagaacaacctacaagccaagggaagaggtgtgaagcagagttagcttccagaaatgtgaggaaatacattgttgtttaagccacccagtctgcgctattttgtcatgtcagccttggagatttcaaattttagtttaattcagagaacaggcttttctctaccaatccaaatgcagagaaaacacaccagggcctggtactcctttgaaactccatttctgctcttcttttttcctaagtaaaattctactgatgcatgttgtcatcttttaggcatcccccaagtcagcatgttaattttttccgccagtgtttcatctgatgctccccaccactgctatcctttctgagcaattgtaatggcctctctagcacatggttggcatggctttccacttgcactgtggaacctggcatattcaccacctacaagaaggacttaaagagttatcaattcaggtttatatcagataataaaatgcctgccaaaataatgcccctggaatactctgaaatcaactgttaataaaaggcaaacaaaaaaaaatcgttaatttttttccccatggagaactttctttaaaaatccagcacagtcaaaatgaaacagctatcaaagaaagctcccccattagctgtcagttcacagcaacttcagtcagctggtgtgcctgcgcctgcagtaatatctccccagcatcctcccacacgcccaacttgactgctctgtgcaagccacattaaacctgtctgccatcaatccccgggtctgcttttcagcagcagcttaacgaggtaagggagctggcatcaccaagaggcaaatgctatttcagagggactgggagaagctgagagaggagtggaagtggagaaaagctagatataggacattaagcaacattaagcaagcagggtttttctcataagatcttctcatattgtcatttctatgcagatgtgttttccagcctcctaaagtcagaagagacagtgggagatgagttaggaagcaccaaatcatagcaagctggccacattcacacaattttatcttatggagaaactggaggacactgccaattctcctcttctcccaggatgagctacaactttaggtctggggcttcctttagaattcgtagcaagaagcacgaagaaaagcataagtttttgtgtttgtttttttcccctcttagacaaatctggcttgaagcatattcacagtgtatgtcaccactagggaagctgatctagccttcttcccagtgctgccaatgaagggcataagcctctggcactaagaacaaaatgaaaaatgactcagtaactaaactgaaaaacagttccccaatcaattccctgaggcggcaatgagaacaccacgtggggcagttcagcctccttcctccactctcttctgagaggccagtttcacagattgcttaaagaccacagtaattctggatctggtggggcttctgggaatagaagctaaacttctatttgaaatgcctccctcctgctgctcttaaataacgctgacaacaataatcagcatttataccaagagggtccttcagaacctttattaaatcctttcaaatatactctcttacttctatccggcagagaaaatatgctttgtgacaggtgcctaaaagatagctgcatggcttttgggtcctggaactacctgttgtctaaaataacacccttacttgtgtccagactctgacaaatgaccagcaaaggcactggcctgcacattttcttgacccagcaaagtggtctgctattttttcttcaaaatcacataaacagtaaagagaccttaatgatcgacttgcccaactgcacagctgacgtttgaattagaactgcaatcaaatggccattcagtctcggctagaaatcctgggatgaagaattatagaagttactatctcctgcatgctggctgtcactgaccaccatttttttctttcatgtgcttaggctctgtttttactaattccattgaactgactgctttctctagaggcaatgagtatgatagtactttatacaaaacagggccagtgttggaagaggaacattttcttcatgtcttttattatacaatttgagataattctctaatgacacaccgtggcatagtgaagagtgctctgaccttggagaacgaagatccaggtgtgagtcccagcttgatcaattactaccttgtaaatagggaggcctatcaatctcactatctatttgcaaaacgggaataaaactgtgtatgctcaagagggttgtgagagagttaaacaggataatatatgtgaaaggaatctctaagtggtaaattgctacatatacataagctgtttattcacttttcaacttttaggttactccttggaaaattgtgccaaagtgagtagaaaagggaaagggccaagagcatagtgatttaattagatccacaggacattgccttcgcatgggtagatggagcccccagccctttggatttcagcacattgatatgtggtaacttaatatgcaaatgataggcctcagagggcacccagtctccacatgtgccaattaatcaaaggaaacagtatcatcctctaattccactaattaggggatcatccataagctactatgttctgagctactgaggtttaataaatttgcaataaattatgagtaatacattagccagggaccaacttactactgagcgataggatgagagaagggttcaggttatttatatatttaaatggttttttttcctcaattttcttcttctgattttctgtcctaaaagtttctgaacaacttgattgtgtgggaccacaggatctccatgtttcgttgtaacaaggggtccagaaatcatatataagtacaactactaaataatgtgattagaattttaacacatgtaccataattaatccaaatgattggttgcttcaaaactgccattgtgtaaatttgtacacttgttctaatgctactactatgaccccaaattagggaatcctttgagaattgccttcacatgcttatttattcttttgaatcttctcagaggtgacaaattgttctctgagagtatatttgaatttggaggcagttaaaagaagtttgaaagtattgtactctggttattaagggaggtaatcaagcaggataatcctgtttgtggtcagttgaagaacccatcccattacccatgtgcttgaatgaggggatagatcatgctaagacaaaactctgaccattagatgtgactccagtatgtgattgaatttggctgagggaatggcgggtatgactacttgaaatcggtgtaagagggttttaacttcacttagaatacagacataagaggtagaagctttagttcttgccgtctctatacccagaatgatttttccaattaagactctatccattctttaatgttggtttatttatttatttttgagatggggtcttgctgtgttgcccaggctggagtgcagtggcacaatcacagctcactgcagccttgccctcttgggctcaagcagtcctcccacctcagcctcccaaatagctgggaccacgggctcacaccaccacacctggctatttttttattttttgtagagatagagtctccctatgttgcccaggctgttcttgaactactgagctcaagtgattcttccatttcagcctcccaaagtgctgtgattacaggtgtaagccacatcacccagccttctttagtgttagtttaaatgccatctcaattactagagttttcctgatagtgttcaattgacagtttttgccctgttcttaatagcttttattgtatcctgtttgtactcttatggcacttatttttggtgttttattttatttggttttaaatagttatcatcaccttttataggtggtaaactatttaggagtaggatatgtgtcttactcatgtttgaatctcacatatcaactagagtaagctttgggcatgatgattaatcaattaatattagttgagaaaatgagttatggtacagtgcagctgtcactatataaatgcagcaatagtcatatatacagaagtacatccatgtaggtacctaatttacttacatgaaaattactctcaatggtgaagtgttagtaagcatttcttttaaaattagaatggttcaagaatgccctctatcactacttctattcagcatttggctggtgtttccaaccagtagtataggacaagaagaaaaagaagtacaaaaactagcaggaaagaaacaaaacattcattatgcgcagatgataaaattgtctatataaaaacacaaaaaattccatacatttttgggatttagacagtttagaaaattgggtgaatacagaatgaagaaacaaaaatcaaacgcatttctagatagcagcaaaaacttagcttgaatggggatatttctaaaaaggtaacattaacaatagtaacaatattataccaaatgtagagataaatctaaaaaactatatgctgaatctttaggcataaaatcacaaaacattattgaaagccattaaagaagacctccacaaatgaaaattgtaccatattcatgagtaagaatacctaatattattaagatatcagttattctcaaattgaccaacagatttaatgtgtgaccttttaaattactgttgaacttgaaaaagtgattctaaaatttatgtgcatgaacaaagagcatacagtaactaagaaatacctgatggcaaaaaatacgatatgagagagggtcctgatttattaaatagcatacctacttataaatattaggcaagtatatatttgatatatacaaagaaagtataaatagacatagaaatagattactacttcccagaaacagatatctacaaagaaaggaaatatgaatattacagagttggcatttcagataagtggtaaacatttaaactataacaattgtgctgagactattagtttttaattttccaggggaaacaaatgaaattgtaatcttactcaaaatgtacagaaaatatcaattctaactcattgaaatgcaaaaaaaaatcaaaacttttagaagaaatcataggaatatcttataaccatggggtgaagaaggatttctcaaataagatacaaaaagtttaagtcataatagaacagattaataaattcaagtaaattaagcaaaatatctcttttcatcaaacagtaattgaaaaaataaaaagctatgataccaactagaagatttttgtattttaggttttttttttttttgcagtttatataactggtaaagggttattttctatatgaatacaaaactcttaaagtccaaaaaagaaagacaaacaacacaaaaatgaaaaatataaacaggtagcttatttaaaaattaaaataataattatgaaaagatgaaactttattattaatcaaaggcatacaagtttttaagatggcataatattttataaatagcattttgacaaacctttaaaaggctgatagttttgagtgtggaaagtatgtagagaaatacaaattatctttagttgtatgtatgtataaattaatataaattagtagaaccactgtggcagaagctgctagttatctgctaatattggtctttctcttctttctcagtaataagatttctctattgttagctggctccatggcaaactggcagaaaactacatttcccagtttgccatgtggggcaaatgtaaccatatggccatgtaaattctgaccaataggatgaaaataaaagtgttctgtacatctttaaggaagggactatgcacctattgggtctttctcctgttgccagccaaaatgtggatacactggctggagttccagaaaccattttcgatcttgacagataaatttgggaatgaaaattgttcatacaagttaacctatacagtacatgaagccttgatctcgacactgtggagtgccttaccatctctggaataaccacctccaggcttcttgaacctgagatagaaatgtatgactattttatttaaactcctgtgattctgaaatttttattagccacagcagcctaaacaaatcttaaccaatataaccacattagaaaaagatttgaccttccataaagttaaaagtgtgcaaattctgtagtcccacagttttctgccttaagtatatgccttgaagaactttatccttacatgcatcaggaaacaaaaaaaatgttcataacaccatggttctaagaccaaatattggaataaccaaatccatggatggaagaatagttaatttcattatgtttttatccaatgaactactaatatggagctaggaataaactcaacctctgaagaaaccataagcataatatgatccataagcataatgttgaataaaaatacaacaacaagaaaatttaaacaatttattatttggaggatacatacatataggcaatttataagtaaaagcaatgcaataataagcctaaatttcaggatagtgattaataaaatagaaccttatcaatatctttgaaattctgtttatgcccctccctggtggcatcctgaaggaaggggaaggggatgaaaccagggaagggcataaccagaactttaaagatataggtaaggttctatttttcttaatctaggtgctcctcattacttatgcaaatttctgcagccagcttgaatttctcgtcagaaaatgggtttttcttttctatcgcattgtcaggctgcaaattttccaaactttcatggtctgtttcccttttaaaaccaagtgcctttaacagcacccaagtcacctcttgaatgctttgctgcttagaaatttcttccactagctaccttaaatcatctttctcaagttcaaagttccacaaatctctagggcaggggctaaatgctgccaatttctttgctaaaacataacaagagtcaccattgcaccagttcccaagaagttccttatctccatttgagaccacctcaggctggatttcattgtccatattattatcaacattttggtcaaagccatttgacaagtctctagagagttccaaacttccctacattttcctttctttttctgagccctccaaactgttccaacctctgcctgttacccagttccaaagtcgcttccacatttccatttatcttttcagcagcaccccactcctggtatttactgtattagtccattttcatactgctgataaagacatgcttgagactgggaaatttacaaaagaaagaggtttaatggatttatattttgacgtggctggggaggcctcacaatcatggtggaaggcaaggaggagcaagtcacattttatgtggatggcagcaggcaaagagagagcctgtgtagggaaactcccatttttaaaaccattagatctcatgagactcactcactatcacgagaacagcatgggaaaggcctacccccatcattcaaccatctcccactggattcctcccacaacatgtgggaattatgggagctacaagatgagatttgggtggagacacagagccaaaccacatcacctccctttttcccaagcagaggagtccctccctgtgaccaccaccatcctaggcccacagtgagtactgcctggctaccattgatgttcactcaaggcccatgggctcttcagtcaacttgtggtgaatgctgccaggcctgagactctcccttcagggaatctggcccccttccagcccaaagcaggtccagaaataccatccaagagccatgtcctggaataaggaaccccaagagcctgcttggtgctctactgcactgtggcctagctggtgtctaagctgcaagacaaagtccctcttccttctccttttctcaagcagaaggattccctccctatagccaccacagctgggaatgtggctgagttacacctgaagtgagctcgcctgtgagtcacaaccaaggtccacggcaattactatctgggtattgctgctgattattgagggtccaagtgctctttagtcagaaagtgataaatcctgctaggactgggtcctttccttcaaagcagcaggttctcttctggctcagggtgtgtctagacatgtcatccagaaggtaggacctggaatggggacctcggaactctacctgatattctatcctactgtgattgagctgatacccaagttgcaagacaaagttctctttactcttccctcttctctcctcaacagagggaaggagtctctcccagagctgtgagctgcactgcctggggtttggggagggatggtgcaagaactcctttggccaccccagctgatgtttcactaggtctcttgtcttccaagttcagtgggtctgagcttagcacagcaccaggacttgccagggaattgcagtccttgtggcctagactgcctttccagtttatttaggacctcagagtgccttggtctgcaatggcaaggcttgttggaactcaggttctgaccactgggatgggcaattcccctctggctaggactgacctaaatgctccctccagcagcactggctggggtctacccagtcttgctttctgcagtgaaaagcagcactgagttccaatgcaaagacctacaatcactgagctcaccttcccctaagcacacagattctctgacccacacaaccactgtcaggggttgtgtcgcaagtcaagaatgcctttcctacccgcttcagtgcctctttcagtgatatgaggataaaaccaggtactgtgattgctcatctgattgttggttcttataaaggtgctttcatgtgtggatagttgttaaatatgacatttctgcggagaggacgattggtgaaggcttctgtttggccatttttcaccacttcccctcacatgtatgtttaagtattcttttgaatgtacgaataattttacaataatagttggaaaaagagtaggcagggcagagtagcatttagagtttggtatgtgtgtgtgaagtgaatctgtctctaggaacatgaagagatttaagcctgatcataaccttcatattgaagtacaattgatacagcagagcacttcttcctctgcttttaaatacatgatgtttgtcacagacttgcaatccaaatggatgaaggtgacccacccttctggcgaaaaaattctttgaaagctcatgtctataatcaccacaattacagctgcttccaccactgctactaccttcaccaccatcttggtatcattcgtttgttttaaatgctctcatgtttctgacattttactcagtgttttattaatattattatctttattaatcctcaacaactagtgagctagatattattaatcataagatcttctggggtaaggctcagcaaagtgaaagaactaggcttatcactgctagtaaatggcagttcttgggttcaaatgcacaccagttggggtccaaaatgttactttttaacgtcacatcatactgcctaatttcaaatgcatatattatactgtcaccccttcagtgacaataatgtgtaccatgaattctccaaagtaatattcataaggatgttttaaaggagtagcagcaaaagaacagactgaatatataactgattaatgacaatacttctgagaggttggaagatgagacatagagaaaagatgcagaacattctgaaaaattgagggcgaaaggacagaaacagagtaagacaaattaaaaccagggaaataggcaggaaggggagaaaaagaatcgggagaatgaacagaaaataataagaccatcctaaagaatttattttttcttttccccagaagcctctttcctcaccttggaataggtgtttcatcttttgaaatgagttggataaataagaagaaaaggttgaaaagtaatttcaagtccacagagcgaaccctaggatagattgcttttcccttgcaagcctttcatccagaaaactttaaggtcttatggttttggcaataattataacagtaatcataatactgcctagctggtgttttccccttggcagtatgtctgtaccaatcagtttggcaggataatatcttcaagttcacacactaatttgcatgaatctgtttgttagtctacaaaagtgagggctctttcatgcccttggaccttagtgtacttggggctgtctatcttggacatttgtgctaatgaggtacttttaggtcagaacgaagaagttcttgcttagacttattatgtacatttgaatattttagctatgcatttgaatgtatatatcacagatatatgtacaaatatctgtggggtgtgaaaattcagattgttagggtggaaatgtgacacttcgtacttgcaaaaaatctttaaaaataggatatttacctacttattaaaacagtaattttggtaatgctggttagcaggtggagcgcacgagagaacttttcttccactgaattctgtgacatatatgttgtcatgagacctattattgatatgtgttaggggttttttatagtaatcactggacattacaattcatttaaccctcttaatgacttgttatgggagctgaggatgggagagaggaaggtgacagacagagtaatgggaacaattcattcagcttctccaaggcatgccagggcgagaaagttcaagtgctgattcagattattcagaggtataaggattaatcctagcatggataggcagcgcatatagggctggaggagaagctatggaactgtgatcctggagtgatgaaagggctataaaacaggtttcttacacttccttttgaaagttcaaaaattgtgcctgtacaattaatgaggaatacaatatgactagatatgcctgtacatgttgttgtttgttccattaaaagtttcataataaaacagagatccaaaacaagattatgtatttatgactatactggcaagtaaaacttttgttagaacttcatgataaagcttttaaaagggctttatcttatctttaaaagcccacaaggaaaatactttttcttttgcttcacaatactgaaggactcttgattttatataaaaagagtcctcttatttctagtgcactgactgacctaatattatgaagctttgaaatcattcttggcttgaaacctaattattatttcattgctgctgaacattagtaacatgccagatattattgtgttaactcttcctaaaagttagtaaaaatcataaagactcctctatcatttggtgactccatacttaaataacttagccattaactattgataaggtgattatcaccatggaaatttccttttcctactgtatacaacattaattgattatacctattagatggtaagctgcttaagggaatgtttcacatcagtagaggctcaataaatgaagcttattcaatgaaggaatgaacaaatcaattaattttataggcttagcagaaatatagcttctgataaagtagattccattcttatattattttcttttattgcattcaattatcacttgagaaggcacattttccacattttttggctactaatcctataaatcctatacatctattaaataaagatgtagaaaataattttcaagaatatacatttcattaggtttagcacactaatagaaaagctctaatggaagaaaatctataaattctggctataattatagacatctccttccatgaacaaactctaaactccttattctatgaacaagcttgagttcataaagaagagtcagagaattactaaaaacaatattgatagcatgctgcatttccaaagaaatggtagcataaaaggaaagccaaaatttatagcaactaaatcatatgaaaaggaactgcaaaagtaaattatctgcttctaaaaagagagcatagaaataagttagaaagaccaaattaatagaactgtacactaaaaagcatggattttaccatatgtaagttatgtcaataaactacgactaagaaaaaagacatttttattagtgtctaatgtcattattaaaatttttgtattttaatacgtttaaaatatttaaaatttttaatatatttaaaatattccccacaaagtatttccattttgtcaggggaataaactctcctttatttgaattcaaataaaattcaaattactgaagccctgttactatggcttcagaaaagccaagaaactcattgttcttcattaaggggtaaagataaaattaaaaatatttgaattaaggttaagaacactgactttgagattagattactgtggaaagctacaagttatgatactgttggctgaataaacaaacccatgtaaacagtagcttattcattgttaaaatatagaaaataatagatatgtgatgcagttattgtgaggatttagcatgacaatgcatgtaacacatttaatgtattagcccattatatattatttttatatattatatattatgtattattttgaattatatattattaatattttctgctgggacaatcaaaaaaggcttcacaaagaagagtgagaagaaaggacattactggcaaaaacagtggaatgaatgaagagattgaggcagacaagagaaggacatgttgtagtttaaatgcggtattggatctttgaaagggagaaatgggagatagatctagaaatatgggacatcaccagatggtgatggtgttaaatgttattttaaggagtttggatcttagtcaatgggtaataaaaagcgattaaacattttggggtaggagaattacatgatttaaattgtactttagaaagattaatttggcagcagtctataaagacaaattagagatgagaatggttagatgtgagaagtccatctagaagaataatgcaggttgagtgtctcttattcaaaatgcttgggaccagaagtgtttcagattttgaatttttttcagattttggaatatttgcatatacataatgagatatcttggggaggggatacaagtctaggcataaaattaatttatgttggccaggcgcggtggctcacgcctataatcccagcactttgggaggctgaggcgggtggatcacctgaggtcaggagttcaagaccagcctgctccacatggcgaaatgccgtctctactaaaaatataaaaagttaccctggcatggtggcaggtgcctgtaatcccagcgacttgggaggctgagacaggagaatcacttgaacccgggaggtggaggttgcagtgagccgagatggtgccactgcacttcagcctgggtggcaagagtgaaactccaactcaaaaaaaaaaattaatttatgtttcatatacaccttatatacagagactgaaggtaattttatgcaatattttaaataattttgttcacaaaacaacatttgtgttaagtacttgtgtgtgaaattttccacttacaatgtcatgttggtactcaaaaactttggaatttttgaaaatttgaattttgaatttttgaattaggaatgcacaacctataccacttgtaaaataacaatgaggtcttgaataaaaatgatggtagttgtgaaaaatataacgctgaaggtatggatctggaatatgttttgtgggtaaaattgataagatttggccttagaaatggagggtagtgtaatcccagcactttggaaggctgaggctggcagattacttaaggtcaagagctccagaccagcctggccaacaaggtgaaacccccctctactaaaaatacaaaaattagccaggcatgatggcaggctcctgtaatcccagctactcaggagattgaggcagaagaattgcttgaacccgggaagagggagttgcagtgagctgagaccgcaccactgcactccagcctaggcgacagagctacacttcatctcaaaaataataataatgataaaataaaaagaaaaaagaaataaaaaagaaatggatgatagtgacaactaaaatgagtgactgaggcagatgtcccaatcaatcgagctgtattgagccagcttgagggtgcacccagaaaaaatggtggatcacagacatatctgtgactattttttccaaataggttctcaggaggtttagtatctacacattttccttaaaagtaagggcaacaatgagacaatgattacatatttgtgaggttttagttagtgcccaaattttcatttcacatagagtaaggtgaatctttgaagacaaggggaatagaggaagcagatgtctcaggaaggggtgaaaaaatgactaatctcatcttgtctttgttttgtactgggaagataagctagtaatagatattaacagtgtggagttttttgaaagggctggattctgtttagcccttaagataaaaagtctaatggtggttaaggagggaggtggttataatgaggtgtgtcgaacctctcatcctgacatggctgggaactcagcttccaaggtttctctggggtccccttggccaagaggggatctgttcagtcagttgagggcttaggattctttttttatttctcaacagtaaggggcaagagaagaacaaatcaaagctatgttggaggtttacaatgtggacatcttggagtgttcctgagccaataatgagattgtcctggaagattatggatcctatttagaatactttgtgtgtgagatgcaaacatgagagactggctgagcacagtgactcactcctgtaatcccagaagtttagaagcctgaggcagatggatggcttgaacccaggattttgagacaagcctgggcaacacagtgagaccccatctcataaaaaaaatagaattaaaagaacctgacaaacaaacaaaaaaacaaaacatgagagacatccaagttgattttatggcacttagcctgtaaatacaggtctcgaactaatgaaagaggttggggtaaagttttagcattttcccaatttatgcagatgattgaagcagggacagagctttggggtgttcttgcagttagaagacaacaagaaaaagcaaaggagacagacagtaagttgttttctgagaaatcagtttcaatatctgtaagggcaggcagctggttattcaagaaagcgagaggggagattatagtttggggatggtgaatggagatgactcattcaaaaacaaacacttcactctcctgactcctgtacttctgtgctctccaagttatcctacttttctgaccacagagatttctaaaccgccaaagcattgactgtttttttccctgtatcttacattactgacctcttgaaaatctctaaccaataatcttctgtgtaaataagacacatatctatgtttctagtccctatctctttcctgagatccatcctatcatttctaaccatccacacagccatttttacatccgtatacctgacattcaaactcaaaatgtcccaactgccccctctttccaaagcaacatctctcttggttttaccattctcccagtcactacaggttgaaaccttacagggaactttacttttctcagctctttcatggtaatcattaataagttcttcagcttctttcaccatgcttaatacccttctccattttctttgacaccactccaggaggcaattgaaatcttctccaaactgcattcctgtttcttcccattttaatctgttctatttgtggctgcatgattagtctccttaaagagaatttggatcatgtcaaaaattttcagtggagtatcactgtctacttaactaagtgcaaacttatactttcactaaatattctccataaaatatttccattttttccagaaaataaacaatcctttgaattcaaaataattaaattcacaacgagaagattaggggagatggaaaggagtggagagaaaaaaccgacttagcaactgcaaaaataaatcgctaatatttttggagacataatatatacatgacaataaactcaatctgaatcaaaagaggctgagcataaacaacaaacaagagaggtcatcatcactgtgaagggacttctatttgtttgaagaaaaagatttcagaagcaattttaaaaagatgatctccaggagacaaatagtacagtattattttattccatttggtcaggattcatagtgagtgatatggtttggctctgcatcctcacccaaatctcatgttgaattgtaatccccaatgttggggaaggaatgtggtgagaggtgattggatcatgggggcggattatccccttgctgttctcatgatagtgagtgagttctcatgcatcctgatggtttaaaggtgtgcggcccctccctcttaactctctttctcctctgctgccatgtgaagatgtgcttgcttcccctttgccttctgccatgattgtcatgccacctgcacagcctgtggtactgtgagtcaattaaaaacttattttctttataaactacctactctcaggtagttctttgtagcaatgtgagaatggactaatacagtgagtatttcattctgtactagatatcatcttttaggacagaacaactggggaacagccttgggagagggagcataacattgagcggaagaaatgaaatctatttcatattatatgaaatattattgaataaaggaatactatttggcttgaaagtgagaagatttagaatgacccaagatgccttttacatatattaagaatgatcaagaagaatggtattttacctttttcagtatggcccagactagcatattaagaccaatggatgaaaagaagatagatttatgctcaatgtagaaaagaaaattctcatagtcactggtaagttttctgtcatcataggtttaaatttactcagtaacaactctgaagaaatattatagggttaattcaagcatcaagagtagaaattgatccacatgatctctggggtgtttcccaaatcacagaatctaggatctacctttctaaagcagatttggcccaaccactctaatttaccataggttcctgccagacatggccagtcactctcccttgtgtttactttacaccttcccaattcaattcctttgctcagattttgtcctttgcctgaaatgctcacatactccaccagctggtattgtactgattcttgcaagtccaatctaaatgactccttcttactaaatgtctcccaacttaaatatctcctccttattgtccaagctgggtataacatttattaaatggcagagcaggaatgaatacaacagaacaccaaaaaaaaaaaaaaaaaaatctttgtcttttcctctgtctctctttttctttctttcagatttaaatatgaatagtcgactaaagcaagttccaattttgaaggaaggaaagaaggccaaactaaaaaagaaagaagacatagtctttatggcactgaagaactgaataaattaaatttatcctaagttattaaaaaaatggtagatattatgacaaaccccatagtctttctttcttccttccttcctgtctcccttccttcctctcttcctcctcttcctttctctttctatcttttgaaacacggtctctctgttgcccctgctggagtacagtggtgcagtcatggcacactgcagcctcgaactcctggactcaagtgatcctttcacctcagcctgtagagctacaaacacctgccaccacgcccagcgacttctttcttaaggcaaggaaatggtagttatttccttctcatagcagaggcaaaatctatgccctctataaaaaaagaaaagtaaaggacaactttggtaatatatggatctacttaatattggttcccagtaagaagagattatagattgaaataaacatgacaataagggagggcagacatgataatcctcatttacaggtaaggaaactcaaggtaaatgaggctaagttacctgttcttcaccaccaagatctttaacattctaatccagtactcttcccaccacatcaaaaactattcatcagtaatttactatgaatgtttgaataacaatggtgtcaagcaagaaattttgtgtttttttaatgatagtgacaaattacaaggagaaaacaagctcagaaatgcagtattattagcagtattcctactaaataaacaaactatcctacagtgattacctccaaggtaacaaacagatcccatcttatttcacagatgagagactaagaaaagaatcaatgaaaaaaaaaaagttaaggagttggcagaaatgataaaatgggggaaaaaatagggcaggctatcaacttacagcctatcagtgaccttgctgataaaggctttggttgagaagttgagtgctaccatgataaaaggagaattaagatgatgccaagactatttgattttgcagttaggaagaaagcagtgatagccaactttaattgaaatcaaaaggaggtgagtaaggagatgaagtcaactttcttgagaaatttggcactaaaggaataagaaatttatttattggtagagtgggaaacattgtaaaacagaaaaaaaatcaataaaactgagttttatatatttaaggcagagagctatgcatgaataaagagatattgaaaaggcaaaaggagatcaatatctaagggttgaagacgtggagtatcttaaagattttttttaaaaggagtgcacagatagagagactagacatggggaagaagagcaaagaggggagagagggaagaaaaaaaacagaataagttggtcgtattgaagcttctccatcaaccctagaacaattagcttccaccagtatttgttttaggaggaatagtttaaagaggagaaaaggaaaggtgaaaaggcccagtctaagggctctagtttatatggaaggacgtgagaagaacaacaatattgtgagatttaccaatttgaagagaatgcaaaacttttattatatccattatgaaatatatatatgagatattcagaaagagttagatacaagtattgcttagcagcaggattcagttgatatgagaaagcatggctttgaaggttctatgattttctttagaagtacctttgggcccagaaatataagcagaaattagacagtggctagtattcaggttagaggcttagaacatagtttcttcatgtaaccttggattgaacttccaagggagattgaggaatctccattgcctaaaatctcaaagaacatgaggtcccttggagtactatggttccacgaatagtaattctgatcaccatacatcaagtttctctcctctgaataaagaacagagattattccttctaatcatggtgcatcttccattgactcaaatacttatagctgcatatagtagttgtttaataagtgtttgctaactaattctaaatggaaataggttttggacagattgagatactttagtgaggcttataatttttctgcttaaaggtgccctttaatcattagcatagttctttacatagtctgttaagttaaattaacatactttttgactctaaagtcaacttgtatttgaacttccagtaagattagtacatgcaattcactgtaacttttttaaagttacatttattattaaaaaaatacttaagataccccattgcattctgagagtttaacctagaattggaagaagatattttaacattcatgaagtaaaatattctttcaagttttcagactattaatcccttgtcaattcatttccctcttaacaaatgatcagttaatttaaactgtagatttgttacttagagtttcataaaaatactaaagaagattgtaagtttttttgttaaatttagctgttgatgtcttctctttataattttgaaatttttcagtttccagaacttcaaaatagatactattttccaactcctcaatcttttttctgtgtaaaaggaaaataagccctatggtgatctctcagtttggagtttttggtttctatttgttagtgtagaaagaaaatagtcttaacttctactttgagattatagatagcagaaaacagttctatatttatttccccacatattccctttggttctggttttatacaagtataatgggaaatactgaaatacagcaagttgacaatccattttggaacacttagataccttgaataattattgagatctgtgggttattacctgtactgagtcttttgagattcatccacttctattttccatttaaaggggaccttggtcctatgacttcagaaaggacaagccccaaggtcccagctgtgttccccttttatctcctaatctagtcatctcacttacccctaaggtcatatatcttttgctgttctctgttgcatgaagtagcctttatgcttcagaaaatttaaaggtcattttcctttctttgaaacctcgctatgtttttttaacttacagtgtcagtttcagtgaaaggaaacggagaggtgaattgtcgtttcactggtgataaccagagcttaggggagtacttccactagttgttttcaaccctgggtcacaatgccagtgtcccagactgagttcccttcccacttaaacctcataaactataacccagcaatgacatggcattcatggtgtgaaatgaatgttgtttcacaagaagttgctgcatcatggaaaatacacttaaaaagaaaaaagaaagtaagttcagcgatcaatcagagtgaaaatttggatagggctaaaaggtcctgccctccaaagctgagttctcagaaagatgtcaggaaactaatacccactacacctttatagtaaaattatttctcagtcaagtccttagatattcatgtaaagctagaccttttgcaatgaaagcaacaggtgttgtgaattcctttttgttggttttgagcttctgtttttttccctattgttgacagtatgatctttaaaaaaaaaactgtatcttttgaaagctacaaaatacattttccaatcctctttaaccttgtattttttatagaaatgcactctgatctattattttataatcatattacatacctgaatgctgcctttcatccactttctgacatcagcaggttactagtcacatgaaatgaatactgattggatgtggatggcatctactggccatgaattctgattggctagttgctcagaagcatgaaggtcacttgctgaattgtttgtgctttagtcaatattgtcccatgttctcttgcagacctgatttctgagagcattatttaacaacaacaacaaaaaacaaccaaatccgcacatcggaattctaatcaagggcccttgtttccttccagcctccagctatgaaaattacattattctttttatgccaccttcctttgaatgttctcacaagaaaacctttacatagttatctaaagaagcccaatccatgtgtgactaggtgtctaagggtaaaaatgacaagagtcactaacaatggaaaagtctaacttggaggtccaaagtgcacccatcttaatctcttgtatgcttcttggtcaaaatgtttttctttacataatttaacataaatgcctccacattttatttatctttgaaggaaggaggaagtataaaataaaacttaatcatcactatcaattcattctacggatagggaaaggataaagttgagacagcctaaggctttcataagcggttattgatgaatgagaataacacctttatacaactggtggatgtttgagactgaactgtgtatgaaggagatatttacaggcagaaagtcagggatgggtggtgattgcaagaaatgtagatggcatgactcccgttccagagataagcttgccaagttctctacctagtttagtaacagcttccaaatcatctggatgcctattagtccacactgattttgaacttagtctcataagatacagattctttatttaaatatgtatttacttgtttattttaaataaaaaggggaaatcctcaaattgcccaagattcttctggtacagaattaataaaacagctgaagtaggacccaagaggtcctcagtgtctcaatttcccattttctacactctgtgactagtttctcaggtttttaaaaaccttttcctatgttcccttttcccctgtattgtacattctctctcttttcttttctttcagtctctgagcctccatcccccattcctccagcctctccagttaccagtagtgctgattgtatttctcctctttctctttttatctccatcactgtctcagccagggcttttcaagtacctgagatttatttttatttttatttttaatcacttcctctttttctgtttatctgcctgtcactgtctttgcttttctcagcctcctcccatgggtgcaccgttatctcttttctccgtcttaaccaatcattgcctatggagacttttttttttttttttttaaatccagtctaaggcaaagtatgaatagcttgccagagaggtcagttgagattcaatttaaaagtaatgctatggaaaatccaacttccatatctcactccttcattgctgcccctgccaataccaaaatatagcaacaataacaacaacaaaaaacaaacaccaagttaaaaacttggctttctgagatgcaaaaaggaaactgagtatgggtcatctgggtcactataggaaaatcttagcatttgacatggtatttagccttgtctataaataaattaatggccaggcatggtggctcatgcctgtaatctcagcagtttgggagactgagcagggaggattgctcaacacccagagttcagggctagcctaagcactatagacttcatctctaaaagaaaaaaataataataaattaaattagcctggtatggtggtgcacacctgtagtcccagctacttgaggctgaggtgagaggatggcttgagcccaggaggtccaggctgcagcaagccatgattgcaccactgccctccagcccagacaacagaatgagagcctgtctcagaataaaaataatagtaataataataattactaaattacaaagtacattctagtttttggttttatgttcctcagtattaagatttctgataatcacacattgagccaacaactatttacagaaaggtctgcctaaaaggaagattttccaaaataagtaattaacatctagtcaaagaaagagccatacagaggggagggcagaacacatgagaggacagtgcctagtggaaaacacagatgattaacacgatatggctccttacactggggcctgcagaaaggagaacaggcaagagatgagtcttcagagataggcaagggcagaaccacagagtattcttgatgttggcacaaaagtggcaatgttaacattaagagacaatgggaaactattgatggcatttacacagaaatagaggttgcaaatttgtgctatagaacaataatttgacagcactatgggaaataaactgagggaatgttagagaggaggtagggtgaccagttaagaggctcctgcagtactctaaatgagacataataccaagttggaaaaaaaaatcaagaaataaaaacagttcaagagatatttaagtcacagcttagaatcaagctgggtatggggagcaaataaataggaagagtctgggatgacacccacacttctggcttgcctgaatgggggtgctattcacaaagaaaaaaaaaatcaggagtaaaaatggatatgaatgggaaacatgatcaattcaaattttctgcatattaaaatcgtttattttgggaattataaatagagatttccttcaaagagttagatatatgggccttaaactcaagatataggtctaggctagatgtatgctaaaataagagcatccaaggagaaagaaagaatcagtgattttcttccattttatagttgctaaacatttactgagagtctactataggtacaaagtgtgagggatttagctatgtggtgagaataaaaagaaggaatgaatgatccttgtcaattcacttatctaatcatttatggattcaatgaatgtttatcatattactaaaaattaaaccgtatactaattagtaaatagcagtacctagtattaatattaagaatccagttagaaagtaagattgataaagccctaatgataatggtaagtaatttctagtgtagctcctttgaggggtacacactatagtgcagtagacataattcattgtaaagactgttacagtaaagttatgcatacattgcaatggtaaaatgagtgaaagggtgacatcagggttctatataggtttgaagggaggacatgtaatcctaggtaaaatgattggcatgtacgaaacacagaggtgtaagagtgcttcttatattccatagatggtgagcagtcttgtgatcaaagcttagattatgtatggggaacagctggaaatgaagctggaaatacaggctagggtcagattgtaaagggccttgtaagaagcaataataagataaactttgtcctgaaggtatcagagccaaaaggcttttatttagactactatgctcaaacaggtattttacagaggaaattctggtcactttacagaggaaggatttattgcaagaaagcctggaaataagaaacatttaggataatttaacatttattgtgatagctattattaaatatcctagctaataaaaaatcagtaccaaagcgttgctggaacaaaaatacaaaatggaatattggcttagtggttaattagtgagcaaagtgaaaggttggtggccagttaagaactagatacatgatctatgatatgaagcagcaaaatatttggtaaaattgtcacctctattaacttgtgagttaggctacatgcttaaccgagtaagcagattgaaaagaagttcaaaaactttgcatttgctactattggctgcctgtggaaaacagcctcaaagataatccccagtgattctcgcctcctgatgctcatacctcgtacccatgttatcctacagttggtatgagtgaccaatatcatatggcatatcactttcaaggttaggtcacaaaagactgtggctttggttttggctgttgttatgctcactcactggctttcactgttttgggataacagatgcccaaggaaaccccattatgagaagccctggggcttttctactggaagtcccacatggtgaggaactgaagacccttgccaacatctacaaccatgtaggtgaacttggaagtagactctcagtgccagtcagttcttcgcagactgtagccacagctgacggtttggttgcaatctcatgagactctgaggcagagccacccagctaaactgctcctggctttccagcccacagaaattgtgagataataaatgtttgttgtttcaagctgctaacttttcgatcgatttgttacccaacaatatataacgaatacaactgcttttggaagagatgatcaaaggagagaattgccaagtttgcaagtagaaaaaaaagaagagtccaaaagtttggggctttgaagggttaaaaaagccaactgcttcttgatctcaaatggtaacaggtggaattttaaaagacttagaatgacaaagggccaatgaaacctcttagttgataaaagaaacttagggcaaggaccatattaagggtggggctcaaggtagctacaattagttggctggagaaggaatgtaggggttagaaagcaaaagaaataaaacatgcttgagagctatttgagttaactgagttcaaaagaacattgagcatagttagcacgagttgctgactagaagcaaatagattagaagcctactaaaacacatttcaccagtatatcttagggatacatatatcaccaaaaaaataatgagcccagactaagaaagccagaatttctgggaaaaacatatgctttttgaatttttatttaattgagaaattggctgaagaatttgctttctttttaaaccctgggccaccacgagaagaatgtgaactgaaaaagttgtgcagcccctaaggaaagcatatttccaaatacccacttcagatgtgattaaggaaatagtaggtgagtgatcatctctacccctagatggcagatccaggagccactggaaaaaaaaagaggggggtgggggcagtgaggaagaacacaaaatcagaagctcagcaacaatcatatctcaccactaggtgggaggagggagttttcataacacccagtggaattttggaattgctttggaccaatgactaatgtttctcccatttatacctttttcccagggagcctcattccatttctcttctatcattttatattaggcatatatgtgatgaagaggggaggagacagatagcttatccttttatttccttaattgctggactaagaggaaaaatatctgaacctcatgagcaaggctgtgtattttggtaagactgtggaactggaggtgtctgcagttactgggttttctcccttagggagaaggggacagtatgctatgtgaaaaaggaagtatatggctctctggaggtcagagcgctgactgcgacagaaaaaaaatgttttgtatttaccatacctcatttcattttcttcttcctgatcacaaacaagatcacatttctaagcctcccctgtggttagtctctcccataagaatgagttctagccagtgaattgtgagtggaagtgaaacatgtttcttctggttgaggaagttatgagctagtgcctttcctgttctttccctcttcccccttcacagtgaccttggaggccatgtttttccaatggcagagctgcaagttagagaagaatgatacatacaggactgcaatgtaaaggaggaatacacttttattgttttaaacaatattcgtttaaccttgtgttattgagatttcaggaactacagtggcagctgggattatcccaattaatttagatccctttcccttcacttctccacattatataagaacagtaaaatgtctactaaataagtaacactgtttaggtcaacatcttcaaagtttagaaaacatttatcagatagaatgtagttttacaaggtttcatgtatagaatggtttatgatgtgtgaattcatgtatatgctaccagatgattacgaattaggacttattgtatatactgaattctggaccacacatccaaattatacctctgatataggacctttaatgcaagcatattttgcagtcaggagaaaattcttgaatataagatttgctatttaaaaattgcatggaatgacttcctatcatttcacagctaaagttcttcaaactcttcaaattcatccagcaggtcagatttctttccttctaagttttaggtacataaggacaattttataaactatatgtaggtgatttatataaagctaaatatgtaatgtttctctaatctttctctgactggatgacttcttattctgctaatatcttcatgatcccatctcctctgcaaagatgagaagactcatctcatctaaaagctttctaactacaagtaaaccagacaaaggtaaactactccattgagtaacttctttatttcttaatgtttgagataacaaaatcacatgcaaattttcattacaatgcttcagaacattatataagtgatgtatttccattttgatctactatatttcacttaaaatcacatagttaactctttttacatagtgtttaatttgatttcatgtgcacacagaagcaagcatgcctaaaagagtagtgccaagacaagaaacactgtttctcaagcttgcttctggaacaaaatttaaatgttggatatcagggtagggaatagaatgtctgtagaataaagtgttttttgtttgtttgtctgtttgtttgttttaagagaaatatgaggtctcactgtgttgcccaggctagactcaaaattctgggcttaagtgaccctcctgcctcagcctcctgagtagctgggattacaggtacacaccattgcgacttagagagtgccttgataataattgtgggtggatgtagcatgaactctttagactggactaatgttgaaaattagcgaactataaatttaaacacatatttacttctttatattcttttttgatttccttcatttttaatagcaaaacaacactttcaattatcaacgtggctggtattttctaagcgttgttctttcagttgagataacaataaaagtggtccagatgtcatcgcttattttcatcaacattatctattttgttctctttcccatattgttatgacagtcttaacatatacttgaaaacaattaaaactctttcattctcgaggatgttttgactccctttctcttgctatattcccttctcaccaataaaaccatagcgtttttctaaatgagaggagcatagtgatatcaaacactgacaattcatttcttaaagggcattcaattttcacactaaatgagtcgttcacaggatgagagtatagttcaagttatgtggtaaatagaactgaagaaagtgaaagcaattcatagaagagaagaaaagaaaaaaaggaaaaatagaaaagtgaatagcttacgtcctgtgtaccatatgaacagagaaaataaatgctaaccacattcctggtgattttctgttccaaggaaatatcaaccaccacaactataatttgcattgtacctcacaccacattcttaaaagggactttttaaaagaagatattggtaattagaaaaatattagtattccgtaaatagtactttattttttactaataacaaagcttgatattgcaatgaagcttgttagtggtcactacattagtattacatctagctgctcatttccaaaagtacaataaaggcttctttttttatttctctttccatgttctctttgcccatctgtcaataattgaaaagcactctatcaggaaatggaatttgtatgatctgtctcctctatagtgctaaagaaaaaaatgcttgactctgtgttagactttcttggtctggtatatctttttgtcattaatccaggcatgttttagaagggtttttagtgggtgcatttccaggagggaaccattgtctttttggtaatgtacttagtctccggaattattgtcctcaattcttagatgtagactagactgggtagaaatagcttatttcctagccctcttttttagccattgctattattaatgataaatgacttaaatgagcacatccaggctgaggacttgatttagagtgagttagagtaactcagaataaacccaagatgatgttagaggcacctgacacttaacaaatgatcagaaaagaacaacccgtgtacattcagagttataatataagtggatagattgttgcataggattggaatttaaaatcagagttaggagctacagagatttctgaactgagtgtgttgagatgacatacaaaagagatatgagtaaagatcaggagaatctagttcttaaccagcctccacacacagctgactgtggttttaaaagcattccttctttgattcttccttgaaatgtaatccagtcagtgagatagaaatctccctgcacttgagtcttatttgtcataattacgcatctttagggtttcataatgatcaatttaatcactttgccgtttagagggctataacagccaatcatgataataggtttggtatttgggaggaaccatttaacgcccaagagcccttattctgagcctcttgatgctacttcaacttgacaggcagcttctgattagcacacattgcaaaatctttggtaaaatgctcatttcttttaaataaattctgtgacctagtagtaggcatcttagcttgcatacaaggtcatgtgtaagagaagtttcctccaaaatgcttattttctttctagccatctattaaaacagtctgaacacaccaatcagcttctgttttctcaggaattccaaatgtagcttggttctaagtggctggtgaaaatgcacctgaacttcccaaactagctctgttactgtcattgaatgatatcgaaatatttttggactgtatctacctaaaactcaccattttcctatcatcaacggccttgtctaatacctgtcacactaacatgaagagaaacaaaacgaggtcttaggacatttgttctcaatctttagtgaatgttaagatcacagggagagtaggcttatttgaatgtagattcctagggcttatcctcagaggcttttatttgttgtcttggatggccccaggaaactccatttaacaggcaccccagtgattttgatataagtagccctgaatcacattttgagaaatattgtgcaaggccaattactagtagattggctactataaagacatctcagcattttatctaaaaacattaataaaatggttttccttcccccgacccccggctatgcctccatttcttctaaactagataatcactttaaaaaagtattttgtaaatgaatgtttgagtgcatttacttccttggaaaaaaagaagataaaaaatacagagctttttcatctgcatagcatgattttaaaactaaacagggattagactttggaaagctttgccaagattataactcacagtatagcagtttgagcatgagatgtgaactgaaatatcacctacagtatgtagattttacttctttaatttcctaatcttcagtatcctcatctgtaaaatagggatagtcatacatgtcatatagaactcaacttgtatttaataaaattaaatacaattatatattatacatacatatacatgtgcatgcctgtggacacacacagcacaaacacatgtatggcttagcaaaatacctgagccagagtaatatttttattgtaaattgataatttataattgtataaatttgtggggtacaaagtgataattcatgaacacaaggtggaatgattaaatcagagtaatcttacatagtcatagtaatcgaggggctagaaacaaatgttaacatctccaaattgtatctatctgggaaaagaaaatgcggcttgtagccactctgtctaacctattcttctttataggtaaagtaaaagcagtagaaaccccaaaaaaagggaaactgccgtttaaagacaggcaggctgttactatgaaagcaatgccacggactgcactgcaggttgctaaatgtgctgaggttatttgtgcccagcaataaatactgttgcaagctccaatggcaggaataaggccatgccatgccccagggtaaaggagaaaggaaatgatctggaactaccttcttttccccacccatgtttgctcttgcacatgctactagattttttccccctcaattatcccaatgtcttgttttgaaagggggcgggtggacagcatggatgtagaaactaagttatttattgtctttgcctccagtatactttgagaagaaaatgtgcagcacatacattttgtataaaatatgttataaagtatttagctgagtaataatactttggattgttattgccagatgagatgtccccagcccccagctccaactttacaccagcatcagcctatgtgatacagatgaggacccagtcaagatggcagtgtaagctctcatttgcaatggcagcagtagttgatgagggccagaggagggtaagggtgtccaagtgatgattcccatctcgctactctcctcctccaggtcaaaaaatctttatttttaaattattttttcctgtggctgctggtcttctttatagttttgaagatacatgtttgggctcctacaagtgagtaggacgatcaaagacaccctccctcttctattatcggggttaaaccagcatacagattagatgataccactgagtagatttggtcatttgaaaccacagagtcaaatcttctcataagatgcaaataaacataaaagtaagattcattacacaaactttttaaataaaaagcttttcaaaaatgcatttattttgtgtattgatggtctttctactattgtagaagactatcagataatgtcgatacagttcataaagatgactaaagggtaataatagaatatatttaataaaaagtaaatttatgacaacaataccatctagagatggataattaagaagttgcattgatatgactgctcattaatatatctgctgctctaattaatgctgtcagggtaacagtggtctcccttggatgctggctgtctcttcagtcacaggaccttgagggcttgggagagccctcttttctgcttctctttctctctttacctagctgatactggatgtatggatggtgccaatttctcctgcatttgttttcagctttctgaagttcgatattgcatagacatctggcttcaaagctatgtatgcctaagtagtttttactctgtaagctaggaatacatttatatttctcctacatactctacatggttagtattatttgtaagtcaaatgtttataaagcacagagatttttgggagaaggtgataaataaatgcttggaaaaagaagcaaacaagaagccccctaagtttttctagtggcagtttggatatgttaacagaaatctgagctcagtgccactgtaaaatcctacacatcctcataacagtctttaaagtgttagaaaaaaattcatctagcatttccatttctactgctgtattgcctgtggtggcgtattcatcctctctttagtgcatctaggagaaagaatttagtattccataaaggaatcaattcctcaaaatttctgactatattttgtatgttcagataatcttattaacatttaatgattatgtaaactaaattcatctattccacttttgaaatttgttcataacttgtctactcagttttctaagtcatgacatgttatgttaatttgattatttttgtgatattttccttgtgctcataaagaaacagactttgcttattattatagacttgaacatacatattttaaaccttttgccctcaaaattatgacatctgcaatagtggctttttaaaaaaaatttttttaagtaaaaaatgtggtatctgtataaaatatacaatgatcaagttttccccatctcattatattttcaattcctttcctttcttattagtatgcaattttttattactgacaagtggatgaatcaaaatgagaatgttgatttatctcagcaaacactttacacctgtagagaatggtgctgttggctcacatcagtacactcttagaaaaaatgcagagatgtcttctaggtttgaactttgtttggaagactaaaaattagtggttcaagttctagagcttttacatggtggaagttgggaaaaagaaactttggtgtttgtttgtttgctttttctctacctttgtgatttgaatctggcctttggaaataaccactgacaacctggcattgcagcactgacaacagcaatgaagagagtgacttcctggatgtcagtatggcatcagctcttcaactctcctgctcttattgttggcatatttgggaaacaataaccaaataaaaaagtcagcttcagggaaagagggaggaaccaggatgaaattttatgagtctaccacctggggatttgtgaggagtgacttctaaagaggagaaaagaatagtcagtctcactatagatatgaagggagctctagtcattttaataaaaacagttactactctcaaaaatgcaacttcatttggtaatgcaacctgagaagtgggtcatatcagttataaaattatttaattataaaaagtcatgatctttgtgatcctttcatgaagcttggtttctcttaatgtgtcttagtctttgtaactgatatagtgtgctgttgaataatcgctaggctagccacatttaactgctgaaaggtagcctcatttcagcatggagtgagtgatccccaaatactggtagtggaatgtcttgggatttcaatagataaaagaaacaatgttaatgtagagtcattaagagcaaatttttaatttgagagctttgttttatactagaatgaaaaatgaaatttggccacaggtgccttcacttttcttttcgctttaatctgtggactcaaaagaaactatagtcaagtttagcagttgtcttttcattctacatggatagagatttggttgataacaggcatttgcatgtggagatgctggggtgataacctatcacagaatggctttttcctcatccttttctgaaagagatgtgtcaagtctgatacaggtatacgtgagaatgtagatgctgggcatcgcacaatgcccatattttcagagaaaagtacaaataaagatttgtgtaaagcattcctagaagctttcctgtacttgtgtaccaaccatctttaaatcttgctggtctatctaagcttgtcaactttccatacatagtattcaccaaaggaagtttccatacattctttttcaaaacaaggaaagaagcctgtcctgccccagaggccatccactttctgtgtaatgtcaccattattcctgtcagtagccaggtaattaaggatacacatgatcaataggcttgccccttccagagctttgttatcttcacctaaaagtgcctgttcatagtgaaggccagtactgatcccagacaaggggggctttttcctcttgtttaatttagtgcccttcctcttccacagtgttcaggatctagaatactgcatggcacactgatagaagccactcagggaatatttgttgatgatgatgatgataattattctatatcacagaccactagtgccttctctgattaataccaatttctaatgattgaatttatgtttttgttgtcaatgaatcaaaaaactgcatacatttcagaggatgttcagaagacagttttagggttttttccccccaataacctattcaatgaccaatgtttcactagacttaaggaggtggagagaaaaataataaaatgagaagatatatgttttagttcaattgactttacatgttagtaataggacagaagtatcattcaatactaaattaagaaaactcatgttacatttgatccccaatgacttatccccatgatcaaattttcttggaaaattaatggacatttatttggagctggtgaggaaacttgtatatattaatattttcctgagtataacaagtgattagtctatggggacatgtgaataaacattagagaaaacttagcttgagatacaatatattaacaatcagaactctagattgaatggatacctgagattaatttactatgattacccaacaactggttaaagaaataccttagaatatattttaaatatatactttagaatatatttaatttagaacctattttataatccacaaggaatatgtgaactggattataataaagttgattcataactgattaaaattttttcctaaagtgtgctaattaaaggattgatatcaatttgagggacttagaaaaggacatcataatcaaatttactaagaataaccaattaaaatagccaaaccatagaatagcagtaataataataactacacattgaacatttactacatgttaggaatagttggatggtagaatagcatccagttagtgagttctacttctgggctgacatatgcagataatccccccaccatcttttatttcaagagagatctacagggaattggggttatccttggtctgttgtaacaagaatttcaaaatcattgctttacagtattatgacttcagtaataaaacaaatctgctaacatgtaacagggataaatgtaaagttttccccttaaattaaaaaaaacaaatgatgtaaattcaaaatgggaaatacatggctcattagctttgtgtgtgaaatgactcaatttttagttgactatgatctcacagacactggtatggatgtggggaaaaaaaacaacaatttttttctaagtccatacaaatctcattatttgaggttaaattcatgtagtttttgtttatcctttattcatttctttatttattactatttgctcaggaaaggtcatttcctcccctcctctcaggctcccttcaagttatcaagaaaaataaaccaggtctattcaacctcagggtaaggatggattggatcctggccagaattgtcttcccaactgggagtcgtcccaatctcccacccacagagataaaaccaaagacagtattgctggccttttccaaggagaacagaagataagctgactggctggcaagatccacgtaccgactagagtgaccatgtgactcactctctgttagccataagagttacttagttgttatagagccctgtggaccttacatgccagtgtgtacagaaatcacaaaggatgcttgttaaaatgtagattcctgagattgtgtttcaatacatctggaatggggctaagaatgctacatttaaataatatatagtagacttactttgtgttcatttatatgctaagtaattcaacatatatctgtgagcagtaaatatgccctggtcacccttctatagtgtagtagtatcactgagggtaaagcggtgaataagatggacaatgtacattccattgtgggactatgagacttacattctactgggaggctatggataaaaatctcacaaataataaactttcaaatagtgacagtgctacaaggaaataaaacagcacaatgggaaaagagtagcataaggggtgtgtgtgagctaaggtgatcagagacagctttctttaggatgccatgtttgaactgaggccttaatgatgaaaagaatgtgtgtgtatgtgtgtgtgtacatatagtgggttgaggcacaggaggtacagtacagaaggcataggagatacagcaagtgcaaaggccctgaggttggaaggatcttggtaagcttggggaatacaaggcaggactgtgtagctagggtggggtttctcaagagggaaactattgacattttgggatatatatatatatatatatatatatatatatatatatatacacacacatacatacacacacatatatttaaatatatacatgcatacatttaaatatactaatatatgtattttatatattagaatatatattatgtattttatatattagaatatacaatatacattattatatattctaatatataaaatacatatatacatataatagctatacatataatattaaaaatattatatattatataatacttctatatatcgtgtgtgtgatatggggcttttctgtgcattgtaatttcagcagcatccttggcctcaacccactagatgctggttttaccttcctggctgtgacaatcaaaaaatgtctccagccattgacacacgtctcctgggaggcaaaatcatccctagttgacaaccactcaactaggacacagtgagagggggagaaagataggagggtggggtgatagagagtgaccaaattatgtagggccataataatccctggatttcatttcaagagattctggaagtcactggggggttttaactggggtaaggggtaaatatgatctgatttatgttttcaaaaaggctctatcatggctgggtagggaatagggggtgtggaaagtagaagaaagtataccagtgggtggattgctgaatagtctagcagagagatgatgggattgaactggtgtttagcagctaggatagtgagaacatgttgaattcacaaagtgtaatgggagaagccctgatgggactttcagtggtcactagaccacactcagaaaaacaacatccttgacccttgcattgtccttgacccagaagtgctgtcatcacctggaagcttagatgtaccatctcaggccccacccagagatgctgaatccgaatctcattttactaagatcaccaggtgactgatatgcaggtgaagtttgagacacacaagtctaagctaagtttctcgttttacttattaaaaacatagatgctttgagacgaagagtgatctatataaggtcacacagacaatcaggagcagagtcagaactggaacccagttctcccatctcccgcccgtgttccgacagcctgcctggtaggataacatctatctcctcttagggtccttacttaagagagccaggaattataagtctgtccctcaattctcataggatgaggaaaagtcacccttcaaaaaataaaagattgaaattcctccagggaggaagaatgaaagacccatggtatcaatttaaagcaaaaagcatttaaaaaccaattaccaagctgtgttgctgctgctcatggggctgtcatcctttcccagctcagagtgttaatactgaaaatacaaaacaaatcccttgaaaagcgatgccaggattggcttgtgggcaacgatgatgaggctttgagatcagcctttgcaaagagggctgctcagctgcatattcagtgacaggaatcttccgaatcacaagcagcaggatttgcaacttgaacaatgtttcttttccctccatgggaagagagattttggaaagctgaatatcagtgttccccttgtctttatcattctcctctctggctaccctagacttgctgctttgttatcccccaaggacacgggccatttgtcaaattctcttctcctcaaaacctaaagcacaaaatagctactgtcctttctggcagctcctgcagagctaatatgttgtgcttatcctaatatgtggaccccgtcatgtcctaaattaaagagcctggtttgaaggatgagcttcaggggaaagaggaataaaacaaaaagattcaaatccctgaggctaccattcatgggaaaaggtacccatctccatctctaaaccttggacatgtgaaggaagccctgtttccttagaatcctgaaggtggtttggtaaaccacttctgcgaagggttttttccattacctggaattagcaggttactgaagggcagataaactaatcgctgtatgagcacagtggttggtggggagggaggctgcctcgggctctcatgggaaggaggaaaaagctgaatgcctttcctaggactgggtgtgaaactgctcctctcagttggagactggcccctgcaagcacacagcttctgccactgcacagctgtcagctgccattagcaggttcctgacaagaacatgtggcgttccccagtcattctccccagcaactcaaactgggcagtgatgcaggggtatgtgtggtgtgtgtgtttgtgtgtgtgcatgtatctgtgcacactgggaagagacaacaaagaagaaagagagattaaacaatggtttctggactcagataattacccagtatcaagagaagattcaagccagattttctctcttggtattagggactttgggtaagtcacttaatgcctctactctttgttttcctgcaccaactgagaatagcaaaaatctatgatttatacactcctttgtaagtgccaggctctatgctagagcccactgtggaaaccatctcacttaatcatcacaacaacctgacgatacaagaactatatatgtatatatatttgcagatgagaaaactgagacttgagaaggttaagtaaatttccccagaacccctagatagggatgatggaaccagaattccatggcagactatgtgactatgagtcatcatgaatcagcagctgtacctcctcaaacgcggatggccacctcactgtgtgtttgagtgatcaaccaaagccatgtgtgggaaagcacctggtacactgagggctgcaccaatgtcagcaactgctatttaaagaactcaacattagcttattcattcactgagtacttgttgtggacctggttctgttctatgaattataacacatggagaaggggagtgaggaaagacgatattggctcttccttcaagtaacacatgttatcaggtgttggcaataaaaatgttgtatctgtatgacaggttcataaccctgaagtcgaggacaccccacatgctcaccaaatgagactaaagcaaaacacctgcttacctaaccccttttctagtagagaccactgatgaggagttctcatgtcagcattctaagagctgcatttaagagtaaccatgggacctccttttatctctcattctatttctgttgtcatggtgtttcaaagcaaatacctgaaatgagtaaattttaattctgaaacagttatgcagttttcccaaagttgtaatttaacaggcataatcaaggcactatatcatagtaaatgatggtttatctggtgctcatcacctagaaatattattactagcgggtgcttctgtgcttcaatggtacaatgataattgatgttcacaatgattaccccgaggcagtgcaagttcctaaagtgctttgtggatcatacaaaaaaagaaaagaaaaaaaggaaaagaaaaaaacagaaaagcttcctttgtcattttttgcattacagttgaacataatacaattctttgaatattagtcaccagtaataaaatatgtgctaacatcactgatcagagcatttcaattccccattatacaccattatgccaaaaaaaggaattctgtacaggcatatattccgtatcttttatttccttccagaaaagctcaagctaattttacataactgagtgtctgcccatgaagaactctgaggggaaactgcttgtgttagtttgttattgctatgcaaactcagtggcttaaaataatataagtttattatcttagagtcctggaggtgagaagtccaaaatgggtctcactgggctacagtccaaatgtcagcagagctgagctccttctggtggtttgagggggagaatctgtttccttgtcttttccagtttctggaagctgcctgcagtccttggctgtggccgccttctccatcttcacaccagcagtgtagtatcttcaagtctctctctctaactacaaccctcacttccatcttcacattcccttggcactctgaccttcctgcttctctctgataaagatctttgtgattacattgggcctatccaaataatctaaactaatttgttcatctttagattttaacttaattacatctgcaaagtcccttttgccatgtaaggtagcatattcacaggtttcagaggttcaaatatagacatctttggggggtcattattctgtctatcaccctcctcttaacgaacttttcatcacaatgttatccttttctttcttttctctttgactttaacttttgaaacaatatcatctttctatagatgatgagttagagtgatcctgaaatcaaaattatagaattccataaggtcatgggaatcaagctcacacagaagctctgctaatatttgtcagattctcaccttgccctggtccaaaccagcaggagacaggctcccctggcaattgcccactccactgtgtgtggcttactaacacttatgccctagagagggcagttgcttagtcttctgtttcctagagcttgcatttaaagatgagaagaacttgaagttagagcataaaaggaaaaaaaaagatgaagaatattttcttggtgccagacactggagaacacacggggatattaggaaggagaaatgcaaaggcagaaagccaggctgaaagaagctttggatgccatctgacaggccttttgaatgcgcagttttggttgtcttcccagctgcaccacatacccctacatccctctgtacattgctggaggagcaggaaagcatcccttggaaaaaaaaatcccagtgcactcagagaataaggggaagtcatgattaaggttatgagagagatactagccaaggggtagtggaggttacagctgtgtggacaaaatgtccagacaggaagaaagtacatgcaaatggaaccaaaatgggcttctgtttctcagctgtagacaaatgtcctctctgctaaccttttgccctcagcttactttggctgcttgcctctgaattatgttaaatgtttctcttttatctcatatttgggttttcataagccctgatatttgcacaaccattagggtttaaataggatacctgacacatctattatgagcaatgtttgaaggaacaaaatccatcatttcaagactggttaagaagaagtgctataactaaagtgctagggtgaaggaaagatgcaaacatgttattgttaactgtgatagtatttttttaatattttacttcagaaattttaatggaggaacaatatagccactacctttatcaagagcttagcagggcaggtaccgtggaaggtacttcatgaagattatctctttacggtgtgcaacagtaatgagaaagttctatgatagcatcattttgtagatccttatatgactgaaggaagtcactttactgaggtcccacagtttgcaaatcatatctaaagctcaaatgtaggttagcctacttcctaattgtatccttttacattgcgttacgtatttcctctgtttatctaatacctttgactttatagataaactcagagaattgtgtagtatagaaaatctcttctcagattatttgacaataaaggcaagatctaattacatttgatttcaatattgcaagagttggagctccccacattttgcctttcaaaagtcatttgggtttgttccactcaaatctcattattctctaatctttttattctttaaagcagattgtagtaggttgaatagtggtcccccaaaagatatatacaagtccttacccccagtaccagtgaatgtgaccttatttggaaaaggggcttttgcaaaggtaattaatttaaggatcttaagatgagatcatcctggattaacgctgaatcctaaatccaatgatgttaataagagaaagggaagggagatttgagacacacagatacaaaaacacagaagacaaggccatgtgaagacagaggcagagactggaaataagctgccacatgctaaggaaagtcaggagttacaagaagctagaagaagtaaggaaagttttcccactagatccttcaaagggagtgtggccctgccaataccttgattttggaattctggcctccaaaatagtgagataacacctttctgttgttttaagccatgcacgtttgtgattatttgttgtggcagccctagcaaactaatacacagacgtagttagttgatggtgcagatgtcaagatagtttggcaaacattactgagaaaaactgtgtgattaatgactgcaactatgtctcagggatacatttttgtagtttagtttcctactgatgcaaactgagaaatcataaagtgttataatatttattactaaaaatctaaaagtccaattgacgttcagggcttcaatataatattcagtgtggtcccaaatggtttcttttctagtacgggaacagaatgaaaactcatggtccctgtgctttgagggtaaaaattcaggccaaggctaaagagtatttcattgtaattgaatattcatcattatagtgatacaagcaacaaattttcactaaaactagtaataaaaataatatcaagttcatacaaataatctaagcaaatgtatatatgtatacttacatatatacacatatacatatatacacatatacatatatacacaattatgcatacatacactattatgcatacatacatgaaaccaaatgtgtgtgtgtatatatatgtgtatatatatatatacacacacacacgtaggtgcatatatatatatacatatatatacatttggtttgatgtctatatatacatgtatatgcatatataaacatatatacataagcatgtatatacatatatgtatatatgtatgtacttttataccatttttatactatttcttgcccatttgattgatttcttatgaaaggtcaatagggaaacaaatgaatatggaatccctactggtatctggtagattttgctcttctgataaaacccaggaataccccttggcaattctctctggacccaattcaagatttatagctgattgcctgtagagctctggacttgggttctgaaaattcatagaatcacacatgggtggcttcctagtagctcctacatacgtgagaaattgtcaatgcagagtacctgggacaagactgacatgaagtagggaccccaattgacaccagtagttgaaactaatgtgactgttctagtgatggtagtaatagtagcagtagtagtagtagtagcagtgggtagtaatagcaatagtagtaatggtggtgatagatactatggtgagaaaagatctgaatattcattacggtttgtccaaatcttatggaattctcttatataagaaagaagccctaaagaaagagagctaactccctgtcttagtgtttccatggatattgagaatctcttcaaacccagaaaggtaccacctcaggcaactgagatcaataataaattttctggatctattgaaataattcttcacctatctccatatgaggactgtatttatgatcaggtcagaagcaagattcagtccttacagactggccatggtagcagccctttatcccatcccagtccccagtctcacacccttacacagcatgatagaataacattatgggttactcctgctgccagacatttccttggcagaaccacacctttgacaggaaatagaactgagtgaagattcacatacattctcaaaggcttagcaacatcacacactagcctcagcagagcccgtgatccactctgacacgcagcagctgagtcagcctgctgtggagagcttagagtgcttaatcgttcctgggggaattatctcctctagcaacaatcagtaacataactgccaatggtagaaagttatagctgctcacacatgcgtaaaacaaattttcctttcaggctggccttggtatgttacaggaataacccaatgggggtgttctttgggtctccttctagttttctggcattatagagaagacaaccagggttggctctactgataggccattcagactttggggtgaggagctagcaatagggtggcagtactggttccagttggtcctttggttatggctgcatattcagagtttaagagaggatttacctctaaggtatagcagtcataaagaaacatgataacagggcaattaaaaatctgtgaccccagagctcaaagaaagacagatgagccagaagtcctgatgatcagcatcatgtgagcagatattatatgctatgtactgaattgtgtccctccaaaattcctaggttgaagcccagatgcccaatgtgatggtatttggagatgaggcttttgggtgataattaggttaaaatgaggtcacaaggctgaggctattatggtgggactagtgctcttttaagaggggacaccagagagtttgctcactgtctccacacacacgcagaagtcatgggaggatctaggaaagtggtggtcatcgacaagccagaaagagccctcatcggaacctgagcatgctggcacctcgatcacggacttctagcctccagaactgtgagaaaatacatcctgcaaattaaatcccccagtttatggtatttgattatagcccacagctgatggatacaacgtagtaactattttttaaaataaatgggattatttagttatattaagtaggtgggcttttagaagtcatatatatagcagccatagttaccacaactaattatgagaaaatagaaaatgtttatctctggtctcttcaggaatccatccatccatcttcacctagatgactccaaaagtaagcctgtctaaattccagagttactcaaataatcaccccctgccgacttctgtgtccattatcacagacatgaccataagcaatgggcagctaagtcctcaatactatgtgttatcatcagaatgacttttgttccgaggtgaaattcttgaatatataatttggtgcaatttgaagcaattttcctatgttttgaaaaatataaaatgtctcctggattgttctatgaagactaaatttctgtgactattttcccatctgcttttcaagtctctcatcccctgatctggatctgtcttccacagcccaaacagcataaagactcggctatcaggccaaaaaaattaaagaaaaaaagactgatgtcattcaaagagtgacattttagtttttgttactagaataccttaaagaattagatctgatttgcattgatatttgccaactgaattattgaagttttttttttctttttctcttcccatcatcagattttaacactgcagtcaactgcagacaaagccgcaatcttgtgacttcacagagcctcatgggcttttgagttgaccaacttgagaaaaatttctgacttgatgcatgaaatgaaacgaaggcaggtgacacataaaggaaatgacaaggtattttttttttgccaaggagtttgcttctcacaaagtttcttaagtgacatggggtaattttattggcatgtcttttatgggcagaaagaccccatttgaattacctattgaggttcctcttttttattagaatgaattgcagcctcagtgtactgggagacttgcaaatgaatatgccaagagaatgatgaggatttcagaaatgtgtgcacattttaagtgatatgttagactcaaacatcattagaatgtagatagaaaaagacaaagtgggaatttctgtgcagttgttacttctaaacctcttcatctaaagtgacagaaattctaaccaaacaaatgtgatagtgcatatatatcaagatatttttataaacacacacacacacacacagtcactgaaacatttcctgttgatttcttattattgcacaggaagaatctcaaatgctcctatatttgtgcttggtagaaacagtatacaaccttgactatctcaaaaagaagtgttttctctagtgcaggggttctgtaagtttactttgcatcagaatcacctgaagggcatgttaagctacatttttgggccccacacctagagtttctgattcatgtaggtctggtgtggagtctgataacttgcatttctgacaagtttctaggtgatgcagatgctgctggtttaggaattatactctaagaaccaatgttttggactatccagaaactctggttttattagcaagcggagtgctttccagtcttgaagttagttctttctactatctaaccaaaatgattgtaatttaagtctttattgtgttctgtggaacttaataacaacaacaaacacttgaataatgctttttcattaataaatcacttccgtatggattatttcactttaggcaaatcaacgtttatggtaggtgagtaggcattcgattattcatgttttacagacggaaagtagagggtttaaagaacttacttaaacccatataaaagtaaattatggacagcagggctttctgactccaaagtctgtattctttctatcaaatcattcttcctctcaattctttacatttgtagagagacatacatttttcaaactagtttcatattcattatctcatttgatccctgaaagcaacagtctgaagcaggcagggcacatattattgtctacattttgcagataaagctattataaaagatgatgagaaaagtagctactgtcattcagactgcatctctttgtacactaggcaacatttttcctccaacatttagtagcagcatctgatgtagcaggtacagcattagatgctgttctttccagtgataagtattcaatgacaaagtattataaccccacccccactccccaccaatatttttttttttctcttttcatggtagaaatgcatttgaagggaaaggaggtggggatgaactttagtgttaccagattggtaggaacgtggggaaaggtccctaactgctatacttcgaatactaaggacagcagctttctccacctgtagtccagggcttttcaaaatttaatgagcacctggggatcttgaggaaatgcagattttcatccagtgggtcagggatgggacccaatattctgcatttccttgtctcttctaccacttcttccaggagcaatattctgtatttccacagtgatgccaattctgatagtcagagtccaaccttgtagccaaggaaaaaccttatttctcaaaactattattattttcattctctgaaccacctctcaatctctaggctgaaacagaaaaattgaaaatataaaacattgtaataatattcggtgagtactacacacattgtgggacttacctaggtgtttctctgtgctagactgcttatgtatcccacaatcttccaaactattttgttctgaagatcctggatgatgctcaaactgtggcccatagagcagcagtgctcacattacctgagtgcttgtcagaaaagcagaatttcaggccccacccagacccactgaatcaaaatccacattttaataagattcttcagatcatttcctagcaccgtcgtaacagaagtccttccaatcgtcttggcaatccccctgtaattatagtgtcatcattctgttcacctggcttataatataactccctgagaggctttacttctacagaatcctaaaattcacaaaagagataatttaagtgtgagattggctaaggaatctgtattgttcaatacctttgcttctgctctgggtaattccgatgatcagccaaatttgtaaatccagcggccatctaatattggccacaaaagttatgctacaggtggccaccaccagaagggttttatagtaaattacaggaagtattataaaacttccagctcttgtaacgggggctccttcttctgtttgactcaacttattaactgtcagagtgggactgaacccttccctaacacaccctcacccccactatagcacaagtttattggcgtgatagtgttgagatccttgtcaccacatacataaagaaaaaaaaaatcctttcccagataagaaatttgcaatagacatttcacagtgttttgttttgttgttgttgttttgagatggagtctcactctgccacccaggctggagtgcagtggtacaatcttggctcactggaacctccacctcccaggtttaagcaattttcttgcctcagcctcccaagtagctgggactatgggcacacgccaccacaccgagctaatttttgtacttttagtagagatggggtttcaccatgttggccagcctggtctcgaactcctgacctcaagtgatccacccaccttggcctcccaaagtgctgggattacgggcatgagccactgtacccagcccaacatttcacagtgttttcaggaaaggaaatgtcctatattttaaagatgtacattatatagtactgtaaaactatagtttatgaagactctgttctttaagtgtaagctttaagcaggttgcaacagagtctgacttttccctggaataactaattcatttattccttcagaaaatatttattgaacacttagtctgtgccaggcactacaatgggaactaaggacatgcaggtggctgctttcatgaggaaaatagacagtaaaaaagtaaacaaatgtttaaaacaattactgagtgtgataactgctgagaggaaaagaacaattgctgataataaatgggtgataaaagactatgaaagggctagctacaagaatgttgagatttgggaggattcgccatagaacattggaaaatgatgcaagtgggatggaagcaggtcagcacatcagagtaactcaaggcaagaagaatctgaattggacctagacagagaactttcctgaaatgtccagaatcttcttggcaataaattactgaaactattagttggataggcttaagttctataattctattgtatcatttgtaattttctttctattcactcatggtttattatcagtgtgtatttagtttatacttcatgatataagttaggttacttcccactaatatttctatttttttagaatgaaatccttaattcaataacttggttgattgattgaacacctgtaatatgccaattaatatcttgaaaatatgcacatgaataaggcatagtttatgcttttttttgagacagagtctcactctgttgcccaggctggagtgcagtggcatgatctcggctcactgcaagctctgcctcctgggttcatgccatcctcttgcctcagcctcctgagtagctgggaccacaggcgcacgccaccacacccagctaattttttgattacaggtgtgagccactgcacccggccagtttttgcatttttatagatcttataaactagggggagaatgaatgagcacatagttaaaatgcagttttattaattttacgatgttccttcctggaggaagtgtcatcttgaaggtcttgcaagaataagttatactggtaaaatgatggtacgaatgagataagcagtcatgtatcaagtagaaagccagaattgtgaaggccaaaaagcaagtgaataaagtacactcttgaaatataaaaggagtataatttcaagagtgttccagggataggatgatcacttgaattaggcatttaatgtcatgttaagtagtttgaactttattccaaaagtgctgggaaataggaaaattaagcaaaaaaaaaaattaacctgaccatttccatacttagaaatagtagcaaagggtccaactggaaaactgatgaaaggcaggtgagaggaaatattggctgaactacattgtgacaatgaaaataaggaaagtgaatgaattagtagtttccaaggaaaatactcaagataatgtgtgaaattaatcattgctggggcaaaggaagaaaaagagaccaggatcattcttacctttctggctcagacaatttttatttccttccctgaacatctcttggaacttttcctctggcccctttgcttctgacaaccctgggtacatatcttgattcatgagacctgagattgtcccccttggcaaggatctaaatcagacctaccctgtcatctcacgagggatattggaatagatagatcttagctgacatccataaacaacattggaaagtccattgtggacagtccacaggagctttacaaccaaatgaggcttttgcctgtatagataagccatatcaacacagtgtgaatccttttgcatcctgtttcttagtggcttggttaactcccaaataaatctacccgcactcactgtgatgaattttattgtgcaagcatctgctcatttcaacaactccatggtcactttgatttttaaatatgctcctgaagaaactataatgtagtatttgtttatttgcttatttgtttgcttgtttatttttctgtgtaactcctctctgttgctgttcaatggctcactcttgaacattgcaggtcatttttgtgtgtgtgatagtataatcatctcttgaaacaccagttttgaaaaaaataacaagggttgtaattcaccattatgggttctatatagctacagttaataaaatatttactgttatataaccagactgtgggaaaactatcttctcaggtgagaatggatatatgaataagccatgtcagaacttctccctctaacaaacaagagactgtcgttgtcatggccttttaaaaaatagaccttaagcgggtacattggggtgaaatgtaatataagatgtaaaatattaaggctaacttggatgttagcttttttaaaaatccccgtggttattgtgctggaatgaaggatagacctgaataaagaagagcctgaggtggttttcagtcaaattattaatctcacccaaaatgatcactatgcagctaatacatagttaactatagttacaataaataataataatgatatcaagaattgctaatactgcaccaagaactttgcctacgtattattttaattttcaggataatatatgatacgtattctatttttaaatgtattttaaacatagactacttggaatggtggcaaaaagtatttgaaggagtgagatgttgagagatgtggactctgtatttctgttttactaggccacgtacaaagtttctgattaagttattgcctctccccacccaaggttccaccatgtcttggagcattgatgtccaaactagttccccaagaacacatctaggctgattcacttctcttcaggcagagtgctctgggaatctgatgacacgtgtgtagggtaggagtggggttgtagggtgatgctagggcatttgtccaacacttgcaagaatagccagcacgttaggttgtgcagatcttctcaatgacttaaaggctgaccatgtcagttactgtgagcatctccaggatttttaaagtttgggttgtggaggccagtaatcatgtggttaaattttgtagtcattttctaaatgatccatttgtttcaataataaagttactaaaaaagaatttgtatttacttgattaggccattatggagccatctgtattgggaaaatatgtttcaaatctaaatttaagatattttatacacacaaacagctgtctatatacctgctactgatatactgagactatactgggaaagtatataactttctctgtgagtgtatgtgtgtataatgcagtagatacactgttatttactacagtatatatagtagtttatacattggcatatataatatcaatatacaagtaaggcactgaaaataaaatatagcaaacattttaaaatttatttttgtgcttttggaagaaggaaatggatatattaaaaagtaaaagaaaaagtgtgattaaaaaagagatttaaacgttcaaagaaaagtagcataacaaaacccctacatcatgatctcacatacagacgcttgcctggattcttaaatgcattatcattctaggccattatatacattgttttctatacctgggatactctttcttcccctattttcttggctaggtcctattcatccttgaggtttcagcgtaatacttctcaggtgagctttgctggtcttgcagattttgctacatggccctgttttatggtctcattgaatgccataatttttcctcataatgaatctaattatggggctattcatgcaattacagatgtcctgacttatggtggattgacttacaattttttgactttatgatggtgtgaaagtcatatgcatttagcatgtgcaccaatttaggatggggttatatctggataagcccatcctaagtcaagaggtgtgtgtattagtttaatgctttgctttcttattgaactataagcttcatttgtgcaaggaccatgtctgtcttgctcttccttgtgtgtttacagagtgaacactgtaaataattcttgccaaatgaacaaattgtgagatggaggtcaagattaatctgagtataattctgtattgatggatgacatattttaaaaccaatatataactaagacactgaaaataaaacataagattgttctttatctattttctcctcttttaaaataaaaaataaaaatattgaaaaataaaaaatgcaagagataaatgaaagcaattaatagaataaattgagtcattattctcttttgaatgttactgcatggccaacagcctttacctgcaaaatgcatacctttgactagtacacatgcatatgctaccaagtttgactcactgaatcttctggaaggtccacacaagaaagccccagagaaataatttcctgaaacttgaactgtagaaaatgtgttctttgtgttaaatatgaaatcatactaattctaacatgctaacttgaaggaccggatgttacttgcaacaggtacttctataatgcaacttaaataaatgagttcagtttaacattacatatttctctcaaacccatgaggtcagagtctaggctggtcatattgggtgagttacaattagaagtaaaacagatgagagtaatagcattaatagaattaaaaagtaccatcagtgaagggttcagacttggaaatgaattgaaagtggaatctcagatcaagtggttaaaacccaatgtccaatgagaaaatgggatttcatgctcttcagactcctcttagcttctccaagcacaatattttcccactcactccatcaaattgcaaaatatttttaaagtgagatctggtttgtggctgaaaaagaaaattacacagtatctcttgggttgttctcagcctaaagggttaaatcctcagtgtgccttttgagtttttcagtgatagaaaactacggaggttgtgtaaacctttgcagaaatgaaacgcatagaaactctttctgtgaccctgagcaatcctgacaacacatgatgcacatttgagaaagggacttcctcatgaatgtgagaagaaagacttagaaacgaagttaaatgaagatgggagcagcattgctcacagaaggaagatcaaacactccatagaaaatacacgttacagtgcaattgccctctgggagtcacaggattatgaaagtctaacttaattaagggagaaaataggtcacatttaataactacatgtgtgacacatcattttgaactatataactgaagaggggagaaaaattaagaaatcagaaatataagaaggcatgcagagaatgcataaatgtcttcaacttcatctaattcaggtgttttttattttgtatgtatgaaaaattcaccattcttctaatttaccttaagcacttgcagtatacttgaaaaggaaatttcagatgcaaaaagaaagaaacaaactggccttacccaattttttttaaactaaattaagaggtaataaatattgtcttcctaaaaatataccatgcatatttctttcttttctttccctcatgtcatcaaatgacagataatcaggtattgtgaaccctgcgtagaatcttcccctatccagggctcaatatccctgtggggtcgagttaattacaggtatatttcctttgcaagacagtcacactctgtactgttgaagacacaattaataattgaacaaagctaaccatttttttttttcctttcacatggccacgggttgcaggcagctttgctgtcacacagggagcagagtctcttctttgggtctcttccacatagcttgtttgtaatctccaagaaagacttcacattacaggctgaaaagaatcacctacggtttccatattttgaaagaaatttttaaaaaccatgaaaacaaacaaacaaaaatcctagtttcctttataaaatagcaaaggaaagttctctctcctgtcaccaggaatatgattatgatcagttggttatttaggtcacatgtgaaagaaatgaaagaggaggcatgggaatgtaagggagaatagtagtctgccctcaagtctgcaaacgcaatagaaagctagttttgcatgtgccagaatagaatctgacctacaaagtgggcctagatagaagactgtagaagagtaaagttgtttcctttgagatgtctgaaggagcttggtgggggatatccccaaagccctacttggccatggatgagtgcagcaaatccttgtcctatgtcccaagctatggccttgagcaggagtctataaacttccctgtaaagggcctaatagaaaatattttacatttgtgggccaagtgatctttattgcaattattcagtgatgctgttttagaacaaaagcaaccatagagaatttgtaaatgaatgagcatggctgggttgcagtaaaactttatgtgtgtacattgaaatttgaattgtatatatatagatacagatatatttttgcatgtcaaagaaataaaattattttgatttttttcccatttaacaattaaaaaactattcttcacttgcaggcagtacataaatggagcagactaaatttgatacataggctgtggtttgctgacctctgttactgactattgagaatccctgtgagtgtatctattttcctggttgatattgaagcctccggggtcctctgagtttatgtaaatacagcctttattcttgaagacatggcttgtcctctggtcttttgttgacttgaaacatcatagaaaaacaagctattaaggggtcaagtcacatgttcattatcatgggaaagtttatgagagttagttatgactacccaaactcctagacaaggtgggaaaggctctgaaactctggttccacatcagaagttttataaattcaagggataaaaaggaatctatctttaagttcagttcagccatagcaaatttttcttgaaaagcctatttgctagtcagtattgtgccaaaagaaagtgtctttctattaatgcagttcattatttgattataacttgaatagaatctttcttcctttctaactcccatttcccttcttttatctaccaccttgttccacgtaagagtaagaaattataaatagtatatttacatagacatttaagttaattagaaaaggtgagacaaaataaaaataatggtaagaaaacaagatgatagcagaagtgtgatctgaaatggacttgatcccataaacttctacatagcttgtttataatcaatttttaatgtgtaatttatgtataataatttatatatttttacagatggtccataaatttggctgtaagtttactaacagtcaaacaataaaggacatacaatcacttatgaaaattcactgggtcctttcttaaaaagcaaacgattgcttaggaaaaaagaaagtagagatattgaaaaacaaaacaaatttcctcaaatggtcttttcaaaggaaaactatgtaaaacaattaacaatctctcaattataacattacagtaaacacaatgattttagaaggtgtcttttataatatccttaaatatgagccaatagcttctataccaaattgctattcagtaaaagcaatgctacttgggacaggggtaggtggcatgggattggagccaacataatgccatccaagtagaacgtgctctgaaggtttaattcattccaagggaaagatataatatctacgttcatactcgagacaatcctttatacatattttttttccacatgaggtataaaataagtatgcgagtcaatgagtttaagattgctctcccaaataagtgtctcatgtatatattatcaataaatgagaaattgcctgtgttaataaggatgggttttgagtgacactttctcaagaaaatagaggcctttaataagaatacccgcctaaatataaaaccattctataggttggtccaaattttacttgagaaattaatttaggatctaacatcaaagagaggacccatcttttcacaccacacaatacagatagttttaaagacattataaacaaatactatcctggtcttttagaaatgtctcagtttagctcctgttgtacatccagtcttgaataatatttttatggtgttcattttaaaatgaatatgttgtaacaaatctctagttacttatatgaggaaattttaagtgactataagatataaattagttaaatttgtgagttctctacaaaatcaataatattttataagaataattcacctattgcctatctttctggaagatttaaatagaaggctacattctataaagactgtgttatttgacaagacatggttttgcataccagaaaatgtaattggtagagtagaggagtatgtatgtacctaatcttaaataatttgctcaaacatttaaaaaaagttcaaaaagcaggaggcctgggaacctttttatggcgatggtggtgagaaggggaaagaaaggatgttgaagacattcctgggaaatgagtttctgattttgactgaattagtatcaatagctgggactcataatgagttcatgcagcttagtccatgtctgatgcacagaaccagatgccaagggcaggacaataaaagtcagaaacaattctgtattttcttgatagatttcttcacaaggtgctacaagttagaaaactgtagttaaaagccaagcaaacaaacatacaaacaactatgtaaaattaattcagacaaaatattgccccaagacactgaatcaccaaactggcatgtattttacatataatatcaagccatttaatgcttctgtatttgttgcattgtgggtgggggggggggggctgttctattgaaactgaaattttacagatagatagatctcttgatagatagatagacagatagatagatgatagccagatctacatatatattcagtacaatgattgtaaactttatagagattaacacgttagcaaagaccatgaggaccctaaataaataaaataaaaaagttgccattctgttagtattttaataacaagatagatgcatgaccttctgattcaacagaatttcaattctgattctgaattgaattgaaatttctgattcagcagaattccaggagcatgagcatattttaaacagcatgtggcatattggaacctggagtattgcttaccagttggtgtaaggtgtctccaggtgataacaggttcaggacggccattggccatgcagaccagagtcacgttgctgccctcattcacagtgacatccgaggagatattggagatctttggtgggactgtgaaaacaaaaggaaatggaatatgtaaccatgtcagtaagattaggcttgtagccatacaactggaagtggcaaattcaaggttttataacttaatttgaatttctgtgttaagaagtaggatgcttttaagacccatgcttgccatctgcttaccaaatccataagttgtcctaaagcactactataaggtaagaacacccttcacaaagccatctgagtgctgtaggaaatacacaaagtagtatgatgaaaatatcttagcttttaaaaatactagaatggaccttatttagatattagacagcatgcacatttatgtaaattaatattatcattgttatttaaatttattttcttatgtatatataaataaatataatccaatgtcttctccaagtaccagcaaaagaaaaacaatgctatttagcataagattacattactgtattattaagatgtggcaatacctggttacttataatctagcaacataatgaacatggattaatcaccacaatagaaagcatttaaatatcatctttgtgtataacaggctgcatgaagtatcttagaacttaaaacgtgaattaataaggcctatctcacagacaggtagacattcaaaaatactattacttctagtacttccaacaccactactactaacaatgtaattaatagctagctttaatcaaacatttattatacctaaaacccaacatagagtatttaacaaatattacttcaataacttcttacaataaagaaatgatatcctatgaagtttttatttatgggtaggaaactgaggcatagagggggctaggtgaggggcagaaaatgagtttgaatcccagccaattcagggcctttgctcataagcactacttgaatgaaacttcctcttcacaacccaggctaccagatggctgaaaacaacagaaattagtttttggtgacgtgagaaatgagtcctcaagggctagctgtactgccgtctgacttccttcattagtgttcagggtggcaacattagatcacacgtcggtaggcttaagtggggagtgaattactcacaaatttcatcacagaggttatgcactgattacaaatagcagggtttatagtttgactgtgaatttcttcttttttactcacttgtttgagctgtccctgagaaagtatgtgtctgggggaaggagaaggacaaaagagcatgaaggagttcaataatgaattgtatcttttctcattcttactgcccattagagactctgtgtagtgacgaataaaacaggaacattttctgcttgcagaagcaagcacctgacagccaaacgatccctgcaaatcttcattaggagacactgatggtacttgggcaactgactggttcagagtgtcacaaggaggaagcaggatgaggaccctctccacctcagcattccactcttgtagggcctctgggtaggggactggtcattaccagtcaaacccaatggcagcagactgtagttgattccaaatatttagcaatctctatttacagagttcctaatcctccctttagctattggggttaagggtcgttttctcatattcacacactgtcttgcaatatgttcttacagacttttgcagtgaaaacctgaaagatcatatacattttacagggaagaatatcagacacagagaaaaatgatggcttgttaaggatgagcccaccaagaactatggctggacttagaattcagagctcctgaatgtccaattattccgttatttcgagttcacagttactaattcccagatgagtaggctagtgctctgaacatcttcaaaacaactgcaatgaactataaatcaatgatagtgtttcagaacataatgtggacatactaggtgtcatcctcaacaatccaaaacctatcatagaaagctatatagtaattctaagagtccacattactaaagttgtagttacatgtgaattgcaacgcaggacacagggtaagaagaaatatagatatgttctgataaaaaaggctctatatccctaatataaaaccatgcaaatttataaaacagaaaaaaaatccacaactaaaaaaaaatcccagagaattactacctgtggtgcaattgactcacaatctctctctctcggtgttttttttttaaataaaaggagatagagcgaagactttgcatttacatgtcacaccagttaagccacttgttcaatttcacatagacaggtactgataaagttgggaataaaatctagaataattgactacagggctatgttctggccaccaaaccacactgcatctcctaattaaggacaatctattcaagtactgagtctcagagactggagatacagaaagtgtttgtgctgaatagttaggaatgtaatcacgctgtatcagtgtatcccatgtgcctctggatctctttcaatgggtcttactccatcatttgttttcctactttattttgtactagcttcctcccataagcatgtacatatgatgcagtgttttttgctttcaaaagaaatttctccctaaactcttattaacttcttttttttttttcttttttcctgtgacatagctttcaggagatcctgagaacatgtgtcccttttttatttttatttttttcccatcttatttactttcaatctctctttccaaatctcttgcgggaattgttctacaccacatcgtcatttcccatccacacctcaaccttcagtgcaatctggattctctccttaacctcaaatgaaattactgtcaggaagctcaccaattatcatattgtttctaggtctatggacaatttctgttagcttgtttttctctgaagtatttggctctgttgatgctccttccagttgttattttttatttcccttggattctaggacaccaaacttgactgtttttcctcttatccttgtagtcagccttctcagattcactcttaagcttatcttgtcctttccttaactatctgtatttaagagtttgatcacttacctctgtcttcatctcaatctatacattcatcgaaggatcttacctattttctagcttcagaagctaaagcaatcaacatctgcagcccagatatttttcatgattgttatacctacattccaatggactattctgtatccctattgtttgcctcacagacacccaagtttcaacaaactcaggactaaagtcattaccttcattcccaccaaacacttgtgttttattatcttagttaacagtatcatcaggcagaattgtctaagcaaaaaaagcaaagcatctcccttgactgctctctccccttgaccacactcataaaaaattgatcctcatgttctgttgtttatgtcatgttctgtggtttatgtcatgttctgtggtttatgtcatgtatggaggatcaattttatataagcgtgatgtatatatacatatatatgtgtatatatacatatgtgtgtgtgtctctctctctctatatatatatacacacatatcagattcattctttactcccagtccctactcccactaaccttgtttcagacatcaacatttctttctgggatggcctaaattactgaaatgagaaaatattaaaaatggtttcggccaggtacggtggctcacgcctgtaatcccagcactttgggaggccgaggcaggtggatcacaaggtcaggagatcgagaccatcctggctaacacggtgaaaccccatctctactaaaaatactaaaaaaaaaaaaaaaattagctgggcatggtggtggaaacctgtagtcccagctactcgggaggctgaggcagcagaatggcttgaacccaggaggcggaggttgcagtgagcccagatcacaccagtgcactccagcctgggtgacagagcgagactccgtctcaaaaaaaaaaaaaaaaaaaacggtttctttgcctctagccttcctctcttcatgctcactgccacacattcaccacactacaatcagatatttttttcctaaattgcaaatatgaatataatatctcttgattaatctcattgtcctcaagataaaatccaaacttttaaatacggtttaataggtcattcatgattggccctgcttatctctccagcctcatttcctactccatttgcattgcatcatctggtgggatcaggcaaattttggcttctgaaatgtgctctcctcacactctggcatttgacattatatttcttcctacatgaaatagtctttcaactcttcatgcaattaccctctttcccctttcaaatttcagctcatcagcttgtctccttacttgtttacgaaagaccttcctgtcattccccaccctgcctcccactctgctcctggatccacaatgggtgaaatgccgtgctgtgttctcacctcatgccccactctggaggccatattgggtgaaatgccctgtgtctcaccctcacagcactgaatcatgacagctgggttacttacctgtgcctttcactaaactgtaagacgcacagtgttttctaaaccactgaatcttacagagcatggtgcttagaacatagtaggtgctcaaaaagtgcttgaaaaaaattcacttagtttttcccaactctttacttcactcaagaaaggtatctcacagaatttttgtcagaaaggaataagttttcattttgaaccagtaaaatagagctcttatcaatatttatttagctacccctttagtcatctatttcactatcaacttatttgactcaataaaaaatattaaccatgaggcagaggagtgtctgtatatttcaggaacataggaaccaagaagaacttggtgtctaacttcttcaactacaggcttttctgagttttaacgtctttgtttctttttctgtgaggacggagaaatagatagatagatacagatatgtctttcttagtgtaatagtttagtatttctttcctagtttcccatagccctccatagaattaagtttagataatcaccaataacatcaggtggcaattcaaaaattttattctattaccctataaaatctttataaaaattctgggaagtaaaatgtattattattattattatcattatcattattactaccactactaccatttcccacatgtgggcaaaggggacaaaaatgggtaaatatcacatagctaatgaataatacagctagaaccaaaacctacaatttgtatgtttcacaaactttactcttcctctagatcatattcacttctgaaaaagtggtagagatggtattttttctttagtttaattctcaggagaaatgactgcctagaaagtactgtttaacataatactcttatttgaatcagcaaatgttaagttttttatttttcaaaatcactgtaatattgatttatgctgaattattgcagcattgtagtactctgtgtagtgttttcttttctttctagacaatcccttaacaattcttatttacagaatattagtgtgatttattatattttcctatatataatgccatgaaccatttattcaatgttttcaatctattcagtttcagtgataactacatttgtctggattattttgtttttcttactgattaatgagagctacttatattgtaaggaattgaccttttgttgtcatgtagtaatatttacaatttattctttggctcttacttttttgtttatgattatttttgttttgctgaagtttaaagcttctttgttgttgtatctattgatcgctcttttgttatttcttccattgcttttgtgcataaataatgcttttccaacataagaacagttaaatacttatctcaatttcttctttttattttaattgtttctttttttatattgaattctttgaatcatatggaatttatttctggtatgagaaataatcagagttttttcctccctataattttttagccaatgtccacaataccatttgttgaatgatgtaaagtgcatatactcttttggttttcagaatcaccctataaagtgctaccaacctggccagcccagtatttctgggaaacatgtaaatatagaccttacttaccatgctaactaattcaaccaaaatatttttaaaatatatcattaattttttgaataccacactattatgtgttaattttaaaatttgaattattaaatgggtaatattctttattgaaatgcacataaattctgcattaaaaaatacacatttctttcttttgtttttctgtgtgcattggtgtgatcatagttcactgcatcctcaaactcctgggctcaagcgattcttctaccctgacctctcaaagtgccgagattacaggcatgagccattgcattgggcctacatattttttttctatttagtaaaaatttaatggtgatttctgaaataatgccaaaatctaggtgcacctaataatatagactccctcagctatgcaatggggcaggcttaagtaagatcatgacacagtcagtctggctctgccacctgtttttctgtccctccttattgtctttgtagttcctttatccaccctctaccagatctccagggtctgccctgactcttacggacccagagttgactgtccagagttgtttgtacagttctctaggttcacaaatcatcccttcttctttttgtgtaagactaacgtttcttatatatgccaaaaagtggaaatggagacaaagtcagggacataagtggaatagacatatatgatttacttgcccagaatccatgcctctttcttctggtaagacatcctggttttcctttggaaaaaccactgcttacccacagctattggtttgttgggactcttaatcaagtgaccaattcttggacaaggagtgggtacaagacctaagctggaccattcaaacatccccgccttggaacttggtttctatgaggaatgattcaaaagaggatgaaactgacttaatctcttgttggcagactgtgttaatggcctcaaatctgtactcctccctctatccccatcctttgccacatccatgccctcctacagagggtgacatactttttcatccctgggtcatgttacttgcttttgccaacaggatgtcagcatctggaacacaagcatagttttgaaaagtgctggcaccattgaattcacttgtgcttatgcctctgccattgccacgagaagaacatactcagctgagcctcttaatcccaggagaaggatgggagatgccagacagaattgtcagataaaatagtgtacctagttaaatataaatttttgacaaacaacaaatgcttttttagtataaatgtgttccaaatattgcatgagacacatttataagaaaaattatttgttgtttatcccaaatccaaatttaactgggcatcctttatttttacttgtcaaatctggaaaccctgggagaagagtcacctcaagaaattcagcctaaatcagctgacttccccacttgtgcaaaataaagaataactattattttatgctcctgattttgaagtgatttgttcagcagcaatggttagtacacgtcatgaaagagtaaccacctaaaaggactattattcttcactagtttttgccactaattatttgaggttattatttggatatccagagatacggggcttgtgtacttgctgaagtaaagtttttctgttttccttcaattctgtgttatttcatattcttccaatggaccacctgctttatacatcagactagccagtcaatttctattgcttaaatcaaagaatcctaatttttgcaaagtaaggattagccataataaggggaaaatttgaagaggggactttccacagaggtaaactgttgtcatctctgcctagatactcctttggcttccacatgctagctttgttgcacgttaagcattggttttgtatctgtcagtttggttgctttaaaacaaccttagatctacaaagccatttaattccagctgtgaatgttttaatgcctttatacttggttcctaactgaacaaccatcagagggaaactaatcagttccagagtaggagagaaaagtggtcagttggctcatttccctaacctcaaataattagcggttattatttgtactcaattcaaagtgccatttctaatggtacaaattagcaacaaattagtctcattagttattgttcattcaaagatggggcaaggtgtatacactactgtgtatgtggtgatggtggggtcttaaagaaacaccaccaactccctaatttttaacttttctttggtacagcaggaaaagcttaagccctgtttatttgcatatgtcacaggctatgaaagaatatggtgtgtctatgtaagaactgggttcaaaaatctacacaatgtttcttgagcagcacttgctgtatttaataagcatactcccaggattcaacaatgagaataaaaatacacaatgcaacacataaatgccatctagtgaaacatcaaacatccatctaacctggcattttgtttctgaaaatgccactaaagcatgttttgctgcatggtgtgggagtttccaggatggatgacaggactgggaaatgtagcacagtgtactagattgagagccaggggatttgtgatcctgcccagccactagctcacagtgcagcagaatattctctgacatttgcttttgaatctccgtcatcaggcactttgtaggtgcttaaccaattttgagtgaataaatgaccaaactataacaaattatttaaatgctttagtttcctcacctagcaattggaggtacaaggttggcattaggcgatattatgggattgacattagggtcaaataagataatgcatttgaacttggtctatctacaaagcaataagaggtctgacaaatgtacctattatttattacatactaaaactagctaataaagaagtgttggcttgagccctcctaggataacatggtaaaatagcctatgcatttctgtggctaatggcattctagttatatttttgcagactccatgattgccaaaaggtgtagataattgctataatttataattaatcattaattgtggcattaacaataaattaccccaaagatatgtattgagcttttatctactattatggagagctatgccagtatgttgagccatttaatagatgtctagacactttatatctccaataaaaagtgacacaaaaatgcaagaatatataccatgagtgaaataattttcaccaaattttttagaaacttagctgactcctttttccaagaaaaagctgccaaaataaaattgtcacaattttacatactttgtcatgtctccataaaaaattggtcttctttaatttgttgtccttgtaaacaacagatattgccaggtgatttgtggctgtcattggagtctctgaagccttagaccttgtagtagaatacaactggcagtgagaatatcttttccactagcactagttcccacttctattaggatccatttgcaaagcaagaaacatcagcctgtggggtcggcatttgaatcacattttactggaacatgatttcatttagacacaaatttcatgggaaagtagaaaaaatacagaaactatagcttctttgagtgtcaggtgaagctgagggtagaaaaaactcattataagtatcagttactcaaatttctctgccaggagtgattactaatgctacattcatgcatgcattaagtgatgatccaaataactcaaggtaagagagataatatgctaactatttagaagaaaagataaaatgtatgcacaaaacaaagcaatgctaggtaccgtgtgtgttaatgtagtaaactcagggaaactggagctggaagctaataaaaatgacatattaagacaatgtatggtcaagaaaaagtcatctccctttaatcctcttttcatcagacaggagcagtttctgaactgcacaagtaactaaaagttagtgcttgaagcttcagttatgtagtcctccgagatgtagccagcattttactatgctgcctaaaggtgtaagctgggtaaagcacactcttttgggcctttgagccctacattattacattctcaagtggccttatgagccccaagcactgtcccaggaagtcagatgtacaacaaaacagtccctagagactcatccagacagttgctaccatcaaaaaggagggttaatttgaattagatggctctaaataacttaaacatggtagccatgggacaaagaaatgttacgtagctcatttatataccaaccagtggtgaatgttctctgctggtgacacatgtgtagcgtggatatctgcaaactgagagtcccttagtctacctaaaatcaaggtatattaaattgaaatttttctatatgtattaaatgttcacgatcacctcagaatctaagcgagtgttctagttcagaaaagggacaaattatccagacaccagcaagtgcattcagctaagcgtgtccattattgctgcttcagcaataggtgcactctgtgtgatgtcaagtggctgttcccatggacgggtcattgccttgctaaataaaagcaaatggaacccttctgagtctgctcactgaagctgctgttactcagcaagtcagcaacttctctgaaatctcatattcccagactcttattccagccatttggatatttgtttttgctaatttgggaaagcatacagatgctgatttaagtagatagaatgaataaaattactatctttcctttacctaggcaaaataacttttatgtttctggtactaacagaacaggatttagatactgtccaaccagagcagatggttttacttggcagaaatgtgggtagcaaacagagggaagctcaaaaaatatcaggctaccttgggtaggtggcaaatagcaattgaatgaattccaactgcgaaatggcaccctaagacattatcagagaaaagaaaagtgtacttttcccctttatactccaaaagatatatttttctatgtgaaaggaagttgcatggtataattcttagagcagatgaaaattcgggttgcattcctggcatctaccagaaatccactccttattccaggggaagccagtaggatttagccctaaaacatgacatatccttaaaaacttcaaaacatgtcatgggcaaccaaaatatttttttctgtgttctattaattttgaattaatttttgaattcaatttttgaattgaaaaaattgaatgtgaggaaatattgcctatatcccatgaatgaattatttagctattaagataatatgataaaagataagtcattatatcaaaagcaaggaagattttaaaccagacagaaaggacccataagtgaatagaaaatagaagtataaagggttcggggaacaattccctgtctattatgcttaaggatcatacaaaacaaaatttactgagtgcctacaacacataaagacattgtgccaggcatgagaaaaggtgatgaggggataaaacaataacaattatgacttagatcaaccatgttttcttgtttcagcagaagtaccagcaggaggttatcatgaaaataatatgaagagttactcttactttttcaaaatggcttactgttcatctaatttttcatttcattttgggaatcagaaatgtgtagagataactctggtgcttgtaaggatctcttaaatgtaatgatttcatgcctacataactagcctaaattctttttttttttttttttttttttttttttttttttttttttttttttttttagttgcttaaggcatacagtgttctttgcatgtagagacggaggtagattctaacagaaacaactagggtgaactaaagcatgcctagaatacaatgaaaataataaaagttgttttttgccactgcttaagggcccagaagatagaatatttagaccaagaatatgattcacaggaggttttagaatttctttctttgcattgcccctgctcaaagcttaccatgaaccattttaaatagaatgtggaacatacacattatttccttctaaacaaatagagttaccattgtgaattaattaatacattcacgtcaattttaattgtttcaaaaattataataatgatagaaaacacagtagttgctgcaaaggttaaacatagctaggagagatagaatttctgtaattctaattaagtttgaaaattccagagaggtacataatgtcattcatgcagggtttgggatggggataggggagagaaatcccaaacgaaaccttgaattgatgaatatgagttagattttttttcctttttatctttgtttgcccttctttggaggggcaaatcaacattacataataaaagaaaatacaaacaagtagaaaagtgagaagaaataataaaagtaataatgacagtaattaataataatatctaaggtagcataactttatacagtttgcaaagcactggtatatgccttgccatatttgatccataccacatgcccgtgtgatagctcagacaggtatcattaccactatgtctcacccttacattggttggacaactgaggctcagtgagtttcagtctcttgactgaaatcacaaagctagagagtgaaagtactaagttcatgaccagttcttttgattatgtcaagatgaaaggaaagctttgatatttcacaaactaaattatataccactgaccaggcatggtggcttatgtctgtaatcccagcactttggaaggctgaggtgtgaagcagcagtttgagacaagcctgggcaacatggcaagatctcatctctatgaaaaatttatggaaaaaaaattagctggacatggtggcacacacctgtagtcctagctcttcaggaggttgaggtgggaagattgcttgagccagggagatggaggctgcagtgagctatgatcatgctactgcactccagcctgggtgacaaagaagaccctgtctccaaaaaaatttaaataaataataaataaataattgataactgacaaattagatgctgtcatattgattaaattaaacagaggccaagataactggggcacaactagagataagaaagtctggttaggtgggtagctgtgctcagcatagaaatggaaatgccactgattgcgtagaagcaatgggagattcgtttactgaagttagtttttttcctgcattattcagttctaagattacatggttaaggatttactttctgattttgaggtatttttctaaataatggtgataatattcatatgtgcaacttgaaaagcttgaacaattttgcaatggaaattagatccatttctatgagcctgtttactgcctgtatcacttccctcaatttggccaacatgaaatggtctttctcctctctcccttctctttttaaaactcaagaaggggggcatggcgatgatggtgagaaggagcattccatctttgcttccacaaataaatcccaaatggggcaagcctctcattaatcttgagctaaatgtgaagttagacatggaggggcctcttgttccacctgtctgttcagagccctgggcatgttatggagaaaatgtcaaaagatttctcttctcttacttctgcaccctgccgtgatgttttattcaaacctctatgtcctaaggaaacaaacgctgcctatagaaatctccccctcgtggctcccggtctcacacataaacacgcacaacacctgtgtttaggagagctgatcaattctcacaaaaagcagtctctccgtaacatgctgcggggccagagcactctagcgaatgatttctgtggcagccacgaccctctgtgactgtgtttgtatccatctggtaatgcttgtgcttatacaacatgatgtgtccactgacccttccttccaacaagaaatgattttaactgccactggaactctgggttcatatagaaaaaaaacctgactgctggaaaaatagggctgggtgtggggagaacgtgatgcagatgtgcctgagaatgggtcggaatcagcagctcgtccacaagggaagaaaggaggaatttttcttgcttgactttgcatcagctctatatttggtactgcccttgtggccagcagggatagtagcttttccatagggtctgggctggaaatctatagagactacatttgagtttctatagaaactctaaggaaattgagcacaggatgaggaaagtgagcggctcccactgtctctatgtcccattacaagcacatgagacaggttacaaagcaagaattaggacaagatggtcatggtggtcatgcaattggatgcacattggcacagtcagttaaggtacctgacatgagggatcctttgttctcagtgagccacagactgcacaaggcagagacacatgcagcagcagtgagtaggattcctgtttttatcggttccaaacagctccagatggactgagaaccaggcctggtggccaccaggaatattcttgattctcagcccatatctcttcctttttaatccatgaggaaagggcgagctgctccctgtctgttcctctacccatcctccctctgcctttggcaagtcacttaacctcatctggaatataacttggcccccagagactttggacatagggtgttttatttccaagagtcagacttgtcataccagcagaaagcacagtgcctagtttgatatggcttttcattagctgtgtgataagggagttaacgaatcttcaataccatgtgtaaaattacaaggaaacaatactcagggccacttgtgattactttgctctcttagccttttgctaatgctttttcattaattatacagccatcacatttctcctgatggtaaaataccccaagtggctcaactccaaactgcaaatgtttagctatttgcccttcctctaatgattacaggctgtgtgagagaacataatattagcctctttccatgttatgaaaattgaaggtatgcccagagaagctaaggtttaagcctcaaagaaaatcttctccaacatatttaacatatatatagtgttaccaaagaaacgtaaaagaatgcaaaacatctcctctctactgacttttcatgaagctgcacaacacattaggctttgccttatgctggtccctctgatggctttgggagtcagatcaggtttcagctataagccagctggtgccatccatttaagggaaaacagttatgtaagtgaaaaagattctaatcactaagtctaattacaaagtagagtaaattattatagatgttttttaaagtatcttaaaacactgtaaaaaagaaaaattaggaaccaaacagaaacctgctatgctggtaattgataacatgtttgggattaagacagtcacatgttaaattttatatgctactgctatttgtgaaacatgactcctcattcacacattaaaaactgtataacctttctctctgtttcaatcagatgctacattgtttgactcaaagtacaccttagattataggtcctaacctggagtaatagaaatgtttcacttacactggacaaagggaacatcaaattagtctactaatatgataataatttgtcaagagaaggaaaagggggtggggaaatgagtgacactttacatagacgtgtgaattttccaaatgcagatctagcctctcctatttaacatctttcattaaaatatttcaaatgctacacattctcctaattgatgcaaaaaaacaaagacaaacacattaacatttaatccttggtttatacactaggcttccacccagatatttcttaaattagctctgtttatactctgtccagcgaccatggacctcaccatttagtccatctgcttcctggaaaaatgaatgtgtgtgctcttaactttcaatgtgcttctgaatggtattctcaatttattgtctattatgtcattggacgttgtggagaaggctgtcagtgctcaccaagtatctatgttgcttctcgacattctccaacctcttggggttcctttgggaccatacaactgggctgtagccaagaaaatgttgggaaatgtgaggtaagcaatatggaggcctagcccttaaataaaagccccttcttaccttgtcacagcgactgtggtggatacacgatcaagaaggcatagctgctacgtaacagaggcatgcataaactgaactggactacatgagcaagaaataagtcatgagaactcagtagtatctgcttcagccactaacattaatgaccaaaatgactctgatgaaagcatcattaagaagagaaaattacacaacttttatttaggagtgtatgggtctgaaagtcagaaacttgatatgatgtcctctcagagtccctcatgtttcctgactatgaccactgaatggaaactctttcttcctccattgaatggagactttggatgttaatgagtacacaattaatcctccagtctactcatccatttcttctttattttctgacgagttatagcctcctgcctgacagaggccgtcaccttgtaagagatataggccttataggaacttctctgctctgtgattctgaagccacagttcagagtcagaaattgatgtctttgactaattctgtgcctcacttttgtcttcactgcctgtcaggcattcgttatctgtgagcccaccccaattataaatctttggtgctaaaaacctgtaagtggctacttccaggcccctaacctataagtcactgagcctggaaatttggcaatctcaaaatggaattttataaaatgcatagtgtcaaagaaagtattctgtaaaatctaaacaaagataatataagagtattattgaattagcaaaatggcattctcatcaatagagtcacaacttccattcacaactattaagataatgaacagtaccaagtatttctagaaattgcttgaggaaatattgtactaaaaattcttactttgcagtccaggtactataaccaagtttctctccatttgcatatgctagctagtaaatagcatagctgctggaataaatgagtcctggataatatttttggctttctctctgtcttggtatcttttgtacctgcagatctttttttcttcctccagctagaggagaaagacaatacctcaggaattatttaaggaaaatctgttacataatcaatgcaaggactcggggacctctgtattagtttcccttactgaaatacaaaattatgctttatcagaacaaataagatttcaaacataggtcaagtatgttctcagtttcccatagtgaaacaattctatatttggcattttgcaggtttccttattaaacaatcatttcttcataagaaaaacataaaggaatttcactgaatatatttctagtacagaagctatttttaaggccaaccagggaggatttcaggataatagtgagagggacaaactgaaaatgtgtgactctggatagaaaataagatctggcctacataagtaagcagttatctaagagcagtcccattcactaaatgcaaggcttcaggagacctagattttgagccccatactttctctgactctcagtagggctccttcatgctacaaaatctctccatagttcagtctctttatctccaaagagataaaaataacattccaattttctagattccaggacagacacaaggattaactaaatcatttagggaaagtatattgggtatatatgcttagaatattttcttttatgtaatcttcttctcagaaagcacaaaaggaagataaaattgagccagaattgtatggtaacattactgatttttatgtagggcttgcagaatatgtcccatgactatgtggttatacttggcctagcacacctttatagtttgtatgtgcatatatataatcatatatataatcatactgatatatatatatcagtaatgtcctatatgacaagattgtactcaacttcagtggtataagcttattctgtttagatgagcattttagaagtgaaccaggaggactaacccttgagctgaatttccatagtctcatggttaatgcttccttatatggatgaacataagaggccagggatctagaataaaagatatgagtgtgatcaatgtcctgaacaaaggatgtctgaagatccaagaggatggggactatctctttcaatatgtattcatagtgtataatttggtggttagacactgggtttcagagccttgtttcagtcccagttcctcaatttactagctatttaatcttggggaaattacttaatctttcagttttctcacctgaaggatgggaaaattaacttataggcctttacaaattttaaataaaataatgcgtgtgaaatacatgatgtctggaatataggaagtattcataataaatgtcactaatctctgaagacgccagtgccacctgattggaacatcagaaatagtgatttgaaatatttctctggaacacagaaagggaaagcatgaataaatgtatcagtgaaggccagagacctctctctggacatacacttttgggaggtaacaggtgaccagcaacttttatttacttgaatctgtaacatctctgtagagaaaactaaagcattaaataggatttatttcttgaaccgtggaatgccttgaatactttctttttatttctaattcctttgctctcagatgagagctctctccccttctctgagatgtatgctatatatatacacccgcctctcattctgagatacacactacagtcacttagcacttcctcttttaattgaaggctgttcatttggctggcctaaagtaagagagagaagtgcaagtcagaaagaccacgaagggcaacagaatagaaatattgctcaaatgcttgtcattttctgcatgttataagacaaaagactgagatcttcccttatattgggtaagagttatagttgattgagaaaccacaattgaataatgtttcttttgtgcaaataaaaataccaaccttaaggcagcattagaatactttgcatagcatttacttcaggttttcatgagagagggaggataaaaacaacctatatttgatgcagttccaaggtctttctttttttccctgccagtgtttgcaatagcctatatttaaatgtatagaggtgtcttcagagaaccacaggcatagagaattagaagtctgtaactggaagcatctttcagggttgagaaatgtaagctattgtgaaagctcaacaatacatgttgaaacaaatcttttggaaatgattgaattgaatgttttcacataagcaaatctacatttgtcattctgaattctttttatggaaagatggtgtttccccctcctgtttaggtaattaaaactagtcacttgatgatcattcattatcaaacatttctgcacatggcaaaaaatgctttggggatgagaccctgcttatacaatttcatccatcaaaggaagtctttctccagaagctattattcactctgtgagagtacatttaaaagcattacttcacacctaagtaacgtgttaacagcacagagtgtctctcccttggtggctaggctccagtgcctgtattttatggaggcaccatgcaccatcttgaaaagctggacagcttccagtagcattagggtttggaggaagagctgttgctccttagaactttacttctcttgggaatattattgtttcaatttattttaatgcaatgagtgggagagaaggtgggaataaaatgcctacacagaagcctctatctaacagtcctgctgggtggggcattacaaagagaggccacaggaaaacctttgagagtttggagcctgctgcgtgagagagataaaagtagaaacagcaaattggctgcaatacgaatggcaggtgcatttgttcactggaggcaagtttggcaatttagttttcaatgaccagcttgtctctttaaggttcacctttcaaagtcctcctttttgccctcaacatacatcgctaaagccctgtctcatcttgagtccccacgctccaggtaacagcagctctttactctgcctctctttggggggggaaaaaaactggtccccttttctacttactgggagtggaattaaacagaaggcaatggaaagctcgctgaagcacagtgcacagtagaatgacatacccaaagagaaagcaaattcctgttatgtgtggatagttttatccttcctgggtaaacacagttgaggggaggggaactctcaggcaaaacactatgattctgacctcactccagtatttctatagatggaagaaaattcaatgcgtatgttcccactgccagaatgggacttaagagacacaggtcaagggagaagaattcagaatggaaagctgatgagagcaatctgtcttcgctgaaaggagatgaagggaggtgacagttgtccaacggtctcagataagcaaggagaaatgactgctatctgtgtagagctcatctggacaaaaaaactacattcatttttccctctacataaagcacacataaccttgaaatgcacatgctctacatgccatctcttgtttatttgtgtacccaccattcttattccattggttgtttctcacttctgtatttctgccattattaactgccctagcaattccacaaaagaagtgaacataatctcaaataaaattgtgataacaccgtttggaatacctttgatggaatgtaggtggccatggaggagtctcccaaggcagcttcatgttaggaaacctgaagtggctagagtaaatgaggtcacttttcttttcttctctttcttccttttttttcttttaagagacagggtcttactctgctgcctaggctgaagtgcagtggctcatgcctgctgcagcctcaaatctctggactaaagcaatccttctgagttgctagaactacagatacatgccgccatgcctggctaatttgttttcttaatttaattgtatttatttatttacttttttggagacagggtctcactctgtcacctaggctagagtgctgtggtgtgattacagctcactatagcctcaacctcctgggctcaagtgagcatcccgcctcagcttccagagtagctgggaccataggtgtgagccgccacacctggataagttttaaactttttgtagaaattgggtctcactatattgcccagcctggtctcaaactactggcctcaagtaatcttcctgcttcggcctcccaaagtgctgggattataggcatgagccaccatgcctgatcctacatatttttaaggcccatattagccaacaaaatggtgaattgattctgaggaacaatcaaaagaagaatatataacaaataagtgatttctgaattgcacagttgcttgttaatgaacatcaatttatcaaacatgcttgtccaaagtttagccaaagattgatgaaacacatatgatctcaaaatcatctctccccttttatagaatcaaaggcctctgaatttaggcagacaaatatgatttatattcaaaattcagtccttttgcaagtaaatgattgaactgagtgtccctgggatgaagcctcttctgcttgttcctgtattggacaaagagcggaggaacttaggtgctgcactttcaaacagcattgatttcaaacattgatcgtgccatagagatgtgtaccataaaaaatgacagtagaagcaaatgcttgataccaaccagaaacctctcagtcctctcaatatatacaactcctgagataacacttgattttaattcagcaagaaggaagcaaagtcatacatatgttttgggaaccacaaaagtaaatgaaagcatgcaaaaaaaaacaaaacaaaacaaaaaaaaaacaccttgattttaaaatggaatacatcattttatatagcagccaggtttgaaaacttcataaatgtgggggcatttttttcctatggttattttacttggatatgtttggatgattaatttatgcttgaagtaaactatgctacttatttttccttgacatatatctcgacacactgctataatagaaccaacatatgtatatattatacaattcacttagaattaattgtgcactaaggttatggataatgttaggtgatgaacaggatcttcactgccttaaaattttatgtgtactattctgaggcatgtgtaactctatcaagtttaggattacctattatcatgttcccactatgataagatatgaagggttataacaatacctaacattcactgagcacttactaagtgttttgcacataattgttcatttaatcctctgtcctactgtaggagctattaatggtactaatggaaataccaaatatttttattttatggatgataaaatagtctgggttagaatcctacatctgttctgttctatcggtcttaagactctggcagtatcagtatctaccagtctaataaagagcatttctttttttttttttttttgagacagtgtcttgctctgttgccaggctggagtgcagtggcacgatctcagctcattgcaacctctgcctcctaggttcaagcgattcccctgcctcagcctcccaagtagctgggattacaggcacatgccaccatgcccggttaattttttgtattttagtagagacggggtttcaccatgttggccaagatggtctcagtctcctgatctcgtgatccacccgccttggcctcccaaagtgctgggattacaggtgtgagccaccgtgcctggcctaatgagcagttcttaatcaagtaatctgtctgcatgatttctttctttttcaccattctgcatgtatgtgtctctgccagacacacatacttggtagcaaagaatgatgttactgaacaaggtggataatctttcagtcagagttgtataaacaactgtgttcctattctagaaactccaggagtataatgacccagtgccttttttatcgctcaatctatccctgatctgtttggaaattttacacctttctagtacaaagcttctcaaccttggaagtattgaaattttgggctagataattatttgttgtgggagtttttacatgatataaagcaacatccctggcctctatctattggaaacgagtagtattcactcatttggatggaatttacattctttgagatgctgttccacttaattaaaaattgatggttttacttattaccattactttttactttttaaacactcctctctggttatcatatgctttttttaaaaacaaactaaccaactcatcaaaaactttccgatttaggtgattgcagacaagggtctaagacaagcattctgtttaccttcttccatgtagaatgtgaaacatgataattctggcgggataatacataattatgaaaatcagcttaatgccaatggacacaaaaaggttgcttctgattctctactttgcttgaggaaggaatgatggcagtatctacctaactcagagcagatgtcaccccacacaaggcaacaaaatggcatttcctgggcataaaagcagcatcacagtgtgaaatgctatccaacaaaacttactagggacaccactaagttagcttgctgctctgtgaagcagacctgccaataagacctggtctgttgtgtgcaaatggatctatatgaaaatgaaaataaaaaaatattcttgccgggcgcggtggctcacgcctgtaatcccagcactttgggaggccgaggcaggcggatcacgaggtcaggagatggagaccatcctggctaacacggtgaaaccccatctctactaaatatacaaaaaattagccaggcatggtggcaggcgccttgtagtcccagctactccagaggctgaggcaggagaatggcgtgaaccggtcaggcggagcttgcactgagccaagatcgcgccgctgcactcccgcctgggcgaaagagcgagactccgtctcaaaaataaaataaaataaaaattaaagaaaaattcttaatgtctttccacttatgctttcaaaagttgctctactcttcctccatgagccctctttaccaattgaatgcagagacaacattatcccctttttaattaatatattacctattaagaatgctccagatagatggacagatagaaggtactcagggaaaatgctcaggcttgattacctgcagtgtgttgagtacacagagaaaggctgctttgctttctggatggaaagcaatgggaataataatatgtaaattgatgtatcaaaatttctgaaagctcagcgttatttccccttgcccaaagatttcacctcgccttattaactattctaacaaccctacctttcttttttgtttgtttgtgtaattcttgtttcctcccatttagcacacagaaaaaagcattagtaacactcctggttttaaatgaaccctattaatattcgtctctgcaagggactctgggataattttgataaatgtggccatgaagctgatctgacagagctgagtgtgatgtttgtgtgttcatggagaaccgtttcatgcataaaagggtgacagactgaaatggggagtctgacaggtctctatttctgggccacagttagcagctgaaagtagaaatataattgtatctaaaaaaaaaaaaaaactaatgcaaaacaaaagaagcaatctttatgaagataaaacaaccccactggtttctgattagaaggtaattcatatatcacaatcctcagctctcacagccccagctggccagacctccaaggctgtacaggagggtaatgtgaacaaaacctgtgtttgtaagaaggagaggtgagcatggggagctcaggctgcatggagtggcttccatttctttctgtgtctccacttcctccagcagtggaagatgccctgaaaagactagatgcctttcagtcgtgattacatttccagaatggaaagaaagaaaaaacaaaaaacaaaaaaacccaggctgccatttctgaaaaagctttgtagcaaatgtcagacgttttgaaaataggatcattccatatacatgggttgcctgaggtaggcttcacaaaggttcttagctttaaaatggaatacataaataagcagtagggtattgaaggattatgagcagcataaagacagttattgaaaatgttcaaaaggatcgtctaacctaagcaagatgaaactccaaatataggcatgtagaataaaagagaagaaatttaactactttcttcaagtgcctctaaattctgcactttattatctttaccaatcatttattaatttttattatgagcattggtcctattttggggacaggtatttatttcctcaacataaaagtttatagaagatcacaatgaatgtctttgaagggaatgtggcaggaaacaagtagggaatgaaggcagtagtggtagtggttagaggtttcactgtcatattttggagagtcagcaaacctgggaaaagatgataagaaaaaaagtatataaccacagacagctcaaaaatatttttcattgggtggaggtggtaaaaaaaaaaaaaaaaaaaaagcctaaaatggctgattaggtcagagtttttcaaatcatctccaattgcaaagcagtgagaaacaagccctgttttataaaaagtgagaattcttcataagttggatgttacttaggtgtctctgagaacagaatgtaaaaattaatgattatatgcctatcatttattgagcatatactatataacaggccttgttttaagaatgttttatttaattaccagattcttccttgagatgtagatattattatgcctactttacacataattaaactttgccccaaagagatcaaatacatttcaatgtaaatggcatctctgttaaggaaataacctaggctcaattttaaactccccaaagtttcatagcttacagggtcagagtccaggtctgcctaaccttggaatagaaagtctttactccacttactcatgcttttgaaaatttggcctttgtgttaggagacaggaggtagaaatccctttctatgagctaaagtaggcatgttagctaatcaagtcattcttcatccataaaaattgttgcctttctctaataagtcatataaggaaactcagtcaacatagcatttcctagaatttaaatacacaccaaagctgtactttgaagctgacattctgggctacattgcctttgggttgaggcagccctcctgttcttaacttgtttactgggaactgcacctggtagaggcatctccatctggtggtccaatcagaacccattaagcactgaggtagactgcctggaagtggaaaatatggactagggaagctgagcctgagctacatgacttcacctttggaaaaaagaaacaggaaaaaaaaaatacagcccatacagcttgcagagcaattgttcctgcacagaactctggtctaattgatttggacaccacagctaattttccctcagacatctgttagcacacattagtggatgtcgttaggtagggaggcactgattagatggggagcagagctcaaaggccctggttttggaggctggagcagacggaggaatgacaacagatagaatctgccagcaccccagcaacgtcagatacttctgctgcagcaaccctgaaaggaagcaataattgctagggagccttggcagttgtgcataatagtctgatcctttcttgcatttgcccaaataataagcatcttctgaatttctaaaggcaaaacaagagtgctccagataccaacagggccaaaacacacatgaaatgaagataatcattgtcaatacccctttcgcttctttctccaaatctcattcattcctgtattttagacattagtatgtagcaactattccaggggctcactcatacccagtcaggcagatgaaaaaatggctgatcaggtcagagtttttcaaatcatctcccgttgcaaagcactgagaaacaagccctgttttatttattctttcttatgcagccatgctcagatacttaactgatgctggaatgcagttcctatcctttgggacacgtattttggttatacaagtcagaaaaaataatctgatgccctcaagaaaatcctccacaagccagtctgatgactactctctcaacgaatacatttaaaagattatgatcctctttcagaagcagtacaatgtcatgcatcacaaataagctgaagaaagaaaaggttgcaactcagtccgaaacagaaaaatcctatatagaggcaaatatttcaaagagtggtacagacttaatcttttccttactgttcctagtgtctttcttaaaatacgaatctagtctaaaaaaaaaaaaaaaacaaaacaaacaaaaaaaaactgtaaggtaaagtcaaatattttaaggtgtttaaagcccatcattctggactcgaccaatttttttccaggtttgtctcttccaattcctctccatgttcctttttctctatttaaaacagactatttgctattacctgtacatcccaaccacttctacatgcatgcatctctttcttttgatccttttgcctccttggacaactctgacttcaagaccctgcccctattttcctcctcagtgaaatcttccatattctagggaaaaagccatttcccctctgtgtgccaactggaccctgttcacatttccatagatgttgtcattgaacattataatttttaaattatttttgaaattgacaggtaaaattatatgtatcatgtacaatggatgtttcgaagtatatgtacattgtcaaatagttaaatctagctaattaaaaatgcatcacctcacatagtcatcacttttgtgatgaaaacacttaacatccactatctttgcatttttgaagaaaaaatatactctcatcgactatagtcacttatttttgtttgcatttctgttcttccctccttggcatccatgcacctttaccgtttgatggcagggctgttcttagtcaactttgaatttccaaaatctgacacagtgcttggcatatgataggcccttactaataaatatctgccaaaaggatgaatttgtgaataaactttgccactgaatacaactatctgggtagcaaatggtaaagggatttgttgttagagaagagtatcaatgacagggcttctgaatgatcatgtatgtttcacttcataaagttaacaaacatatatatcttgaataactttgttgtgtgtgtgcattctttacataagttgtcaaagaatcaccaaacaaaatgtcctgtaatatccagtctaccaaggaaggaatattttgtacaatatagttgtgaaggctaagtaatgattagttatatctgagattttgaaatatagtgcattaaagtggggtgacgataggcaatgcttaaagtatccacaaaagcacatctctgtatagtgtgacttagctatggactatacatttggacaagaagaaatataaacagagtcacatgacttcaactgtgagtaaaatgaacaaatgtaaatctaacaagtcttttgtgtgagctacttttgcattcacactaccctaatgataagggaggacagaatcaaattgaactatctatttagtacttattacgtattagaaactatgctatgtcctttcatattatttaaacagggtcttatcatcatatcaatattaaacatcagaaactgaggtataatgagatgatataactcatcctagtcacagagctagaggtgtagaccagaatcaaaccagtgttccggtttcaatccatgactccttgcactatgtagtactgcctgtttctgcatcacgatatgagacaaaatgtaatgtaaagaagacatgcaattaaaaataaagagggccaaggactcctggagttgaagaggtgaaagaatatgcaggaatgaattagctgaatttcaatgctgcaaatgggagctgatactatagaagttcagtggagaacagaacctcctctaggttcactctcagacaatgattaggagacagtaaatacactgtctatgttacagagcattgaaatgctcaaccagagcttgaagccagggttgtccatctgtcctagctttaatgggatttactgggctttgctatctctgctttctgccaaacagaatcagaaagcatcagtgttggtaatttaggagcagtttttggccacataagtggctgttagtagaatttatggacagtaaagcttgattcagggccagcctgtagcaaaaccagggagcaagccattcatcttcagtagtctctaccttcttaagtgtgccatttttcccagtgacaattagttgggaaataaactatttgaaaaattccagtaattaattgcaaggtgttggttgcatctgtcacctgttcctccaatgtcacccaacaaaagatatttgcctttcaaactctgtgtttgtagggtagttacaatggcgattacaatagggtggttacttacataatatggtggttacctttgctgactactcataaagttacaattttgttttgaatggatataagaggtctctagctgcctcatgtatgacgctacccatatgttcctggatcaattaaacatttttttctgaaggatagttctggatttataagaatctatttataatatgaattataagccctcagaaattagagaaaaatatgaatcttttcactttatatttctttcacatgaacattttaatcaacatcaattgctgaatcaaaacagacacgcaagattgagttagacactagatatgttttttactcaagggaagccaaaggttctgttcacttaccctatttgacagagaagctgtcccttcaaagaaaaagtaaaggttacacaaatcctgggaattattcttttgctggataccctccatttacacagagtggcccatcccctgatgtcccctgctctgtgccctgggaggctgatcacctgaattatatcaatgacatccttgtctctggcttccaattgggatcaatcagtgaggaatattaataaaagatctgaaagggtggcagagtgatatctgggcatttatttccctgactcccacaacacagcatctccatgggctgcctgtgttctcctggtacaagtcctagtgcttgtcagaggctctctgcacacagtgctctgtttctctagctcctggtaaccactccctcccattaccctcttcagacctaaaggtgttaacagcttcctgatgttactagccccagagcactgcactatcccccttgatttccttaccccctgcctcttgtccaaatattaaaaaaaaatttctattaaactcctttgacattatccaatttaagtttgccatctgtttcctgcagggagtctcaccaaaaaagccctgtaactcaggtttacctttattctgaagcctgaatatggtccttggggaaattagggggaaaaaaaaaaagtatccactaagtcacatggtcaaaaatgggtgctttagcctagaaaagcaccagcaaaccagatgaatttcttaggacagatactggccgttatgctgtggcttacattcacccactaaagcatgcttcctagccaaggttttaatagcaaaataaaaggtttggagtcagctttgctctctttccccaggccaagggcatatttcccagttacttctaaaggacttctttcttaaaagatccaaatatgagttgctatgaaattctgtcttttttccaagaaccatataattcatttgtatctgtagtatgatcaatgacatcttgtggaagataaattgtgccttataaggccatagtacggggcacaccagaatgccaacaggactcccagcaacaacttcagaattccaagaaagtgttaaataataaaaactagcacagagtacttgaaatggtgatataataaaatcttctttcatgtctgcctccagcagaaacctggtggcagtagcagtgagggacatatttgggagcctcattttcccctccagaggtaatggaatctacaattcaaaaaaagaaggaaagaaagaaatcacttcagtacctggcacagctaaaagttgtgaatcatcaaggccggcccaggagcagcaaggtgaatgacggtgacctcccttgtcaggttttagcctcccgtacatttggcatgcaaaacataggtttaaaatagctttcctgcaggttccatgtgactcgtcactggacccagccagcacaaaagggttgattagtgagggaaaaaaagagaatcttctcctgagatgacttccaaaagctgcttcttgcagcacaaatctccctttgaaaatgcagaactggctaggaaaggcagcagcattctctcctccaaatgattgaatttttctttgggaatcctttattattgttgttgttgtttgtttaaagaatgtcaccttccagctccaacaacccttactttggagagatatcaggatgtgaaaaatcaaggggcaatccctaaagccatcaccctagctttcttacccactagctttgggcagacagaatccagacccctctttacagaaagtagaaagttttgagcaatggcttcttgaccagatctggctgtcagcagaggcacagggatgtcatttgtactttggctgcccacccagaaagcgatgagggcctctcttgtcatggctaccagttggaagtcactggcaggtgctcatcggtgaaatggtgcagggggctggggagggggtgatttaattttcctctgcggatggagtaaaattgctctctgggggaatactagtggaacagctgtcataccaccaccaactgcttcagaacttctttgtatcctgtattattctttaaatgttgagcaaagcaagaagtgctaagatgtgaagtaagaaagaacatagagaaaggtaaaatttaaatgtagaaaattgtatagtagggagaagagccatgacctgaaacttgccatttttgggctggccagtgatccaagtacttcagcactgtagacagagggccaacaatgaatgcttcacaaggatgctgtgactgatagatgatgatcatgaataaaatcctctctggttagtgtcagcaatgaaaagaaaggaggagaaaaggaaggaggaggacagaagtagaagtggatgataaagaagaggtggaacagcagcaacaggagaagaagagagagacagagaaaggggtaggggatgaacaccccaactcaaaatttagaagaaaagagtcagaagaaacgttgtatgtgtttttcagtttcccctttattctattaaatctcttgggttgtagctttcacaaataagtatgtattttaaacgaagaagacaatcgtataaaatttatatttttaatataaatgtactataaggatttcttccttcctggaaactccggactggctttaatgcctctaggtctctggtaggtaagcaccgtccccgtgaggctaagaagttcaaatttaaaggatgatgggccaaacaagacaaagcattcttgtgtttaacctctgttgagaagaaattatttacctgctagctactagttcccaggcatttgggctcaattacccaggaaacttctttcagagagggcctgcactcatccattctggtagcaaacaagtcagtgtgacatcgttcaaggtgctcgtgtgctcccagaccaatttcacatctcattgcttagttggacggaatttgattgtacatgctccctggactctctaacctggtgcagagaatcaaccagttctgaagcaaaacttggtttcattaaatggtgcatagtggaatgcagagtgaaaccactggaaataaaatctgggtaaaatgtctctatttataagtcagcctgctcttagtggggaggaagagaggatgttcactcttaagcccagtggcaccagccatcacctgatgtttactgtcacccaaagtagaaattcttatttcacacttgaaatatggaaatatggatctcaacagtaaaactgagaaccatatctcagatccacagccctgactacaaggatgctgtgactgatagatgatgattatgaataaaatcctctctgcttagtgtcagaaatgaatgcttagtgtcagcaatgaatgcttagtgtcagcttttcaattcaattaaatcatggttattgagcttctagctcaaggtacttcagggaaaaacaggcaatttcctcatccttctttcctgccctcagtgttcttacaatccaggaagtgagacaggaatataggcaaccatggcacaatgaaatgggtgacaccatggaataaaaacaacaagctaaaagagttttgaggaaggaaaggtaatttatgaattgtgcaaacgtctctttgaggatatagcattatactggaccttagggacaagtaagttgaatgaaaatgtatagaaggggtgaagaggaaattgtaggctaaggaatgctttgggcacaggttcaaaggtggcaaacttaaatgagttttcagagattgacaagtagtttgatacgactgaaacatgaaaaatgtaagtaaatgagagacagaatgtaaggaagttcgtgggaaagatgaatgtcaggctgaagtgtggtattatattcagtaggtaatgttgagccattcaagtctttttgcgtgggagagtaatagtcagtgctgtgtctttgaaaggcagctctaataatgaggtgataggtggactggaggattttagaatacaggaaattggtaaatctgttttccttttagttctatacatttaacactttgtttttaaataccatattactttcctatttcagttatagtcaattaactcaaacttggaaatttaaggcagctcaaacatattatcttacagttttagagatcagatgtccaaaatgggcctcactgggctaaaagcaaagtcgtggcatggctatggtccttcttgaggctgaagaaggaatcaattccttgccttctccagtttaaaggctctctgcattcctgagctcctggccaccttccatcttcaaagccagcagtgcagcatcaataatctctttttgattttgactctgaagctatgtttttgtcatcacttctccttctctgattcttttaaggatccttgtgattacactgggccaatttagataatccaggataatctcttcatctcaagtcgttaatttaatcatatctgtggagccctttttgcctttcaaggtaacatagtcacagattcccaggataaggagtaaacatctccagcgtgggggcattattctgcctacctcagacatacttagcccagagaataaagcaggggtgaaatgtgaagatctaagcatgggctcctacagacatcttctaggtttcagccagtgaaattggtcctattcatggtctctcacaggtgaatcaaagtagcccgagagaaaagggcttcactcctccaccaacaccttcaagccattttatattacttataatcaacactgaatagaataaagatttaataaatatacaaatgattacatgcactaaatataaaaagtaaaaacataatttttgcaaaaaaatgtattaaatatttggaagactaaaatcatttttctatccttgactgaaaaattagcaacacggtctgacatttacagtcacatttatcaccacgtggttatgttctgctgcaagattgaagaacaaaagtgccctgtgtttggggtactcatttctagggtttggtgttttggaaagtttgtcttttttcttattctctattctattttccatgttccaggtacatgaaaatgtattctgaagtctgaatacagctgatataagaatgtagcacatctattctgaagtctgagtataggtgacataagaaagtagtacaaagatgttgggcttggaattcaggcaaacaccctattttgtccctgatttgctgtgcaaatacacattatcacacctcaatttttctgtgtgttactcagagatttaaaaaattggctcttgatatgctatggaaatgtgttataaaaagagattgcctatgtgaaagccctttgaataaaattcaaaactgatggtggttactgcatggttactgacatgcgctatttgtcatgcacagtggtacactagggataccgtgatagtaacatgccacctgaagccaaaagtgggcaagagtgacctggaaacaagcacagtgagttgtggtcattgccataacagaaacacataaactgtgtgcatatttaaccttatttggtagtttaataattagaaatgaatgtgaggatttgaggagtctatttagaatgacgtaggtaagttttctctagaagtaagacttgaagggttaggtccccctgcccagcctttggaagacactgccctgcctcacacaaaaatgaaaatgactacatttgacaatgccctctactcacaagtaacctaatggagaagaataaggctctttggaactcattgcaaaccatgtttcctggtcctggctcaccctgggacctattccaggatcagtcattttcgtaatccttcaaatatatgtggaagaagtgaagagtgattggagaaaagtgacagtgaattccatatgctttctttgtaaatcacttatatagcaaatctgcatagtctatatgtcaagagaggatttttcaagctaaggttgcaaattccatgtgggttctaaaattctgcctgttcctacatcatcactattttcaaagagtttgcacttggagtataactagcattataactaagcaaaagatggaaaaggatccctgctttttttttcccccagctcttctgattcacacgactattgagggagcagcttcattaagcctggaggcttgcctcttataaaataaaggcaagtttctaatgccatgataataaggaaagacatgggtttcagtccccactctgatattaattttatttattcatgtattatttatttatttatttactttcatcctagaatgtatatctgctacatgaaagactataaactcgggaacagaattaccatgtcataacagttagtatgcataatgttctggatactaacacaaagatggtctgctttcctgaactattgtcactaggccacatctttctcatattagggatgaatcaaactaagttatccacactcctgtccattctcttctgtgatcaaatataaatgttgaactagtctgggctaaagtgaaatctggtacagacctacctagctaatttaggaatagaaaccaaaactaaatatatgattcggacagagaaattggcctaagtaacccagatatgtcataatggtacttattattagtagaaagtagaaagcacagaatattatacaaccatatagtcagaaacacattctgggaaaaagactagttctaattaactctctgagcataacgcttatttttaataacaaaggcatctttaagtttagagaggcaacttcatgaaatatgattttagcaacacttctctccattttctgtgttttctttgctgttaatgtcttcttcatcccccagagatacctagtgctcacaataaacctttctttcctgttatgggagaaaaagtaaccaagaaacaaatcctcatcaagacagtgggatctagatacaataccatctgagaagttattattcattgatttgcagattcactaagtaaatttttagtgactagctagtatgtactgagtggtatctcagatgtggcattcataaagagaatgacacaaaaaaaatggcctggtgtgcaatacaaaggaatgtatagtaaaattaagctatgaagaattgtgggtggatcctttatgaggtttgcatatatcatttacccaaagcctgaccttgtctgtggcaactgctgtgacctcttcttaacagcttttccactgaatgtcaagatcctttgacaaactatcctatttgtggttgttgtggagccactggttcctaaaaactctcactttggatattgctttgcttagtggcacatttaccaaaaaagtaaagatgaaacaggagagaaacaagactgatcaaccaggtattagattataggtaaaaagaactatagtaggtaaaatcctattttggcatttttagccatacatacatctggaaattatcttcatgtagagttgtctttcacttttatctgcgtagcatcttttcttcaaagaattgtagtcacttggtgtggctttttgtcatacaacttgacctcccttgatatggcattggtcatcaaactagtcaatcagattactatgtcccttagaaagagtacttggctaatgagtgagcattgactaaatcagagccagtcagattatttctttcaacaaactgaaatggctgaaaaaagaggaagagagaaggaaagggggaaagacagaggagagaggttggctcttttttcttctgagatctcatatattatctagtctggaatttccagggtcatctttcccattgtatgcagaagcacttaggtagagagaaaaacataattcttatgacgtcatttgaacttccagattcaatcatgcctgaaattaaacacccttgtgttttccagttacatgggggcatactttcccctttctacttaacttatttttatacatttttgccattgaatcattcactccaaaaaattaaaagaccatgacttgtggtttgaattcccttcagcttgaagtttggcactatatagtagctacacacacacacacacacacacacccacacacacacacacacacacacagagtgaatggtatttattctagtgaacctagagtgcagcagcatggtacagtggaaagaaaattctactgggagttagatgccatacatttaatgtggtattatctacaatgaatatattttactttttaaataaagaaaggagtgaaggcagctttattatggaagcaaaacagggaaggtctgggttttatcttcacttctgatacaagctagctctttggtataggcaagtcattgtaacattttaatcctcagtttcctcctttgtaaagtaaagagcagtgggtctcccactagactcttgtgatccctagatgtttcatgtaacaccacaagaagtggaatatgagaggtggaatatgagatggaatgtgagatatccaacctgttttctaaaccagaggaacacttaacatatttgctctatctacaaagcttgaatgtcagtttccaagggtttctgtagtataaaattttgaaaaaaaaaaaaaaattaaaaagttttttaaaaatggggcttgataattcctaagtcctttttagttttaacactctttgaagttaatccccaagtcaaagtttctactagaaatatagtaatttactcacagaaaatagtcatcttctgtaattgcttttacttaatccaagcctgttggtcacatttgaacattcagagtctttacttttgtgaagtatgctgcataaaagttaagaaaatttagtttgggtgttcaagttcatattttagatactcaaattcagaacactttaggaatagaaaaagcacaaaccctatttatatcattgggacataaatgttaaactgagaagagtgataaagactcacgtgtttctaagacacatacaggtcttcagcttcttagccattaggaaaggaaccaagcaaagatgaataatattcataaactagtacaagggttttgtttgttcgtttttttttttatcatttccaatcaacactgactccatgcttatgctgtgctagacatcatggcagatgccttcgatacataaagggctgtgacacattccctatctagttaagaacagacatgtgccttaaacataattatagctgcaaagttgcaaatgataaatctccagagattaaaatttctatgtccaaataagagggtaactcatttagaacctggctggctgaaattacaaatgatttatgtttcaccctggaatcttattttacttcttggtggattagagaggtaaattatttttattagaggatgttttgcatcttgcagagataaagtatcaaagctttttgccttatgcaactcttttcaactactcatatttttgaacagattaatgcaagaaaatataatcaggagaagatgtgttcctttagctctgcttcttttggaacccccttggtattttgcttatcaagttggaagagttgtggcagaagatatctagctcctgaaaattctgaagatgaaataattatcaccttcgttctacttttctgagctatcttcctttttctgccaacattttccacaccaaacaccatggttcacctggataaaggtgcagcacagttccaccaaaggagccaaggggctgagtctttttcagcaggtagagctagtgtatcctaacacaggagttttcatagaaacttcagcttagacaatctatgagccttcacacacaagcagccaagcagatacaaatgagctcttttaattaggtatctggatttatattggctgactcagctccatctcagctttagaggatgaaaaatcacctgaacgctctctaatgaaataccccttgccctagcatgtgagtgcttgtctgagtcaccaggaagtgtaataaggaacactcagggatccagctgtgtatgcagccctcctgctggaggtagggctggcttgtccccaccacttggagttctccctgagtcactcagttcctggctgagtacagccattctgtgatttatgttacataccaatgcctccaggcagaaaatgctgataataattgcttgctatgggggattaggaaaaggcaaaggctttctttgggatttccttttcctttcttctctcttcccttcccttttgtctctttcccgcctttctgctttcctaacctccccttccttcatttctcctcttccccctctcttgcctaagtctttaaagcaacatagttttttttttttttactagcagcattgtaaaggtagccaaataaattctgagtatgagttctttatttctcgcaagtcaaagtagaaagttgaaaaaactcacaaatacatcaaatataccttaaagaggtaaaccaactattcggtgaaattttatagctaagaaaacccaagtgctaatgaataggtagtttcaaaatctgagatggaatctctaaaaaggagggattacttttaaaacacacacacacacacacatagacataaaatgtattcatttgtctgggtgccgtggctcacgcctgtaatcccaacactttgggaggctgaggcgggtggatcatctgaggtcgggagttcgagaccagcctgaccaacatggagaaaccccatctctactaaaaatacaaaattagccggacatggtggcacatgcctgtaatcccagctccttgggaggctgaggcaggagaatcgcttgaatctgggaggcagaggttgcagtgagctgagatagtgccatcgtactccagcctgggcaacaagagtgaaactccatctcaaaaaacaaacaaacaaaacaacaacaacaagaacaaaaacccacaaaaacatattcattcatttcgcaaaattttgcacctacaatacctgaggaacttgactttgagagatactcaaataaaaaataaaataccacaatgagaaataaataaaataaaataaaataaaataaatataaataaataaaattaatttttaacattttgcagtttactttctagtagacagaaatctatcagaagacatgagaatatcatcctcaagttgccagggaaatgtaaacatatagaatggaatcagggactaggagaccgctgggacatctaacatactttaatcacatttcatttagtagcacctgttcaattctcacaatattttaatattaatatttttattttgcaaataagcaaacagaagcttttctgtatcaagtaaatagctagtcattagcagagtcagcatttgaatccaggtctctctgctccaaagctcatgctctttctggcataccacacaggaaagagaactgtccataattcacttaatggaatatgattttaaataaatttaagcaattaactatgaaaagctgcttaggttctttctccttagggggctgagggaatagcctgtcatggccgggccttaattatcctccatgcatgggcatggtgatacagcccaatcagatgtggtgagaggcatggtaggtggtggtggtggtaagcaaattgtgttcatcttcacttccttcaggtctttactcaaatgtcaccttaccagggaggatttctatgtcacaccattgaagattgcagcagcccctgcccctaagttccaacacctccagtattctccttccttccttttctccatagcactatcacctatcaccatcagatatattgtggatttttgtttatcttctttattaattacctcctggtctggaatctaagcttcataaagggacagtttttgtttttttgttatgttatcttaattatttatattcactgctctatccccagcatctaggaggcaaatagatattaaacaaacattcgttgaatgtataaatcgttagtaatttttaggcagcaaggtataagtagaaggaattcaaggatattattgctatttccataatctattttatttgttcttcttgaaagacaatgtgactctgtgaaataggggcacttactccaaataattacaacatttttttcctgaggaattggactagaaattgtggaaaatggagcttccaatctatctgtggtgtttgaatattttatatttaaaaaacatgttcataaactacttataaaataaaaacaaaataagtactaataagccaatgaaatggaatcagcttcattactttactgggtctcagctctcctgccctccccttaatgatagatggccactgatttatactcagtgtgaaatccaggccgggcatggtggcctatgcctgtaatcccagcactttgggacaccaaggcaggcagatcacttgaggtcaagagttcgagaccagcttggccaacatggtaaaaccctgtctctactgaagatacaaaaattagccgggcgtggtggtgcacaactgtaatcccagctactcaggaggctgaggcaggagaatcgagaatcgcttgaactcaggaggcggaggttgcggtgagccgggattgtgccactgcactccaacttgggcgacagagcgagactccctctcaaaaaaaaattaaaaattaaaaagtatatactcagtgtgaaatccaaagtgcaggagggtctctctctctctctccctttcttttccttcttcagacatagacgggatctgtgccagttatgtaacagtcttctgcgagcttttcagaaaatttatttttcaaaaatatgttcttatttcaataatgtaattattgttcaaattattcctggaatttatttctgaaattgacttcaaagaccttgatatcttggtaccaacacaacaaatatttactcacagagcccaactccagatattaataattaaattgtgtaattaagttgggtaacactgtgttcagtgaaacaaactttcataaaactgtaaaactgtatttcttattgttcataaatttatcagtaaatgagaaattctccagaagggtgaaaggactacaacatgagaagagtattccattcaagtcgtgtgaattattttgaggaattaaacttatttgaattttataaacaattcttatactgcttataaattggttttattatatattaccactccttatgtacatacatattgtgtgtgtgtgtgtgtctgtgtgtgtctatacataaataccttggattcagggagagtaaattttcttatctaatttaatttgaagaccaaatctggatatctatttatggtgtcttgatctttgcatttgacaaacctcattaaatattttacaatagaaattgctacagtttttagaactccttctgaattacacacaatacaattcttatagtactttaacagttaagcttgttggtacaccctgaagaacaaaatccagcctaagccttttgttactaatgggaaaaagagatttattctcatccattgtcaaaggcacctcaatttatattatgattccaagaataggcttatcagtcctacaggaaaaataaacagaatagctgtatatcctactttcagaaagcccaacgttgcattgaaaacatgaatgcaaaacaaataaattggagaatgttgttacattaaaagttaagaataaatgtttcattttgagagatatttaccaatataattttgaatactgaaaactgttccaaggcatttatgtgtatttaaaattgttaactacttgatcatgatgaggtacaaagattattagaaattattatgaaataaaaataaactaggaaataaaacattttaaaataatgacagtttatcaaaaataaagattaagtttagtatagactgtaaagtaggtatctattgcaaaaaaaactacaaaaaaaccaaatcttcaaaaagcatggaaccctatcaaatctattatgttgcgtctaaaccagtttccttccaacatctaattttttctcttcattttgagcatactttaaaccactgttacttgcttttctttttgttgtcttttgtccaaattctgaataaacacgataaagtgggtggtaacatagagtaatgaattaatagattattttccccttttaggggtttggtctcagaagagagttctaatgaaactcagtaatttactagagcaaatcttattaatagtcttcaaaggtataacctcttcctctttaacatcataagcatttggagtttcctatgcaagataaatataaaagctttcagaaacacagaaaatgattttgtaccgtttttcttctctatggaaagtcagtctgaggccaggcatggtggctcacgcctgtaatcccaacattttaggaggccaaggcaggcatatcacctaaggtcaggagttcgagaccagcctgaccaacatggtgaaaccccgtctctactaaaaatacaagcatagtggtggatgcctgtaatcccagctactcgggaggctgaggcaggagaatcacttgaacctgggaagcagaagttgcagtaagccaagatcgcaccactgcattccagagcgagactccgtctcaaaaaaaaaaaaaaaaaagtcagtctgatgagttattgaaaataattttcttagtgtgaaaaagcagtaaagcatagcccatatgtgactaacatgtttttaaagtattaacagatacaattaaaatgaaaacaacaataatacctaataaaaaattgagcacctactatatcaggcagtctggtaaagactttagattacagtttctcttaatggttacatacacacacagagacatacaaacaactatgattgttattgttgcattctttatagaaaaggaaactccagcacaaaaggtaatataacttgcatggtatcacacaactagtaaatgagtcagactggaatgtaattcatatggtctgaccttagaacctatggtcttaagccactacgtactaaacattaaggctagatatggcattttggcaagtccatagtctgaagctctaaatgtgaagttcaatgcaatataaaataataataatcatatttttaaaattatttaccatgtatgaattgattttgtcagatggacatttacctgatgcatgtgaatggaatttaacagtagccactttgtcaaatattacttagaagacaacatatcccaaaaaaagtctcctgtaaacatatggataacgtttagtttggatttgtgactgagctagcaaagggttctacgaatagctgtttactccgactgtatgagcagtatgctgaaggtgggtctgaaccatgcttatgccaagtgaaataagaagagaaatgggtaattttaaaacagttagatttatatatcattcatgatatttatcatttcatcagacagtaatgcctcaaagacaatgtctagttttttgcagctatatataatattttagtttttatatttggttgatatctgtgaaaaattattgtttgctgtctagacactcaaaatgcttttccagtgatctgtactgtactagagggctatacttggaataaatacagactagtcatgtggatcatctttactttctgcacttttagcataaactagttttgttatcataatccactccatttcttaagatcttaaattataaaatagggactgtaatatctaacaccacacatttcacaggtatgcatggagcaaacccagcaagtattttgtctcagcagtttctccagatggctatttccttgccaactcaaattaaatatgcccaagagaactgtttactaccttttgtttatattcctcctctgtctaaggaagcagcatgttagcaaaacgggcaaacaagcaaataaactaaaataacttgtggaatccaacagacctgagctcaaatcatgacactggcacatatcagttgtatgaacttggatagttatttattattttctgtttccattattttatctatactagggatgataatatacactcatgtgtttatataaggtttatagataatgaatatgagtgtttggaacatacagtagtgtctttatgcaggctgctataacaaaataccatagacagtgacttatacaacagaaacttatttctcacaattctggagaccgagaagtcaaagatcaaggtgccaacaggtttggtgtctgatgaggacccacttcctggttcatagatggctgacttttcactttgtcctcacagagtatggaaggggaaagggacctctctggggcctattttacagaggcactaatcccataagtgagggtcgagcctaatcacttcccaaataccacatttccaaatagtatcacactgggataaagttctaaactgaatttagcaaggacataaacattcagtctatgacaagaatgttcttcaggataggagctgctgcatcagcaaccacctgatgctccaggtcatgacagaataatgaggtacagaagatgtcttcacttcacttgtaaactctttattgttcttcacacaaaactgaaatatttctgtcagatattattgtcttcatttgttgaaaaattaccccatcctcttcactcattagaattctaacctggttacctttttttctgataccgccactttctggaaactgcctttgcaaacatcttgcttcagattatgttttccatttgaagaccccacccatcatatttactaaattaacatcctcagttgaccttaagaaatttgcaatctcacagcaaataaaggctaagattctcaaccacctctaagttctttatatgatagctccaccctaatagatctcttcctgttcaccaaccactgtcactgttcctaagaccactttatttccaaatatttattgtttatttatccaactcctatttcctttaagctacattcttcatgttctttttatccaatgtgcctgcccccatttttttttgcaaataagtattctatatttgatatttcaaacaactgtggaaatctcatttgttacagaatccctgtgatattactatttagaaagagaagcctcagcttagaagttcatttatctgacttagcagagcagttcttaccttcttaagttctccccaacttaaggaaaaacatcagtaactcccttcaatgtgcaaatcccacaatcctcacttcaggcttcaacttgactaaatatattcctttaatgtcttcctttctatattcctatgatgccttagtgtctgagcttgtaccctcctagagagcatataatgtgtctgcttcaaatggtagcccatgcatatagatgactcaaaaatattactgaagttgatgaagagagagatgaacaaaaatgtggcattactggctactctgcaaaacacaaaaacctaaaattctcattttactcaaaccaattctaccatctcatgcctagaggcactcaagcagtaaggctgcacagcttatacacactgctgtgaaatgtggacctcatacagcagccgaggtatataaatatgcaaatcatagatgtatacagaaacagccttccagtagagaacaccagctgtcacaagcagcaaactcactctgaggacttggcactggtgaactggcaaataccccctggttgttgctgccccatcaatcatgggccatttggccgggcggcattcttgaacaggttttctcccctttttaactccgttaaagaacattattttaaggtgatgtaataagctcctgtaaaacttgatatgactgtctgatacaggagagttcatctcttgatgtacacctttctgtatcttgctgttgtttttttttaaaagtctgcatcccccaaaacaaaagcatcaaattaatgttatatttatctttattaaataattattatgaaaggttttgccgatacatgcttgatgagcagtgtgcagaatttaacagtttgttaatttgtttttcagacacgattgaaaactattgaccctcaagttatcacaaatggttatgaaatggaaatggaatgggaaggagtatgaaaaaataagctgaatactgacaaacctaaggtaccccaaagtctatggaaactccaatttaacgaggggatgaataagaaatttacttctcaacaaacaacaaataatggtttataaccatggaagcattctgagagaagtaaatatgtcatcgattttaaatagcagtgttatccagcagagagcagatcaatgaaagttgcataggttttcacatgcttcaggatattaaagaacaatcccatttcccccctctataaaccattccatccagaagagtaattttaaatgtgctataaatcattatctgttcaacaaccaatctgcattcagaaaagttatatccattcctattcttcttccttggaacaatttaaaatgctctcattttttgctaacctgtaggcctgctttgggtcttctgactggatatgtggtaaaaaaaaaataagttatttctcaaatttaatataacaaatactaggagagaaaactgatgtattttctttagaaaaagtactcaatgattatcagttgggcaatgtttattacagccttgtaaatgggtcgataagatttattgctgtttcaaagatagagtgaacaatatctagataattacaaagatttgcttcatctacacaaaggtagagtgatgaagaatcataatgaataaagactaagattttcatcaactatctcaacattctatatatgattgcatcctctcctgtgaacttgaatgttaatgttagaaaataagatattcattcattaccaagtattttgtgaagttctgtgtggtttcaaagagaaacaatgcacattctgtacactctgggagcttgcactagtagaggaaataaggtgtgtaatgaaacagctatgttataaagtggaatgtgatgtgttttaagagagaggtaaatttgcttcccatattacagagaaagaacttgcttgtggatagcaagatcaagtaagccatgatcaagatatcactttacataaactatgcttggtgatatgtttaaaacttcaataggaactcattgttactcctctgcataaaaccttcagtcagtttctattacacttagaatatccacacacaccaaaaaagaaaaaacacaaaacacggaccctaacaggcctgcaaggttctgggtacctcatcagcctcctcttgttttctatctgccccttcttagcacgtttcagctcactggccaggccctttccacatgtcctagttctgcctgcaatccttctcacactccatgtgtggctaactctaccttcacaatttgggggaagactttgattatcaaggatataaattatgcacatacaaagaagtaaatttggaacaacgtttggactcattccgggtcagactcttatgtatgagcaggctatcactattgttagcagccgaaagatttttaagacaggaaatgaaaatgacagagctatatgtcataaatatcttgtaggaatgtttaggacagtttagaatacagaaaggtgggtgtgagagataccactttcctcagaaaaaaaaaaatgtgggaaagaggtaatgagggtctatgttagagaaggtaaggaggcacagttcacaaacatgttatcactgactgaaaagaagagataaatggaatggagatgttagaaataactctgctttcagggagatcaattgtgccattatcagaaatagggacatcagaaagaaacaagagatattttggaggcaaagattaatttatttttagtataataaaagtgaagtggctgatagatagacagaaatgcttataaggtatttctgggctagaattcagaaaaataaagggaaacgctggcaatgaagacttggaatcaaactatatagatgttaccattaaagatgaagtcatcaatggacaaaatcggaaagggaaggagaagcaaggacagcaaagcaaggacagctctgatgaaacatataggaatatgaagatcacacaactaaaggagatcaagttgacacaatctgtgaaatggaaggaacatgagaatattgcattatttcaggaaataaagagaaaaggaattgcaaaaaaagggaattattcatagtgtgcttaaatagaggtcaaagagaatgacataagaaggctggctctttaaaaagggagggacactgggaggctaaagtagaggatatggaacacaataagataggcaactgagttaaaaattagcaagtgatgagtggagagacttactgaaagcttactcaactgagattagcaggactttatagggtacacagcaaaatgttattatatccaattttctaggaatatttaacaccctttaaataaaggggaaaagagaattattagagttgctcgtggttagagacagaagagatcaaaacaagataagatcgaataagaattctggataccagtaaagtggacactgaaatgtcagactataagctctagcttggctagacaggcaaattatgtcagtaaatggttaaaggagcatccaggaggtcctgatttaagtgttcttttttaaaatttaaattagaaattttatgcaggaaattgtttattctgcaattttacttgagttgaggagattgacaaggtcctacccacacaaaatctttgcctttgttcctcctccctgagacttgtgtgtgactgtgcaggcagcattatctttatgatatctcttttaaaaataatgtacctgccgggcacggtggctcatgcctgtaatcccaaaactttgggaggccaaggtgggcggatcacctgaggtggggagttcgagaccagcttgaccaacatggagaaaccccatctctactaaaaatacaaaattagctgggcgtggtgtcacacgcctgtaatcccagctactagggaggctgaggcaggagaatcgcttgaaccctggaggtggaggttgcagtgagccgagattgcaccattgcactccagcctgggcaacaagaatgaaactccatctcaaaataaataaataataaataaataaataaataaataaataaataaataaataaaataatgtacctacatgaggtgtaataacttaaaaacttggggcctaatcactctagcatagatgattttgtgagtttgcataaagaaaaaaaagaagagtatgaacactcaggtgaagaaatgatggagggctaaagaagaaaaaataaaaagaaatataaaagggggaaaagggcatcacaacaactttcactctctgaaaagttttctgaaaggttatcctcttaataatcatgagggtttttttttttttaacaattcttcttgagctgttcttcaggtacaacacacaaacacacacaagtttataaactaaataatataaatttctacctgtaaagccaacacccttctccccaaaaaactgtaaaaaatattttgttatattttattctttttttccagtggaggtatgagtacatatgatatattgaccattgttgataaaattgaggttacatatttcactgttttgtaaactaccacttcatttttttcttcaacttttattttaagttctagggtacactggcaggatgtgcagttttgttacataggtaaacgagtgccatggtgatttgctgcacagatcaacccatcaccaaggtattaagctcagcatccattagctattctttctgatgctctccttctccctgaccccaactaacaggccccagtgtgtgttgttccccctcaagtgtccatatgttttcatcattcagctcccacttacaagtgagaacatgcagtgtatggttttctgttactgcattagtttgctgaggataacagcttccaggtccattcatatccctgcaaaagacatgatctcattcctttttgtggctgcatagtattccatggtgtatatgtagctttttttttttttttttttgagatggagtcttgctctgtcacccaggctggagtgcagtggtgcgatctcggctcactgcaagctctgcctcccgggttcatgccattctccttcctcagcctcctgagtagctgggactacaggcacctgccaccacgcccagctaattttttgtattttcagtagagatggggtttcaccgtgttagccaggatggtctcgatctcttgaccttgtgatccacccacctcggcctcccaaagtgctgggattacaggcgtgagccaccgcgccccgccagcatattttctttatccagtctatcactgatgggcatttgggttgattctatgtctttcctattgtgaatagtcttgcaatgaacatatgagtgcatgtatctttataatagaatgatttatattccttcaggtatatacccagtaatgagattgctgggtcgaatgatatttctgcttctagatctttgaggaattgccacactttcacagtgattggactgatttatactcaccccaacagtgtaaaagttttccttttcctctacaacctccctagcatctgttaagtttcttaaccttaataattgccattttgactggtgtgagacggtatttcattgtggttttgatttgtatttatctaatgatcagcaatattgagcttttttttcatgtttgttgactgcataaatgttttcttttgagaagtatctgttattgctatttgcttactttttgaaggggttgtttgtggttttttttttttttttttgtaaaattaagttccttgtagactctgaatattagacctttgtcaaatggatagattgcaagattttcatcccattctgtagattgtctgtttactctgatgatagtttctttttctgtgcagaagcactttagtttaattagatcctatttgtcaatgcttgctcttgttgcaattgcttttggcattttcatcataaaatctttgcttctgcctatgtcctgaaatggtattgccttgcttttcttctagagttttcataattgtgggtttcacattttagtcttcaatccatcctgagttaatttttttataaactttaaggaagtggtccaatttcaattttctgcatatggctaaccagttctcctagaacgatttattaaatagggaatcctttctccattgcttgtttttgtcaggtttgtcaaagatcagatggttgtaggtgtgtggtcctatttccgagttctttttctgttccattggtctatgtgtctgtttttgtaccattaccgtgctgttgttgttactgtggctttgtactatagtttgaagttggataggttggatggtgtgatgcctccagctttatcctttttgcttaggattgtcttggctatttgggctctttttttggttccatatgaattttaaaatagtttttttctaattctgtgaagaatgtcaatgatagtttaacgggaatagcatttaatctataaattactttgggcagtgtggccattttcacaatattgattctatccacgaacatggaatacttttccatttgtttgtgtcctctctgatttccttgagcagtgttttgtagttctccttgaagaggtccttcacttcccttgttggaatgctagtgacttttgcatatcaattttgtatcctgagactttactgaagttgctaatcagcttaagaagcttttggactgagaccatgctactacttcatttaaccatatattgcaaatatttttcatcatttattaaaatgtttcataaaacatgatagttaatgtatgcttagttgtataactcagtgtttttatttggaaaaaatagaaaaaataagatttggctgtcttatgtagaaaaggaaatcattgcaacccacatcactgggaagactctaaaataagaattatgccaaaaatcatataaaaagggcatgactgctgttgaatctgaacaagaatgccatagctctcaccaccaacaacgtggccctggatccaggccttactgaaacatcaatgatacaaccacttccatataagctcactggtacaagtgccaccaattacctgaatagattctccttggttttgagttccttgtatcaacaatatctattaaaaattctaattctaaggtaggtgcactggaatcttaaagcctggatctcatgctgaagcctcagttttgaggatgcctggattttatttcagcatttatactgggtggtaatgtctgcctcccaaccatattgacaaggaggaaaatcccccaaaacagggaagaggtttgaatgctgggcagccactataatgttcattataatagtatttctcatgaaatgaccttaacttaactatccaattccttagtctgaatatttatgacactttccataatttttttaaaaaaataattctgtaatgaccactttgcccaaaaccatttgtatttcagattgttttatttctatacacacagaaatggaattactgagtcaaatgatacaaatatattttaaaactttgatagatatccctacattaccccagggaaagtttccattaatttacactctcaacagggagatataaaagtgtcagttttcctactaacttgtcaactctggctatcctcattttgttaaccctttcctagtatcactagttttaaaattaacaatttattgctgttttactttgcatttccttgattattagtgaggttttaataattttccatgtttgccatttccatgtgtccttttgtaaattggcaatttatgtctttgacaaagtttagtcatattttctttattctttttttttttttttttgagatgagtttcactcttgttgcccaggctggagtgcaatggtgcgatctcggctcaccgcaacctccgccacccgggttcaagtgattctcagcctcccgagtagctggaattacagacatgtgccaccacctctggcaaattttgtatttttaatagagacatggggtttctccatgttggtcaagctggtcttgaaatcccgacctctggtgatctgcccatcttggcctctcaaagtgctgggattacaggtatgagtcactgcacccagccatttttttttttttttttgagagagagtcttgctctgttgcccaggctggagtgcagtggccaatctcagctcactgcaacctccacctctagggttcaagcaattctcttgcgtcagcctcccaagtagctgggactacaggcacgtgccaccactcttggctaatttcttgtatttttagtagagacagggtttcactatgttggccaggctggtcttgatttcctgacctcgtgatccgcccgcctcagcctcccaaagtgctgggattacaggcgtgagccacagcacctggccttttttcatttcttaaaaattgtcttcattaatctgttgtaatctattcatatgccaatggcattaaagctttatctgcttttttattttgtttttaaatcactttatcgtttttttttttttttagatggagtctcgctctgtcacccaggctggagtgcagtggcacaatctcggctcactgcaacctccgctttctgggttcaagtgatctcctgcctcagcttcccaagtagctgggactacaggcccacgccaccacacccggctaatttttgtatttttagtagagatggggtttcaccatgttggccaggctggtctcgaactcctgacctcaggtgatccgctcacctcagcctcccaaagtgttgggattacaagtgtgagccaccgtgtccagcctctagagtcttttaattttatatatttacatatgtttagccaaatttgttttctatacctttcatttacttttatgctaagacagccttccacactccattggagagacatttattgataattctttctagtctttttctttactttttacttttaaatctttaagagatctggtgttaattttcatacatggctgtttagtaaaaatacaattttttaaaaaattaattcattcaaaaccatttgttgaataatgacactttctccgttatgttaaacctgcatcatatgtgacatgaccatatgtggtagacttttgagcctttcatttagatccactgacttgatggtttttaaatatgttttgcagatgtagttttctagctgtagaagtctttcttcccaataaaataataacttttttttttttaatttgagacggagtctcgctctgtcacccaggctggagtgcagtggcgcggtcttggctcactgcaacctccacctcccgggttcacaccattctcctgcctcagcctcccgagtagctgggactataggagcccgccaccacgcccagctaattttttgtatttttagtagagatggggtttcactgtgttagccaggatggtctcaatctcatgacctcatgatctgcccacctcagcctcccaaagtgctgggattacaggcatgagccaccacacccggccaataattattttttaaagttggttatttatgcctgtccattcttcataattaatttgataaatttggtgtaatttcagtttcaaaagctccaaagtaatttttagatacataaaaaattcaatttaccttggggatcattatattttcattttaaacatctttacatctttaatgatatttgtgttgccattcaagaattatttcgttctattgtaaaacaacagcaaaaaatacccaaacaagcaaacaaacaaaaaagccagttctttcatcctttcaatttttgcatttatgttctctccattgtttatttaatttattcttaaatgttcttatatttttgcagctttgtgaatgaccatttttagtatattttatgtgtttgttataactatatatagaaactattgatttaatatatttcttcagataaatgcacaagttaccaaactattgttagtattcttaatatactgtatattaatacaaattaatatatttgttagtattgttaatatatttgtattgttaaatattgttaatatatttgcttattaatttataagtgtttttctagttaatcatattagctggaaatattgataaatttatttcctcctttcccatatttaaaccattgtattttattatcttgtttcattgcattgactatagcccctaaactaatgttacgtaataataatgattgttggtatgcttgcattagtcctgactttaattacccatctttttcatgttaagaaataaatcatctatacttagctcactaaattccagagtattttaaatacatcaagaatagaagttaaactatatcctatgtattttgttcctcatgggattatctcatgatttttgtctgttgactttgtaatgaagtatattttattcatacatttctttataatggattatgcttgaaaaaacctgcttaattatgctgtatttaatatttaatataattttttactttattcacaggttttaatcttaatatctgccttaagtattattgccttcagtattattgtatttcactttcactttgaaataatttcaagtttaatgaaaagttataagaataatacaaatagttcccatgtatccttcacccagactctacttaagttttgtcaattgctgcgtcatgccttgtctagaaaaaggtcacatagtatacccagttgtcatttctctcttatctccttcactcttgggcagttcttcagtctctcttgacttttataacctagacatttatgaagattagaggccagtctttctatagaatgtcctttaatttgtgtgtgcccaatgtcgtcctattattagactcaggttctaggaaatatttcacagaagtgatgtgtgtttagctcattgcctcttatcttttggcaaatgatgccaatttgtcccgttactagtagtgttaactttgatcacttgattaatattgtgtcagttaggttgtactacttttttaattagtcttttctctcttcgtatttaacaaatatttgtgggcagctactttaacattattccttatttcatttccacttgcaagttttagtatccattgatatttcttgctggaattaattatttctgtgatggttgccaaataatatttttaaaattccatcattccttctattagttagcattctataatacaaaagggctttatatcctctttatttatttatttatttatttattttactttattttattttattttatttatttattttttttgagaaggagtctcgctctgttgcccaggctggagcgcagtggcctgatctgggctcactgcaagctccgcctcccgggttcactccattatcctgcctcagcctcccgagtagctgggactacaggtgcccgccaccaacacccagctaagttttttgtatttttagtagagatggggtttcaccgtgttagccaggatggtcttgatctcctgaccttgtgatccacccgcctcggcctcccagagtgctgggattacaggcgtgagccactgcacccggccctatcctctttacttaataaatagtgcctaatttatatcagaattgtaatatattgtaattatttctttcaatacccaaattgtcctatacttggctcgtgaaagtctctctcaagctggcttccgtgtacttttggcatgactcgtcatttttttgagtacattcttacttcctggcccaagagatgctccaagttatattgttccttccttgccccagtcctggtaccagctgtttctccaagtaacccttccttttagtgaatagttatattttaaaaccaacatgaagatgctaagtattaggtatatgaattgctactggggtgtctgtgctccagggcctcttagtggggaagggcagggttaggaaatatatgtacacaattctctctctcttctattaaaacttattaataatcattaataacttcaatttcatccaacatcacaaggttcattttagctttctccctgtccacatttatactatcttctccaacaataagaaactttttatcattatccgcaatatttttatttacttcctcaattctcttcaatgtagccaaggtcccaactttcccagatgtttttcccttcagctgctctcttgggtgggcctggcccttcggagatgcctcctcactcagaatcctttcttcttcaggccttggtacagattgggctgctcttccacaacacttcagcctgtctaatagctttttaactaataagaatgaaagaagctggctaagtgcggtggcttacgcctgtaatcccagcacaatgggaggccgaggcaggcagatcacgaggtcagtagttggtcactggcaaacatagtgaaacccctgtctctactaaaaatacgaaaattagctgggcatggtggcgcacgcctgtagtcccagctactcgggaggctgaggcaggagaatcactggaaccctggagaatcaggccactgcgctccagcctgggcagcagagtgagactctgtctcaaaaaaaaaaaaaaaaaaaaagaatgaaagaagccttattgtattttgtatacttaaattgtttttcactcaggcagacctaggactggaaacattataaagacaacccatgtcatacagaagagttttgtcaaaaaaaaagttgcctatttgtagcaaactgaaaacaatagaaataactatatattaaatatatatatgccatctttcttgactttttaaatacataaattcaaaaaattgcctttaatatttttaagagtacatttttaaggtaatgtgtagaaaacacaaatgctacagttaatgataatttatagtggcttatggtactatttaaacatatttgaaagggtagatatccttattttaatacctaagattaaatatctgtgtaacaaccagatcatgtgtgaatagccacatatgatattgcgtaaatccaagtaaaaataacttgccatagaccggatgtagttacaatatttagcagaggcagatacaataagaaataaatctctacctccacatcttcctaataactctcaaaattctccccataaggcattaaaatcttcatagattcaatgattcaagatttaagtataggtgaatattagttaatctctgtcttcaagtaactttctttttctttcatgaagtctatattttcatactgagccaactcttgtgccactattggtactaagataactttttctcttttcccttattttctctcctttgaagaaggaaggacaaaagcagtttagattagaaagtatgtggatgtatataggttatataatttaataactaaaagatggactacaggtatataaaaagggtttggagatagtaattaattatgcttggatgggattggtttagataaaacttgaaatcctttctacagggaagaatatcaggttaaaactgcatgaggcaatattgctaaccatcttaactaaaaagtttcagttcttccctttcattagctgtctggttgctgatgtgaatagtgaagtctttcaagtctgaacctgacctattaacagccaatcaagaggctattgtctgaaaaattaagctgaagagtagaaaaattagtagacttcagcatataaaattcaaatgagaaaattccagttaatcactaagattctcaataatcaacaaaattcacactaagaacaaatctaacttccaattcttattttattagaatgccttaaaatttaaaaaggagctataggctaaacttttgaataaaattttataggcaatgtataattgttgaaagaataatcaatgcaacatgagtttattaagaaagggaaggaagaaggatgggagtgaaggaagaaagaagaaagtaacagaaggaaaggagagcgattctgagagaaaaatgagataccgtcttggagttctgggtaacagattttggtcagcatttggaatggttaacagaattgcaaaacttgcttctaaaaatttaaatcctagaaacaataagctctagactaatcactaaaaatgtaaattgggggccggcgaggtggctcatgcctgtattcccagcactttgggaggctgaggcgggtggatcacaaggtcaagagatggagaccatcctggccaacatgatgaaacctcatctctactaaaaattaggcaggcatgatggcacgcgcctgtagtcccagctacttgggaggctgaggcaggagaattgcttgaacctgggaagcagaggttgcagtgagccaagacggtgccactgcactccagcctggcgacagagcaagactctgtctcaaaaaaaaaaaagaggttgggtttcctaatatttaagttttcaattattaaatttaaagggcatctagagacattataattttaagccattttagatttatatatattctaggattaatgagatataggaaatgaggctttttaaatgtggagattttaaaaacacacaccaaacatgttggtcttataaggagtcccactctcatattttttcacaattatattattttatataacataattatgcaatcctggcaactaatggataaagtccgacaagccatgtgtgtgatttgaatcacagtgctgagaaaaatgtatgggattctatttagtacgatagtgaaatttaaatctttatttagaaatacattttaaaacttcaaaatgttaaaaaaaattatctccaattttagtatttgcagattaggccattttgaaaacaacattagccaaataagaatagcataaaaatgggagcaaaagattcaacataaaaatgaccactctattattggtaccaacttaacaattaggcagtacgtaaattgaaaatatgataaaagatgcgttgtaaaatatggtgaatgggatatttaaaaataagattctcgttttaaaaatgttgtcatgtgaggatttcctttgtattcatacacacatgaaggtttttaatgtaacatttaaaacaaataccctagtttttggagccagtattcccagggctcaagcacatgagattaatctatgtttttgatgagtctacagatattttatatgatttactattataaggctctagtacctgctctgtagagttttatatataatttgattcaatgtcatacaagaaaacgaacaagcagggagagtaaatccctctctgattgcttagatccttagagtagtagctcttgatttttgtgtgtgtgcatctgaatcacctgcagagcacaatgattcagaagtttagttcccatttttataaattctgattccattgttctggatgtggttctctggaatctgcattttgacaagcatagtaagccaaaatgttgactttgcttcagcctatacaagaatcacatctagaaatgctagtttaagaagctctctatggtagaattctgcaaatgttcgttgcggcactgttcagaatagcaaaaacatggaatcaacctaagtgcctatcaatgacagactggataaagaaaatgtggtatatatacaccatgaaatattatgcagccataaaaaagaacaagatcatgtcttttgcaggaacgtaggtggggctgtaggctatcatccctagtaaactaatgcaggaacagaaaaccaaataccacaggttctcacttataagtgggagataaatgataagaacttatgaacacaaagaaggaaacaacagacactggggtttatttgagggtggagggtgggaggagagagaggataagcaaagataactactgggtactaagcttaatacctgagtgatgtaaccctatgtacaacaaacccctctgacgtgtttagctatgtacctccaaacctaaaataatttttttaaaaaagaagctctctagaatcctaaggaagtaaagctgaagactagatgttaaggaaaaggacagctgaaaaaaatgggctagagggacccaaaataaaaacggaaggagcctactgcaaagataataggcaacgagtgaaagcgtctgttagattctgggtagcaccttaggacaggagtgagttttatggaaatactggagcaccagcaacatcatggtatttgtcatcatcatcaacagcattgttatcaacatcatcatcaacctactgggtgagaaaacatgatctccagacactggactagaggtttacatagatcatctaatccttacaataaatttaggaggacttaaaatattagttttatgtatatttttcatatgacaaaactgagccttagagaaattaagtggtttacccccaaagtgtatttaaacagcaagaatgaaaacagatttgaatcaagcaatgcaactctgcagagcccaccttctaaactgctattctttggtgatatctcatagcacctttgagctcaggttggcctcaccattgtgtaaggaaaaggaatacagtatttacataatgattagttgaactgaatttgcagaaaccatggcggatgatcatggcaggacataaaaaatcaaaagtgtcttagagtctaaagaaaggtgctgtgaggttaggaaaaagggagatgtcagccattcctagagttagtatctttgatgtggtgaaaacaatagagagctgaagaatggaatagaaataaatgggaacagtgtgaatggatggaacctctgaggggcacaaggctgaatgccccaaggggaagtgattcagccatctggtgcttgagatcaaattatctaatatgtacgtaattgtccaaaaattccccttggcgactcaggctcaaggaggataccatgctttctttatcccccttgtaagtacaagctttgttgttgatttttttctgtcaaaacaaatacaatagtatcctgaatcagacaaacatgggtttgaaaccctgtcctaagcctacagaaagcctttggcagactccttcctgtctctgaacttcaagcttttgcatatatataaaataaagtgagaaacatctacctaaaagtaatattattagaattaaatgagatagtagataaacaggacttggcacttctccatcccttaagttaaatttaatttcatttgcactgccatgtcaggaaggtacatgcagtatctaacataattttagttctaacccttgtgagatggtcatgtttgtagcttaagagtacaaaggtaaataagaaaaaaaaaagaggaacattgggcatttggtgctaagagctcagacttaaatataaattcttaactatgaatccttaaattagtctttaaaatcatggcaaaaaaaaaaaaaaaaccaaaaaaaaccaaaaaactccattccagtggaaagtgctttagatttacagatctgcttggcactcaactattccctgaactgtcttgtgactttgagcaagtaacctaaatttaatgaacttctatttgctcatctagaaaccaagggatatagtgctcagattgtcaaatttattcagtataggataatacacaatttctagttacggtctctagtggctttttagtgacatcaaagtccataaagctactaaaattgtgtagaaatatcacaatataatcaatcagtttttttcaagcataacccattataaagaaatatatgaataaacaatcttacatcagaaatcaaagaagaaaaatcacgagataatctgaataactggtcagtaggtaaaatctgttctaagtgatcctaagtaaactagttatctctcctccttctgccattgaatttagtagaattttttcttatgttttgatgtgtgtgtgtgtgtgtgtttgtgaataaatgtgtgcttgtatttgttttgagggagttggtaaattaacccattggcatatttacatatttctagttatgtttacaaatttaaataggttgcctaagatccataccctggtgtctttcttgtaatggagcttaagtacgctctactaagctacaagaaaaacatcctatgctttgactgtgattggaactttgcaagctagtagacatgcctttacaagcaataaaatgaagctgtcagccattgcaaatggaccaaaatagaggccacacgactaaagcacccctgcaccaggcagtctctgatgtattttattccagtttcaatctattaatcagaggagttgggagagcaataatttaaacactacaataatcaattccataacacattaatagaagctacagttaaacttttccacaccactgactgcattggaaccttgacaggagccctagggccatgcctaatttgcattaaatttacatagaattataaatcaagaatacatgaacacagccctaatgtttgttagtgcttagatctttcctgatagatacattgaaactgctggtggttgggcttcacttgcaataaaattgtgcagctgatcagctttgttctcattctgcaattatggcgaaagaaacccaattgagcaacagtttgggggtatgtgagtgccatttaaggtttttatcctgtaaaacgatgactcagatgtgcccttagatcccccaatctagaagcaaattgtccccaattactttgcagatctttgtcactggatttcatcaccagtaacttgtcattaagtagagatacaaactacatagaaacctgaacagctgaaaaaataaaaagtcctctggaaaattttattttttcagaagaactttgctatcacaaaaaagataattagtgctaatcttcagggtgaggacagataaacccaaactttcttaaactcagcaaagcatctggtacctaacagggtggaaaagtgtacttcatatggccctaggcattctgtgtgttctggtatccctgatttacattgttccaacagctgtggcttttgccgtgtgttttcacactcagggctaggtgaaaacattctcaccaatgttactggctctcagtaacaggagtacactctctatattgttttgggtcctctcattttaagtgtctttttagacagaaaatcgatacttaagtccaataatatctttgggaatatttcttttcaggaaggattctgcaaatattttgtacattattattctgcaactcccacctctttcttaccacccttctatcccacactttccttaccttgtacgatcaagtaaacttgggaggtcttgggctcatgctgtgtctgaactgagcaagtgtaggaaccctcatcatagacatccaccttctggattcggaggctgtattccagagaatggcgtttctccagctcaacccgtgggtccagagaccacttgtcatgtccagcaaaaatgatgccagaacggttcaaccaggccacctttgagttcttgtcttctacaacgcacctgacagagcagagtaacaatattagtgccttaacaacaactatttctgcgtttcttctctaggtgatcagactcaacaagtctaaacaaggaaaataattatatgcagaatgaattattgccatgccattcttggagtccttagaattttcactatttcatttaagatctaattaccatccagtggatggatgtcattatattagactcagttcagcaataaacaatctgagtatgagtaatgaaggcaaagttaaattagtattgacttcccattatcttcttcttgtttaggaaaaggccactcactcagaactccgtctgtttaagtaattttgagaattatacaattgatatcatagcacttttactccatcttgaactgtgtttactcttttataagtatttcctatagtattgtgtaatgatagattaaagttatactccaccattataggaattagactagacttctgagtttacttctaatctttacaagtttgggatgccacttccaggagtaaaaattgtgtgagcagatccaagcataaggggataggtgttatgacaaggaaatcaaagcaaacatcatctggcataagtttggttccagctgctgaaggcagaagcttgtttggtggcaagttaggttgctaccagcatttctagtcacactaaatgcaggcaatctttaacaaagatgaagaagccaattttgtagtttatagaccaatagatcaaaaagggtaaaggaataacgcttaattgaattactgctttaaaaaacttaaaagggtctctttctgaaatttgaaaggggcaaagaacatgcattagtgaaggaggggtaaatactttttggtgagtatggttttctccttcagttccagcaagagtcttgcaatggaaaaatctagcagaaaacaaaaacaaaaaaaccttctgtctgcatccctgtggcaagatttatgtctgccccatagggagatgtcccaaaccctgttcacagctgcaaagccagctgctcaacactctggagcaggagggaatgaacagaaagagccacgagcaccacagcaggactattaagacaccctgttcccctgtattttctaagccaagtaaaatccagtttttatctcaggtcaaaacaactaaacatagacagaaaattgatgcataacccataggctgtcccacatggaatataaaggccaactgtgtctcttacaagaaagataacagctaagtctttttaaatactccatttatggtataatacaaagacctccttatcctattaattttaaacgaattgtatatgttatttagagggagatttttttttttttttttgagacagatcttgttcggtcaccaagactggggagcagtggcctgatcatagctcactgcagcctcaaactactgagctcaagcaatcctcctgcctcagcctcctaagtagctaggatgataggtgcatgccaccaggactagctaatttaaaaaaaaaattagagatggggtcttgctgtgttgtccaggctagcctcaagtgatcttcccaacttggcctccctaagcactgggattatagtcatgagccaccatgcctgaccctagagtaagaatttgacttaataagttgggtgccaagatacacaggtcttacttttcttctttacctatttgttttcataaacataactagatttaggtatcatttaacatctccatttcccagtatgtgcttctctgccatgcatatattattgagtataatttatgtgtttaataatttagaggccttttatcatgagcaccaagctaacttcatgaatgcttgctgcctcattccagactcagttttacttttgctgttctcctctcttgtggcatcatttctctgttcttggtgatgtttgccgcatctctgaatttaaaatcattgatgaattaattaataggatgtttggtgtcttactctagaccattatgaaattgttgaatgtagatttaccatgttttttctattctagtaagaaggatagaaatttacctgtgtaaatgtgttttaaatcttctatcatttttccctgtgcatgtttctcacctgcacagcgtaacacaagaatggtcagatttgctacattatagatgtattctgaatgcctcttagcaccaaatatggctccaatctcttcactttaaaagaaaaaataccacgtaatatagcttacctaaatatggcctgtgaatccaataaaaacagcaaatttttaccttattcatttggataccaccaataactaatctaggataaaacaggcatttgataaatgcctgtcctgtgaactaactgggtcacacatgcagatacaggacatttggtaacctatattccacgtccccatcccaagtcctatagcacccacaaataaattggacagatttccttaacaatataaggtaaagtttataagtcgggtctttatggtcctttgacattttagcaaatttcattcatggaaaagttaaagtcatacggatcattattccaaattattctttgagggtgttcagctctatcttacctaaagaagtaattgaccatttcagcaaaattgccagatgcataaaagtgcatctaatgaaacaatgtattatgtggaaattttgttatgacaatttacatagcaccttgtttttgatctgggttttatccgtatttatttttaaaattcgtcttttactgacaaacaagtgaatagtatattagaatacacatatacttttttttgttttgttttgtttttgagatggagtctcgctccgtcgcccaggctagagtgcagtggtgcaatctcagctcactgcaagctctgcctcccaggttcacgccattctcctgcctctgcctcccgagtagctggcactacaggcgcctgccaccacgcccgcctaattttttgtatttttagcagagacggggtttcagcgtgttagccaggatggtctcaatctcctgacctcgtgatccgcccacctcggtctcccaaagtgctgggattacaggcgtgagccaccgtgcccggcctagaatacacatactttttcctaactcagatggttagccaaactccaagcaccagaacacaatacagtatagtgtttttaaaaaggaaaccatttcaaggagaaatttgtttaaaataaatatatctcaatggaaaaaaaataaataaataaaaataaaataaaaaggaaaccacttctccagatctttcagggttcctttttatgtactcagtagttgcaaaataaatctattagctctataaactggaaaataatccttctacaatgtgactaaaactttcttaataaaaaatgagtaaaggaataatgcaatttcagaactaaatattttcttaattttagaatcttaatttaaggtggcacctattttttttaatcataaaaagtacacatgaaaaaaaatggtaggaccaggcacggtggcgcatgcctgtaatcccagctctttgggaggctggaggcaggaaaatcacttgaactcaggagttcaaggctacagtgagctatgatcacatcactgcactccagcctggccagagtgagaccttgtctaaaaaaaaaaaaaaagaaagagaaagaaaagaaaatatagtaaaccagaatcagtagtttcaatttgtagaggtctacgtttattaagagataataactagtcatacagtgtactgacagaccacctggctatctggaaataagaaatgctgatataaatacagacccaggttcccagcattcactgaatcaccaataagcatcatgggcttgcatctctgaggtctgctggctcaactgtgcattaggcaggcttgtggagtaaatgagaattctcgggccatgccattataatatgataataatgaattatcacctacctagaatgttgctgcaatttagttctaaactttatacttaatgattttgtttcgggggacctgccccggaaaatcacgtaggttcttttctattttcctaagcgtcggctggcttgagaaataaaaggacagagtacaaaagagagaaattttaaagctgggtgtccaggggagacatcacacgttggtaggatccgtgatgccccacaagccacaaaaaccagcaagtttttattagggattttcaaaaggggagggaatgtgtgaataggtgtgggtgacagacatcaagtacttaacagagtaatagaatatcataaggcaagtggaggcagggcgagatcacaggaccacaggaccgatgtgaaattaaaattgctaatgaagtttcgggcaccattgtcattgataacatcttatcaggagacggggttttgagatcaaccgtctgaccaaaatttattaggtgggaatttcctcttcctaataagcctgggagcgctatgggagactggagactatctcacctctgcaatctcgaccataagagacaggtacgcccctggggggccagttcagagacctacccccaggtgcgcattctctttctcagggacgttccatgctgagaaaaagaattcagtgatatttctcccatttgcttttgaaagaagagaaatatggctctgttctgcccggctcaccggcggccagagtttaaggttatctctcatattccctgaacaattgctgttatcctgttcttttttcaaggtgcccacatttcatattgctcaaacacacatgctgtacaatttgtgcagttaatgcaattattacagggtcctgaggtgacatacatccttctcggctgacaggactaagagactaaagtaaagacaggcataggaaatcacaagggtattgattggggaagtgagaagtgtccatgaactcttcgcaatttatgtttagagattgcagtaaagacaggcataagaaattacaaaagtattaatttggggaactaataaatgtccataaaatcttcacaatccacgttcttctgtcatggcttcagccggtccctccgtttggggtccctgacttcccgcaacaattttatctctagaatcaacctgggctaaagcaggaagataaaaagatgtatttcaaaaacctgttagtgttatgtgttgttttaatagaatgttgtcttgaggaacacatgatgttgcaaataattcccaggtttagaaagaaccggaccctaatgacaatgggtgttagtgccacgaggagaggatcagagaatatccttccgctttgggtgggttttatggaaggcagctgaggacatggacgtatgctataaagtgccacctcttcagaaaatcttctctcgtcagtgtaaccttcttaaaacttcctttttatgaccttatcatactccacattgcattagagttatttgcactcatcttttctcataagcttattaagacagtgaccttcttgtaattcacctctggagccctcactgagcctaaataccatgtgcataaataccatgtgcatagtagatacttgctgaaatgtggaataaacaagctgaatttaatttaacaaattgcattaggtcaattataaaatattcattaattatctaataggtacagtaaagatggataactattttaatatttcttaagaaataattaaagttattaggtataaagggaaatttaaagagaattattgagtgtggtattaaaatgaaagtaaaggagagaaaaaatgtgttcctgtgtccactatgaagaaatatcatctctaggaactaaatgatctatattgcatgtgaaaaactgtgaaaaaaaagtataacatcctaaataagtgattaggaggttgctcacgttaatcatgaaccctcaaatattagatgggttacctactggaactgcaaatctatgatttttaaaaaatcatctcttaaaaaaattaggaaaggtaagcacacaaatttttatcttccctgtttagtatatttgattccataaaactgtcacaaaaaatcaatgcacccatacaaatcttaagcattgaatttcttcaaacactttacatcaagtctattatgcagacttatacaaacaggtacattgacaattctagtaacattgcacaagagtgggggttatactgcttaaaaaatgaatataactggaggtagaaaagaaatgctaaaatcagtttgtaccaacagattacttaatagcatatgtactgacaagatatctatgatgtaattgatacatatctaccaaatattaagcctgttcaattgctgctggacacatttcatatttaacaagcattaatggctgttaaaaaacataccaacttaggattcaaatttgtccagacttagccttgcataaatttccttcttttctcaagagtataatctggtatttattcactgataacaaataaatatattttatgtaatccgcaccagttatctatactcatatttatacattgcagaggctgggagcagtgtaactggatgggtaagagaaatctatttgtttcttaagaaagaacagttagataagtggtcccaagtgaaggcaatctgtgcccctagatgacactgacaatatctggagacattttttggttgtcacaactagggagggggtgttgctattggtttctagtagggagaggccaggggtgttgctaaacatcctacaatgccgtggacagcccccaatcacaaagatgtatcttatccaaaatgttgacaggatcgaggttgaaatacccagatatagatgtctgtctcttggtttacacatccagaagcataggacaaacatctaaagtgcagtagtgtgttttcataggcttatgctttttaatttatacctacttaattgtcagcagcaaagttcatgacaaaggcacagcaatgaggcctagtgaggctctggttgtaagtcgatagttaatgattataagttagtagttaatcatgccccttttgttgttttactttagtttcataatcgtaaaatgatgtaatcatttcataacacccaggataggtaaaggagaatcatttggagaaaaattgattttttttaagaaaattagtctttgttcatcagaaaactttttcattgacctttattatttttcacatttgtgaatctccctcttttgtaagatatggaaagattcaagatgtggatgggaaggatgtcttcaagaatgttattttgatgctgtttgccttgtaacttcaatcctacaaataaaacccttagtgaatcagcaaaactatcatagaatcatttcactctagaaggaaagataattggtctgggaagtgatgctatatattcccagcattaaaatgtggaatcagaaaaattctaagcagagaatggaataaagcatgaaaatatcccagattctcctgagtcagaagtccttagtctggttttataacattattttaagtataatgaattccaacaactatgcaaacacatcaaaaaaataaataccaagttagttaaaaaccaaatttaaggaattttaaatcatcaatcattttgaagcatctttgcttcattaccattttctaagattagactcaattagaaataaaaaaagaactgtgggaattcactgctgacactcaggagccctgttagcctttgctgcaactaaaagcttcagctccttaccttccttgctcctagctttagttcttttcacacctgacctctggttggacccctgtctgctatcttggtgtcattctcttgctcttgtgcatgtctgttctcctcatcttcattcccttgacccagaccctaatcttagtttggtaatggttgacttctctggattcataccaaattgtagaccagttaacactatgacagcatctacatgatcagattatctcccctcacccttgcttctttgcacacattcatatacaaatggctacatgcacacacagaagtagaaatggatgttcagggcagggtaagaacaccgaggtagtagaacacagaggtggtaaacccacaggaactgaattcatgtaaatatattaccacatgattcagaaatctgtgtactgtgtactgctgatggagtgctagtgtaaaaaacaaacagtttagatcctgaagaggctcattttagttctggccttgcagcctatttactattggaacacagataagtcttttaacttttctgaatcttagtttcttcttaagtaaaatggggctaacgatacctgttcaacctcttagaaccattctcagcatagttctttaaatcaaatgaggtgacgtacatagaaacatttcataaaacaaagcaatatatatgcttatattcatagtctctcattgtaaaggatagtagataaaaagaaaacagtcatataagagagataactaaaggaaaaacattgatttctctaatcacattcaaaaagttaacctctttatattttgcagtgtgatgaaacccactaaacatgtattattacccagactctcagatcaatcatgtatttctctaaatgctcaacttttattagttattcacatgtgctctactgtgaaagcaccctttctgtgattaggctaccacttattacaatgatcatcacctgaaagtgcaaaagttcacatggcaaatggcaaaacccagacaagctgcgcaatttctggagcaatgaaaaggcctccatagacatgctttttgtctcttactatcactaaagaacaccttgtccagtcatatatgcattgttatatatgatacatgcatgactacatttcagaatcatctttttgaagaagcacagatgcatatccatgcagatggtagaggttaagagaagagtggatggaaaagaaacaggaccacccaattaagtcctgaatgtgtctcaacaaactcccttccggcaccatctgtattcctattgttgtcacatcaactgtgccatctctacattcacatagaagaaataaatgggaaaaaataagacacaaattctaaaaagagataagtattgagactgagaccaggagagaaccgatttctatcccagtcacagctggagttagagtcaatcccaggaacatttattagtgattggaaagagctcttctaggatctttccaagagtctggatcacgtcagaaaaataaatcattctcttcttaatcacatctcaactcaaaattcttccttattttgtaagtggtgaagtggaaaagttatgggttcagtagtttagtagctttaggcaagttacttagcagagaaaggcagcgtggtggggtggcgataggtttaggctacaaagccaattttctgctctaaattctagcttcatcacatacttgctctgtggttttgggacatttgtttatcctctctgtgcatgtgtttcctaagctataaaacgaagatgatcatagtatctaccttgtttggcactcgtaatgtttaaaagggttttaaaaaaacatatagagcaatgcctggatctaatgtgtccaatattttcgaagagcttcagggtttttcttctgcaacacaggagtagtaggtacttcctcagattgttgtaactattaaacaggatatatttggagtacacagtgagctctggaagatcctgatacatttttatttccatatccttccataattcaaatcttggtcattcattatgtagaaaacccatttttgggatcaatccagcaactcccagatattgtggctcaatccaatctttgcttattaataggcattttcagggaaacccccttttaggggcttgagctgtcttgcatctgatagccccttggtcccctctggttagcaattggcctcttctagcccacagaatttaaatcaagagcaggatgatgcagcatggttatagtgcaatggtgtaaattgaggctctaatgccatctctggaacacttttaaaggatttttgggatacctgtgcataggcagcataggacttaattgtctcaccactttcaaccagatccacttagtttcataaagggcagaactcatacatggctgtctctctaggatagctgaaatagaggcccatgctgtgctttgtgatcccctgagatctgctggctgaattggagttccacctgaattggatgaagcataccctatgctttgaggactctcaggttgcaacaacaaggcctattctgtctcctcagtgactgagtggcaattatacgctcactaaactagcaagaatctacaacttttttctctcctttgaactagaaattctcctctttcctccgtatacagttgagagaggatgagaaacaactttaaattttgcttttgttttgattctccctatgagcctttgttctctgtgaaaaatacctctcatttggaaagagaaaaaactgcctttggttgtacctttgaaacagtaaaattagtcttggaattctggctcagatttgtagttaaaaacttcactcactatgcaattaaaaacaattccacagctatttgaagaaaattgtgatacttctgcatcattacagataccaaaagcattgctaagttctagatggaaaaaaaatatggtcttttccatgtagggtttattctttatctcattccagcagtagggagaaagaaatgctcgcaataaaccacaatccacaatgcacttaggatgagcattctgatgtataaggcatggctgtaaagttagaagactgttttccacaaggctcacttgaaaacccagccccttactttatagtcttgtcatatatgccattatgtaaatgttatcattggagcagaaccacattataatatgactcatcattacattacatgcattgagacataattcagatcaaattatgccaagacatgacaattaatagatacaacatgtatgctataacgaagttaacacataataagtatgtaagcccatgagtaaataagtaagtaatgagactgtcttcaggactaccattagaaaatggctctactgtctggtttgccttccctggtagaggtagaggtaaaagagacaaagataaaggcaggtgcatatgaagagcaaaagaagtctttttttttttttcttttagacacagttttgctcttgctgccaaggctggagtgcaatggtgtgatctcagcccactgcaacctcggcctcctgggttcaagcaattctcctgcctcagcctcacaagtagctggtgttacaggcatgcaccaccatacctggctaattttgtatttttaggtaagatggggtttcactatgttggtcaggctggtctcaaactcttgacctcaggtgatccacccaccttggcctcccaaagtgctgggattacaggcatgagccaccacacctggccagaagtctttatttttgaaatatattttgtggaaacaaatgtgaaataggggactccagtagctgcaaactgaaggagatataatcaaacagatctatcacaggcaaaggaaatgtagtggtctcctctcccagatgacaagaagccagtagatcacgatggatgcgtataaatcacaaggagcccgggcgcagtggctcacgtctgtaatcccagcactttgggaggccgaggcaggaggatcacctgagatcaggagttcaagaccagcttgaccaacagggagaaaccccatctctagttaaaaattcaaaattagccgggcgtggtggcgcatgcctgtaatcccagctactcaggaggctgaggcaggggaatcacttgaacccaggaggctgtggttgcagtaagccaagattgcgccattgcagccttggcaacaagagcaaaactccgtctcaaaaataaataaatacataaataaatataaataaatcacaaggacacttctcaaatggagaattataatcataagaatttttttatgacttccatgtttgcttttccatcacacactttcccccacctcacctcctatttttttctatttccagaattattttcttcagctttgtcttccaaaggacaatggtgtgaggaggacttcatccttgtgtaacaccctgtgtgtgtgtttttcttctttctctcaccaaagcatttttttttcctcccttttgctggaggcctgtctctttctcttgaacagatcaacaatcaggtcgtaaatgggagttggagccggatgatcaaaaagaactttagaaaaatgggaataaaagcaagagctgatgagtttgaaatgaaagcccatctgggagagctcttctaatgaactcagcctactcaaactgtacaaagaaagctgaagaatgattgcagctgcaatctccaacctacataaagcactaacgctggtaaggtgatgaaagtgaagggaggtaactggtatctggatttggaagagagaagtcaaaggccatcacccccttgtactactgcattcaccatgtaagttccttcggaaatttcacagccaatctgaattaaagagacagctgcagatgcttcaggatgaaggtcacactctgaattctacgaagagccctatgattcaaaagtaccatctctttagcctcagagcagttgtataccaccttctcacttgctctgtccctgggctagtatggctttgaaattatgttaaagaagaggcattttccctcacaaagactcccaaaatatgactattaagtgaaagaacaggtagagggagggaaagagctgaatctaagtggagattaataaagtgttgttttgaaattgttcctttatttttcctgggttaattatcgccatttagtcacgacttcctgacacagcaccagaaattttgttgaaatcttaatattctgcaggaaactgacctgactaccagcaggaattatattgactaattaataatgtccagtctccctcaaggataagtcacctctgtctggctctatcatggccactcttagaatgatggtgatggtccactgattgtcacatccaatgaatttatctgaagtatttgtcctatgtaacctcttcaaagctttcagcgccagtcaccacccagttttcattttcttgtttctcttcctaactctctcacaatttctcaatttccataattgtctcctctttctccatgcacacttttatacattgtttttctccaggattgtacttttctcctgatctcacagagcactcctaatacagtgttggttttatttacatttaatataattgaaatctgaaatggtatactcagctgctccatgtagatatttgagggtacctcaaattcaacatgtcctgagctgaaactcatcatcttccactttactttggttcttcttctaaattccctgttatcagttaatggaactctaattcatctataaatttaagctagtatccacagaattattatttttgggggggtggggggtggggtacagagtctcactctgttgctcaggctggcttgcaatggcacaatcttggctcactgtaacctctgcctcccaggttcaagcaatcctcccagctcagtctcctgagtagctgggaatacaggtgcatgccaccacacctggctaatttttgcatttttaggagacacggtttcaacatgttggctaggctggtctcaaactcctgacctcaagtgatctgcttgcctcagcctcccaaagtgctgggattacaaacgtaagccaccacccccagccaaagttattcttatttccttctttttcttcatgtgtcttatgtagtcatatattattttacattttttctaatttttaaaaaattatttaaacaaatttttagcacacaccacctttgttattctcataaattgacctctactctccatcgtcacttccactgcctttgttcagtgccttgtcatttgttaccagcatcactacgtagatttccaactggtgttttggtctgcgatattgtatccccttacccacagctattccatctgtctttcatagtgaacagaatgtacatacataaagttgatcatgtactcatcttatttaaatgttcgtggtctttttacctgtaaaaatccaaatagattagtaaaacatcagttcacttaacctagctttccaaccccgatctcttgacattacactccttttgctatgaattttatgctttattcagacttcaatctcaccctttctagatctggtttttcctttttatttaaaatgtcttgtttggcaagctcctgcttactatacaaaatctatctcagatgtgcccttctctgtgattcattctctccaatttccctagttgattctcagcttatgctagcattttaagtctttgtttttctgcttttcatcactattttaagagtgggcccaaaccatgtcttctcaacttttgcatctctattgcctatcaaagttccttacacaaagaagtttctagataattactcaatggatgaatgaatacatgggagtcttttgcctctcatctcacatttataagagtgtccccactctgatgtaccttgaaggtggaagaaacttactattccaagtggtgttgaaagcggagaagttgtgacaggacaagaagtgtttttctaatctaaaccaggtatcttatttccctatatttgcttctatcattttctctactcctctaggtctagaaaaatgatgatatctatgatacatctacgttatactataatagatatgtgaaactaaattttttgtcactcttttaaattgttttaaattgacatgtaataattgtgcatattcattacatgtgatgtttcaatacatataatgtatagtgatcagatcagggcaatcaacatatacatcatctcaaacatttgtcatttctttgtgttgagaaggttcaataacctacttttagctatttgaaattatatattattgttaactctagtcatcctatcttggtacagaatgcattagaacttatttcccttatctagctgtagttttgtattctttaacaaatctcttatcatccaaacagtaaattaaaaaataaatacaatatgcaggggaaactgcataactcaaattctaaaaatatgcttaagagtgaaaacaaaaactgatttcgaatatattgatgccctttctgtatttggtagacttaaatatgaacatttgtattatcttttgttagtgtctcttgacttagaggcttatatttaaggatcccaataaatattttttaatccatactcaatgtcatactgaggactaaccacctatgagtttatagagggattgtgattagatcataatcagttttctcactgatctattgaagcaggttaatttggtctcacagaactttaaaattttttctttctctacttcatttcactgtgaaattagcaattattttttcctgtaaggtaataatatgatcaagaagaaaaacaggaaggctgataaagagatatgtacagtagaattttctccactgatcctttgtctggaaggcaactaaaatttaggcagtccagattctttcagtcaacaggaggcactgtagttattcagataaaactatgtttcattccttaattttggtaaataccatcctatatttattttcttggattattataaaacacaatctcagaattctgtatatcacatctgaatctgcaatctgaattaagcaaaagaaaaaacttagaatgagattaattttatttgtctaactgactgggctaagtggtgcttagacagttgtttaaacattattcctggatgtgtctgtgagggtgtttctggatgagattaacatttgaattggtagactgagaaagcagattgatcttcccaaatgtgggtaggcctcacctaatccattgaaggcctgaatagaataaaaggctaagtaagaaagaattatctctcattacctgccttcaagctaggacattagttttctcctgccttcacacttggacttggactgaaattactttcacactatcagctttcctgagtcttcagcttattggctgtagattttgagacttctcagcttccataatcatgtgagccattttaaaattttatctatctatctatctatctgtctgtctgtctgtctatcttctatgggttttgtttctctgaagaaatcagactaatacagtaagttttaacaaaatattttaagtaagctgagcttagctcaatcaaatgaataataatacattattgtcttttataccttgctctttatcacactctaagaagatatttcttaaagtccttattctcttatcctcaatcacagtattacccacccccccaaaaaaaactttactaaaggaagttgctgctgtagctcatcaacatatgtccttatatttaaagaatattggtgtgtatagctttagtcagaggtggattatctagtttctttactatattaatcattgtattctgtcctgagactagaatatactgatataatagacagtgtagactgggcacagtggctcacacctataatcccagcattttgggaggcccaggtgggcagatcacttgaggccaggaatttgagaccagcctgggcaacatggcaaaacccctgtctgtactaaaaatacaaaaattagccaggcatagtgtcacatgattatagtccctgatacttagagattgagatacagaatcgcttgaacctgggaggcagaggttgcagtgagctgagattatgccactgcactccagcctgggtgacagagtgagactccttctcaaaaaaaaaaaaaaaaaaaaaaaagaaagacagtgtacatatcatatatttttgttcatgtgttctttctgtgtcacttcctctcattccatcttttttttttttttttggctatattctttgctttgaggacatgagtcaatgtaagaaaatggcttatttatatatccttccctttttgctcttatgcagtgtgagtcccttaaagtcccttaatctttatgaacattcttctgtctaaataagaccttgtgccatgtcacacgatgcttcacattaaaattatacctctgctagactgtaaaattaaggaagtcagagtccctaatttattttttctaagtgtatcagtgcagtaatgatttgagtgcacaaaaatcctacgggtattcaataaaaaattctgtaacaataaagataatttcaaaaataaaatttctgatttatcattgtacctttgtataatacctgaatcacagaatactgtgacagagggtaagaaaataggaactttatgaaatatgccctgagaggacagaatcagagtggaagtgatcaaagaatgcattgtttattaagtagaaagctttctctaagtgagcccacgtagatttctttccccatcactgagttctacacagggcctccgtggcccacccagaactcagtatgaacactggccagagagtccagtctcataatttcaaaacctttctggcagttttcacttactgatttatcctaatcaccagctcttaacagcaacaaaatggtaagaggaacataaagcaagatcaaaagatacatattcaatgcgaaacagtgtagcctgttagccccaagcaaggaataagtgaagaacactctccattgtgtagtaaagtgtttctgggaggctaatgttgttagatgcaaccctgcccaaggcaatgttaaaaaaaaaaaaaaaatcaaccacccaacaaagaaaactaggcttgcacctcatgttcttccatgcagctcacccaggctttgttcatcggggagaaatctaatatgataaagaaagatttgaagagattaacaaccttgcaccaaatattaactgaccctttctattatatcatttttgccgaaatcatccattttaaaacaacataaaaggtcagatactggagttgcacaggactaagatagtgtagaaaataatatatttcttacagtatcattctttgccatccactcgcaagtgaactacctcacgtctctccaaaattgagaaatgcaatttctcttacgttacttcataatactaagtctgctcactctacctttttaagaggtggtgctcatctgggacctaaatctacacaaaaagaccttacagacattccttctctgtcagatgaaaagttaataaggatatattgtaaaccagaatttttctagacttatcacacacacttttacctgtcatcctcataaaacatacagccatggcaggagcacagcggtggaagagaactattgctttggcactttcatagcaggcacccgtgtcaaatatagggcagaaaatgtgtttgaccatcagcaagcactagcctggaagagccagctatactctaaaagattttgaaagtttgacttgggtataggatagttagcatgatgaaggcattcatagaactcttggctacagaagagatatttttcagtttgactagggggaaaaaaaaaaaaactgccacagctggtgatatacagtctgggataaagaaacaaatactgccaggcaattctttgagactctgttctagccacacagtagaagcatgatgtgagaggactaactgccgcaaagaccttccagcttctccagcagtctactgactgccagatatggtcactttcatgcgcgtccgtgtgaaaagaccaccaaacaggctttgtgtgagcaacatggctgtttatttcacctgggtgcaggtgggctgagtccgaaagcagagtcagcgaagggaggtaggggtggggccgttttataggatttggaaaggtaatggaaaattacagtcaaagggggttgttctctggtgggcaggggcgggggtcacaaggtgctcagtgggggagcttctgagccaggagaaggaaattcacagggttaatcactcagttaaagtggggcaggaacaaatcacaatggtggaatgtcatcagttaaggcggggcagggccttttcacttcttttgtgattcttcagttacttcaggccatctgggcatatacgtgcaagtcacaggggatgcgatggcttggcttgggctcagaggcctgacattcctgccttcttatattaataagaaaaataaaacaaaatagtgttgaagtgttggggcggcaaaaatttttggggggtggtatggagagagaatgggcgatgtttctcagggctgtttcaagcgggattaggggcggcgtgggaacctagagtgggagagattaagctgaagggaggtcttgtggtaaggggtgatattgtggggatgttagaagaaacatttgtcgtatagaatgatgattggtgatggcctggatacggttttggatgaattgagaaactaaatggaataagagaaagagaaaaacaggtataaaaggtctaagaattgggacgactcaggatatctgattagagagtgcctaaggagattcagcatagtcctgccagcaaagattatttatttacttcaagagtttagagtagcagtttggggatagcaccaggagatatcagctgtaatggcttggagaaacagtgtaaaccggcagtgtaaacaagagcagggcatgtgtgagtagttgagaatggtgaataggagtatgactagacagaagatagtagggatgacaagttttttttgggggtacagtctaagttggtctggtgtctggaatgagactggggcctaataaaaaggagtgtctatacagcagctcaaatgggctgtaccttgtagcattctgaggacaggtctgacttctgagaagggaaagtggtaaaagtattgtccagtcctttttaagttggtggctgagcttggtgaggtgtgtttttaatagaccattagtctgtcactgaatactaagaacctgagaaaatgcttggctgatttgactaataaaggctggtctgttatcagactgtatagaggtgggaaggctaaactgaggaattatgtctgacagaagggaataaatgactgcggtggccttctcagaccgtgtaggaaaggcctctacctatctagtgaaagtgtctacctagactaagaggtattttagtttttgttactcagggcatgttgaataaagctaatttgccagtcctgggtgggggcaaatcctcgagcttgatgtgtagggaagggagggggcctgaataatccttgaggagtagtagaatagcagatagaacactgagaagttatttccttgaggatagatttccacaatggaaaggaaatgagaggttctaagaggtgggctagtggcttatactatagcatagcctgcctttgctggtgtgtggttattaggcctggtggaactgccattgataaatcaagtgtgatcagggtgaggaacaggaaagaaggaaatatggggaaatggggtgaatatcaggcggatcagagagatacagtcatgaaggtcaggtgtggtatctggaataatgtgggaggctggattgaagtccgggccaggaacaatggtaattgtgggacttaaggaagagtgagtacagctgaaggagccggggagcagaaaagtatatgcgtcaggtatgaggaagaaaatagattttggaagttatgaaaaatgtagagtgagttgaacatagtttgtgattttgagggcctctaaaagtattaaagcagtggcagccgctgcacgcagacatgagggctaggctaaaacagtaaggtcaagttgtttggacagaaaggctacagggtgcggtcctggctcttgtgtaagaattctgactgcactaaccatgcctaggaaggaaaggagttgttgttttgtaagggattgaggtttgggagattaatcggacaggatcagcagggcgagcatgtgtgtttttaagagaattatgccgagatatgtaacagatgagaatgaaatttgggcttgactgaagtaatggggtctgtctgtgaagccttgcggcagtacagcccaggtaatttgctgagcctgatgggtgtcagggtcagtccaagtgaaagcgaagagaggctgggattaagggtgcaaaggaatagtaaagaaagcacgtttgagctgcagaacagaataatggattgtggagggaggtattgaggataggagagtatatgggtttggcaccatggggtggataggcaaaacaatttggttgataaggcatagatcctgaactaacttgtatggcttgtctggttttaggacaggtaaaatgggggaattgtaaggagagtttataggctttaaaaggccatgctgtagcaggcgagtgataacaggctttaatcctttcaaagcatgctgtgggatgggatattggcattgagcggggtaagggtgattaggttttaatgagatggtaaggggtgcatgatcggtcgccaaggagggagtagagatatcttatacttatggattaaggtgggggaatacaagaggaggatgcaaaggaggctttggattgggaagaagggcagcaatgagatgcagctgtaatccaggaatagtcagggaagcagataatttagttaaagtatctcggcctaataagggaactgggcaggtggggataactaaaaaggagtgcttaaaagagtactgtctaagttggctccacagttggggagttttaagaggtttagaagcctggccgtcaatacccacaacagttatggaagcaagggaaacaggcccttgacaagaaggtaatgtggagtgggtagcctccatattgattaagaaggggaaggacttaccttccactgtgagagttacctgaagctcggcgtccgtgatggtctacggtgtttccgaggcaattaggcagcatcagtcttcagccgctaagccaagaagatctgggaaggagtcagagagccttgggccagagttccagaagctatgggagtggctgccaggtgagttgaacagtccgatttctagtggggtcccgcagagatgggacgtggcttaggagaaatcctgggctgcaggcattccttggcctggtggtcagatttctggcacttgtagcaagctcctgggggaggaggttctggaggaacgcctggccgctgcggttcaggcatttggaagttcttgtgtgctggagatgtggctggggtttgtctcacagtggaggcaaggaattgcaacttttttctgttattgtacaccttgaaggtgaggttaattaagtcctgttgtggggtttgagggccagattccaatttttggagttttatttaatgtcgggagcagattgggtaataaaatgtatattgagaataagacggccttttgaccttttagggtctagggctgtaaagcatctcagggttgctgccaaacgagtcatgaactgggctgggtttttatatttgatgaaaaagagcctaaacactatctgatttgggataaacaaaaaggagcattaaccttgactatgcctttggctccagccacctttttaagagtaaattgctgggcaggtgggggagggctagtcaccgaacgaaactgtaagccggaccaggtgtgaggaggggaggcaataaaaagattatagggtggaggagcagaggctgaggaagaattgggacctagcttggcctggcgaggaggggagaggtcagataggtctgtagaaaaggaagattagaaagactcagcaacgcttggggttgggactgaggcgacaggcgggagggaaagaaggaagatttgggacgagttgcactgggcacagagactaggaagggactgatgtgtaaaagaatgcctggacgtcaggcacctcagaccatttgctcattttacaacaagaaatatttagatcttgtaggatggaaaaattgaaagtgccgttttctggctatttggaactactgtctagtttgtattggggtcaagcagcattgcagaagaaaataaggcatttgggttttaggtcaggtgtgagttgaagaggttttaagttcttgagaacacaggctgagggagaaggaggaggaatggagggtggaaggttgcccatagtgaaggaggcaaacctagagaaaagagagcatagagacacggagggaaggggttcgggggttcttaccctccagaaaagcgggaaggggggtcggggcatggaaataagggattggggcacagagataagaggatggggtgcggaaataagggattggggcacagagataagaggtcggggtgtggaaataaaggattggggcacagagataagaggtaggggtgaggaaataagggattggggcacagagataagaggtcggggtgtggaaataaggaattgggggttcttgccccctagaaaagtgggacttgctgctaagggtgaaggagaaggggttgaggggtacttgctcctcccccagaaaagcagagaaggggtagagacaaggagagaaggggttggggtacttgccctttccccagaaaagcagagaaggggtagagacaaggagagaaggggttggggtacttgccctttccccagaaaagcagagaaggggtagagacaaggagagaaggggttggagtacttgccccttccccagaaaagcaggtcttgccgctaagggtgaaggaccaaggcaggcatccctgcgtggtctgacacccttgaaacatgggtgaataatcagagaggcttccctgcattgattaaacaccaagggaaggctgccttcccagtctgtgaccggcgccggagttttgggtccacggataaaacgtgtctcctttgtctctaccagaaaatgaaaggaattgaaattaagagaagggagagattgaagtgtggcgccaagattgaaaggagaaagaggttgagggatagtgagggaggttggagaagagtgtaaaaagaggccgcttaccagatttgaaattggtgagatatttcttgggctggtcggtctgaggacctgaggtcataggtggatctttctcacggagcaaagagcaggagaacaggggattgatctcccaagggaggtcccccgatccgagtcatggcaccaaatttcatgcgcgtccgtgtgaagagaccaccaaacaggctttgtgtaagcaacatggctgtttatttcacctgggtgcaggtgggctgagtcggaaaagagtcagcgaagggaggtaggggtggggccgttttataggatttaggaaggtaatggaaaattacagtcaaaaggggttctctggtgggcaggggcggggggtcacaaggtgctcagtgggggagcttctgagccagaagaaggaaattcacagggttaatcactcagttaaggtggggcaggaacaaatcacaatggtggaatgtcatcagttaaggcggggcagggccttttcacttcttttgtgattcttcagttacttcaggccatctgggcatatacgtgcaagtcacaggggatgcgatggcttggcttgggctcagaggcctgacagtcactgtcaatagaaacagttttggagttgactataggacagttggctccggactgccagaatcaaacaggcactgtcactgagaaatggtaggacaggtagtaaatatcttcctttgatcgacagtaagttttattctctctgatttgtgcctaacagaaggtatttccagatacttctgagctcataaattttcactgagacatgagttaatacctcatttccatcaatggcattagagtgttcaaaggtttatttagaatcacttaataaatgttaatttcaaaatatcttcatttttgaagcttagacttatcctctgcaaaagtagattttcataaagtgatatggtttatcaccttagtagtctttttttccttttcctttcttctcccccttttaacactcattttttgccataggttatgaaaaatttgtttagtatattattgcacagatttgcaagaccatgtttcttttccgtttcattaattctgctaatttatcatttaatttggctaatgacacttattccgtttttactactcttctgacaaaagttttctaatgaaagagatatattagctagctgttttgaaatgttctcaacaaggttaagatggtccctgtaatagatgttggaacaaaatcaaggggaccctagccacaaggtggaggcatgtgaaaaccactctgcttctgctagcctgcactgaattttcagaggcaaaggtagggagacaatagaaggtttaggtaggtaggacagctccttctccagcatgtaaagataattactcaatgggattaacctggacagaagccatgtgttcttgatgaggcctgctttctttcaagggtaaagcttcttagctgaataacaaaattgaaagttttattttaacctggaatgctaaatagctataacagagaaattagagtcctaaaaatgctttttgtgtggaagttcaagattagtacagggattctccttagaaatgtgtgtcttgggactgcaactaatcaaaaccaatcatgtttttaataataaagagtatgattgtgtgcacctcaataaaaggacgcataagtatgatacagggcaggaggggagagaacagaattcagcctggctacacagtttaacatagccagctagtacatcctttttctagaactcaaaggaagggtgtggagatgggcaatgagcttgcgaatgactatgataataaaactaataaatgatctataaattagtatcactcacaatctgaaaaagaatcattcatttaacaatcagatgttacaatccctactcagtccttcagtattttaatagatggctcttttggtccatggctcacacacatcttaaagaatttggtagcataggaaccagcctaggaagtgtgcaattggaaagagtggatctggtggcatccacaggcaggtttaggatctcctgagaattaacaataactggataaggaagtggggaacgagtttggtatgaaaataaaattaggtgaattaactacactgtctccccagggaaacttctcacaaatgcgttggctaccctacccaacaatactgttatctgccatgaatttgccctttttacattttgaatctcagtgttgcagacataatccctgaaaattctgtggctctgacaggagattgcaaaatattctcttaagtactaatgagttcaagcttttggaattccagtactcatttttttttttttagtagattcaggcagatggaaaaagacagaaatgtatctacaacaaataataagtaaggaaagcataagagaaatatgaggcagagagaaggatgcatacacaaactctgtgagaaacagtgagaagtgaagagagagagtaacagtgtggctacagagcacctactaaagaatcagataaaaagagatgataagaaaagccaaagaaaattctctaatagacattcagaattttttttttaagtaggagatttagaaaaaaagaataagaatgtttgtatttggccatgttaagtcattctctctctttatcccaagtcacaccctaccattcatcctctgtaaaacaacaaacttgaggggataggcaaatgatgttcggtagagaagtttagaaattttagaaatatgtttgccctatatatatatatatatatatttttttttttttttttttttttgagatggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcactgttttagccaggatggtctcgatctcctggccttgtgatccgcccgcctcggcctcccaaagtgctgggattacaggcgtgagccaccgcgcccggccctttgccctatattttatgatacttgttacacactgttgttgatactgtcattgctattgtttttattattactgatattattatatttactactcacaaaaacaaaatgacaaagaatggatatgagactgttttttctgaaaagagtggatcaataattgcaagctacaaagagcaatgaggagagtctcaggaatactcggaggattaaaacactgattgaagcatgatttactgaatttaacttctaaatgggagacatggaaatagaagactatgttgaaaatgttgaactttatttaagccctgtgcttccaggaaccaaggattgctaagaaatcccccacccttttgtgttccagaaaatggctaaccaaccaaaggaccccagcgtcctcacataacatgtctcaatccttcctcatcattcctatagactccaaagactccctatacctatagcaccccatgctcccttctttcctgaggtattcttcactaatgaatatccttattgcaagagcctgagtaagaacattttggtaactatctggtgccttcggtttttcacatcctgtatctcaaagctctctgtgctagcttaccctgtggaacaatgggctgggagcagtgtccagagcaatcctaggcagtacatgggttggaaggaagaagaaagaaagggaagtttttattcttatttgtgttgtataaggaacaaggtctgttcattacattatcccttatttcacaaaatgtatgcattccagaaatgctttttttttttcccctggggacttagggacagctattagaaaaccagagagccttgggtataataaaatcctgagatgtaataaaaccagacacttaagaaagcagtagtactactttttacactcacatatttaagagaaatactaacgttgcttttataaaacacagtagtattcttaacatttataatcttgtgatatccactaaataaatctcacaatgaaagcactgaaagtgaatcccttgggtagattgtagactctaataggtctgcctacactttggatcattcctccatgtaagtcataaagttaggaatttcacattccttatctatttagttcagctattatgtcagtgggatgcaaagtcccctacattttacaatgttttccatttattttatgccactgggttaacagttgagtatggcagctcttagaatctagaataatttgcaaatgtagatgcttttcaataggattttatgaagtggaattgttttgcatgttattcacctttttataattgtttgcaggttttgtaggtttttggaaacacttaaaatggaatttttagtctagctcaggttttatgaaattataaaatgaaaactaaatatggcttacatttggggaatttattttttcttgaaataagccaatacatttgcattactttcaatgcagaatgaagacagcaaagctgaaaggggctttaataataaagggtaaaggccagaatttgttgagcgtctattttgtgccagcacagctcaaatatatttacatgtgttgtcaggtttaattctcacaacagcctatgtaatgtaggtaccctaatgatccccatttttcagaaaagaaaagtgagtcaccggtcaattatttgctcaaggaattctagtcaataaatggtagcactgagaatggaatctagtctgtcctgaactgtttgctcttacatctgcatagggctataatcctggaacctctctttacctctgtcctgtgttcagtctcctttcttctcttgtccatttctttttctttttctgtttatttaattattttggtagaaaacatcctccagtgacttcttaagatttgtgagatagaaattattttatgaattttgtatctatcaattaaaagtgaaggcaaaaaacaaaaaacaaaacaaaaaaaactttgttgagtcgagaaccctaaattaaaaagcattttcctatagaattttgaagacattttcccattaacttctaaattccagtattgctattgagaagtccaaaatgatttctggtcctttgagtatgactttttttgttgttgttttttgtttctttttttcctacttggatttttcttggttcttctccttatcccattattctgaaattttatacttaaatgtccgtagggcggcttccacccctttcaatcctttcaacctggaaacttatattcagttcaggaaagttttattgaactattacattgttaatttcctctcattttttttttctttttttttcttctgtatttattattaattggatggtagacctcctggactggtcctataatatatttttttcttctattttcctttttttttttcttttggctccatttcgtgagacattttctcagcttttatatcattatgtctattgggttttttattactaccgtcatgtttgtaatttccagcatctctcatttcacgggtacaatatcttctcttgtctaagaatactaataatctttaaaaattttcttctgctcaaatccttctttttctgcaagttgtcattatcatttgtttatttggtttctttcatgttagaggcattccttaggtctctggaactcttcatatgcaattcatatttaaaatgagtaacaaaggctgggcacagtggctcacacctgtaatcccagcactttgggaggccgaggcaggcgggtcatgaggtcaggagattaagaccatcctggctaacacggtgaaaccccatctctactaaaaaaaaaaaaaaaaaaatacaaaatacaaaaaactagctgggcgtggtggtgcatgcctgtattcccagctactcaggaggctgaggcaggagaaacgcttgcacctgggaagtggaggttgcagtgagctgagatcgcgccactgcactccagtctggcaacagagcgagattccatctcaaataataatgataataataataataataataaaatgaggaataaaatgtaagtgggttcttggaagactctccaggagccacgtcaaaagtttgactacggtgaggccgctgtactacagaggccatgcataggttctctggccaacagtccagccttctaaccagccctatcaagcttccagacaagtgagtgaagcccacctggaccctccagaaccagcccaccatgggctgaacagcatggagcaacctcagtcaacaccacgtcaaataaaagaatcacctagttaagtcctgtccaaatttctgaatcttgagatataacaaaatggtggttgtcttaagccactaagatttgagtaattttttatgcagcaagggataatcaaaacattcgacttatatggactatcacagaaaagtgatatctaaaatactgatatggtaagataaaatgcaacttatataattatttttaaaatgatgattggaaactctgagtgtgtgggtgggactccttggctaaaggctccactgcagggtgacctggctatgctgtttattgcaggagcccctcatgtctgtcattccccccctattctttctttatatattatttttaaaataaactattttagaacagttttagatttactgaaaaactactagcagcacagggttccccataaaccccatgccaatttctccctattattagcatcttacattagtatggtacatttcccataactgataggctaatactgatacattcgtattaagtaacattcataccttatttacattttcataatattttacctaaggtccttttttcattccaggaccccatccagtgtgccacattagttattctgtctttttaggcttctcttggctgtgatagcttctcagtctttttatgtttttgataactttgatagttttgaggagatgtggtcaagtattttgtggcatgtctatttaatgatatttgtctaattttttttcatgattagactagggctatgtgtctttgggaggaaaccacagaggtaaagtgtcattttaattatttctattaagaagggtatatactctcaacataacttgtcactattgactctgacctggatgacctgcctgaggtagtgtttgtcagttttgtccactgtgaagttacgattggtatggactcaagaatatttatttcgtatatcttttttttttaagattgtttttcttttgagtcatttatatttctcaagaaagagtcttacaatactctgtagagagggaaaatgctggctgccaatactatggagtctcagtggaaaattaaggctgagattgggtgtgggtagggtcttagtatttaatatgcatatgtcacatatcatacctttaactatatctggggtcccccagtacagagaccttgttttccctctccagagaatgaacctaaattagggagagtcagccacaggcatgggaaggggacagtatctatggatttctctcactcttaaatgtcattcaaataatttctcttattttaattgctccccatcccaaccccaaccttccttccttccccctatttccagtagtatttggtgctgtcaattcctgaactgtctgtgggatgattgctttggttctcagcttttcccattactggcttacgcttcagcattttcacatctgctaagtcagttttactcatccatctgccctacagcttccaaaattgtttttgctgtgctcttctgtcttgttctcaccattcttgtatatttgtctttaggaaaaacaaatccctttacagcaaatttagtagagtttgcagggggtgggtgagagggagcaaaattggatgtgtgtttgatccatcgtctttccacagatttgctcaggattacagagttagctccgtgagaccagaggctctatctgctcatctttgtatacacaacacccacacacatgcctgataaagagtaggaggtaaatattaattgagtctggtataaatgaaaataggaagccaagtcaggactcaaatacaaatccaaatttaatttttattttttacattacactaaacttccacccctcatctattataaagtttgtatttttaacatttaaaatgaaatttatcatccatgtgatcatgcagatcagtgcttttcaaattttgtatgtgcatacaaatgccctggggatcgtttaaaatgcagattccaattcagtaagtctgggtgaggttgagactgctagtttgaggaccacaaatttgtatagcaaaatgtttagtaatagatttatagcactatatattctgacattataaaatgccatttcacattttatttctattacagaggtactatttgcataacaactttgtcagggcttggatagcaacacattgcctcattccagagaaagggagccagaaaaaggactcaggtcaacctaaaagttaattacagatgtagggagaaaagtgagagtaaaacatgctttttaaaaattgtatctttcttcttccagtggcaactagattctgttagatagccataagattgttatctgttacagaaatggttgggataggaaatattacatgactatatagatatatgtatatgtatgtttacatcataaattgtaccaaactaatttaagatgatttaactttgcatgcaaataatatttactaaaggaaacaaggacatcaaagcaaagagaaaattatcataagaaagataaaataaaacaaatactggggttagtacataaaatatataccatgaatactacagttaatagcagggatattataaatagagcactggacattcagcacaaaaatggatacataatcatttatataagttactaaggctaaagagataatttcttttttcttttctttttttttttttttgagaaggagtcttgctctgttacccaggctggagtacagtggtgcgatctcggctcactgcaacctttgccaccccgattcaagtgagattctcctgcctcagcctcccgagtagctgggattgtagatgtgtgccaccacacccagctaatttttgtatttttagtagagatggggtttcagcatcttggccaggctggtcttcaactctggacctcgtgatccatttgtcttggcctcccaaagtgctgggattacaggtgtgagccaccgtgcctggccaagaaaatttatttagtttacctttataaagaggaggccatgtcatgttccacataatattttcaaagacaatcttaggataaaattttataaggcagccagaaaatacacatttgttcaggcatgaatttagatgctgatgatggagagataaagacatataaactttttcaaggagctcacggtcatatggagggacatacatagccaagaaatttcaaataagatatattataatagaagtaaaaggtatcttgatggaccaaaggaggaagaaatcagctcagccagggaaatgatggtggtggtgggaggcgtgagctaatttacggcgtaagacataaaactgtggctgaacaaatattacatagtgccaaaatctgtaagaatacaatattttaatctaagtgggctctggattggggtcagtagaagaaaaggaatgaaagaaggagggagggaaggaggaaggaagaaagggcctgggaattttggcaacgaatgtgtggaacacagtttctctgggagactgaagttcatgggtgagggacagtactcacagataataaaagagcccagttattttttacttgcagtagaagtcagaggaacaagcttctagggtgtcaaggtgagggcagttcccagagcaaaaatcacataaggctagggctagtcccaggttctggagcagttaagcaggctggatgagtggtccataacctgctttgatttccaggtatctttgaaaacataaccaaggctatttaccttctacttagaaaaactccttataataaatacatgcaaagtttgtgtttggtttaagagttttaaggatatcacagacctttctaagctcttcataaaccctgagtaaaacaaacttgatggatgcatcaggctatcatcataactggaggctaggagccatttagatattcttgctaactccctttactttaattctatgctcatcaagtgaccttctgattatagaatgtcaacaatttcaggtggatgacaaactctgtgaaacccattacaggaactccaggttaagaacactcagactaggggcaatgtgatggcttagagttgagaaggtcccaacatcttcagttttttcatctcaatcacatttcatttgtgtgcacttttctcattacttgaactcactggcctttctgcagaactttctacctaataatagttatttactaaaagacctaaagctaaaactaaaatactgcattcttgcttagcattgaggactcagtgagcaggagataagcatgctatcaacatccaaatattaggcccagaaacaagtttgcaacatttctgaccttcccagaaaatacaaccatgaacttcacagggcctgaaaatgtgtttattcttgagtaagttcctagcggagtatagtgggatgttttttaatctacacaattttaactttatcgaaactttcttataaatctttaaaaataaatcataagcttcttctgtaattaagatactggcaatgttggtttgggaacatgtatttcattctcccccaagttctctagaacctgaaatttttagctcacatttatcaatatgctcagttggcagcagacattcctctttaggcaatacgagtactaactcggtgaagtttcctaccagcaattttatgagataggtactactattatgcccattttagagatgacaaaattggagcacagatagataaaggattcacctaaggtaacactgatagtaaatggtagagccaggtcaagactcaggtaaactggctctagagcaagcttgtccaacccgcaccctgtaggccacatgcagccccagatggctttgaatgtggcccaaaacaaattcataaactttcttaaaacattatgagatttttttgtgatttttttttttttttttttagctcatcagctatcagtagtgttagtgtattttatgtgcggcccaagacaattattcttccaatatgtcccagagaagccaaaagattggccacccctgttctagagtctgtgctgttcattatttcactatactctttttcttcagaggctatgactgcgcaaaaataaaaatcaaggcatcaaagcattggagataaggtaaatgtgagaacaataggggaaggctaacaaaataacattatttgcaataaatggaattctatgccatcattaatttagaaatatatttaataagctggtaaaatgttcacaatatattgctacatgaataaagcaaatacattctatagtaaaacccacttatgcatatatgcacatggaaacacacacacaaaggatatgttgatgatggtaattaccaagtgatgtttaaataggttgtatttatttattttctcaagaatgatctgatctttacacagctggttcccttttgctttctagagctcagtttaaatgtcaccttatcaaaaggtctttcctgaccccctgtctgaagaagagaccccatcactctatcttcctgtaaagtacttaccattcttcaatacttattatttgttagtactttttaatatgtttttcacattcagccatctcatctacaagtaatctctatgagtgtgaagattgtctgtctaactcacttttgcattaccattacttagaaagttgtgtgagtactctttaaatatttattaaataaatgagttaatgagtgttaaaaataaatatctctaagattcaacatacatttaacgtatattattttaccacagcaaatctcaacctcacaggaagccaaaagaagctcctcgattctctccctctgttccatcttcactttcactcacattatcacaggtaactggaaaccttgggtaaaacactgggtcaagagctatggtatccatgagagacatggaagtgatgctccctgcccttagaaggttatgtctaatggctttgaaagacttttaaataaatagctgtatagtgataaaagatacaaaagaggtactataaactgtaggcactgaggaaagactggctttttttgagttactttctgatcgagaaaagtcaaaaaaattattttgttttaaacaattgtcataaagatgacaaaaacaattttcatgaaaatatcaataataggaaaccagcagtaaattattagtgttggatcatgtctcctctacccacatgtaaacagatataaccaagggtggagtgagctgcctgctgccttctcatctgggtatgtgtgatctgtgtcttaaaagaagttttgggaaagtggccaaaggccaccagaggaggccatgacacctcctccagtcgtgggccacagccagaacattttttgtttagagatacagtttatcctctgcatatattctgaacttaacttgtgcttctcacaatgcatatgaaaaaaatggcaacaaaagtctaggtttttcaatttagatgagattccaacaataggcaacattatgccatatggaaaacatgatgatgtagaaggaagtttgggttgaaaaacaattacaaattgactatggaacttgaagagcaaaagccattctgctttaattgctacactctttcctttacatctttcattaaaaccattgtgaatcaaaaatgtttccttgggttatctttttattttaaatggataagggtatccatgatgctaggtttgatatcctaaatcttaaatttaagaagtcactatctgctttaagactttattaacacggtagatattaatcagacttatacaacccatctttggagtataggctaagtgccttgactttgatgctgtacgatgtcccataaatgttgagatgacttaattcattgggtgccagataataaggcatgatttggagaaaagactattcactaagaaactataagaatacaactctcaaataagagagtatatgccttccttaccatgaagatatgatgtggataaaaagactgttcactcaggaactataagagtataattttggggcaaaggcttccttaccatcttgtatggttgactctctaggcagagaagcaacaaatgcaacatgcttttcatatgtgttgggaaagacaatcctttcatctggaaagaacaatggaatcactctgcattttccacaaatgtgcaaatatgagaagtacctcagcaacttgtatagagttcctgaggtacttctcattttttgagttgtggatggcccacaaatgttgtaaaaattttttccattgaaatttgcctagtttgaatagaagacctaccattcatatatccttagggaaccaaatacatcactgcttctcattcatgaaaattgtctgtgggctgcctctgagttgctccagaatcataccacagtatcacattcttatctgacactgatccagtctttgaaaaattattcagtgtgtggtctttgtctcaaactttgaaaagttgatttgcattaagtcatttgggaaaaaccaaatctaaatatatatccttagcatttaagcattttaaattcattaaaatgtaaataactttgaaaacattttaaagactgattgtatcaccaaccatgtttttaaaagtaaattacagtttgggaaaacgtttctgggcaggagagatttgaaaacacaaaatgaaaatgcaaaaatatggagaagaataaatattctccattaaactttaaaactgcagaatatgtggaattaagatccagttaaagaaatgaagctgtttacagcaatcagattgctgtagacatggacatggtcatacacactcaaagagaaaacacaattgggctcataaatacatggaggttttataagaaatattcattttacacatgcaaagggtattgttttcatttgtaaacttcgactctgatctttgcatagtaaataactgactgatttttgctgattctgggtggataaatccgataacagtgtttggaagaatgtcgagatcttgggttttggaaggaaggagagtaagagaagaaattcgtctctgcagtacttggggttctttatttcccagggacctctagctttgcctgatgtgctcctattgcatgtggtgccctagccctgttgtctctctcctacttgaaagtagagaatggcttctcttatagggaacaagacagtgacaaattcattttcatatctaaagccagttctgaaatgtcaacatataatgaagttttaacaagaacaaaataagacttcatctgctttgtgcatattttttcccagacaaaatcaagagtctcctttgggatattttgttagcttcctctttctctacttctttcccttgcatagttattattattcatagcagttcccccacccccgccacgagtttccttcattgttttttttttcagtgtgtttctttatctttccttggttcatttcttgtgatccttctttcctagttgagagtttcatccagtgtcagtatccttcatttattctccttcactatcttaactgtcttttccccttttccaacactctctcaactcttttctttgacttccctcaacttgactgtcctgaactcaacaggaattggttttctgcagattgcttatttgcctccctatttcagttggataaacaatgatatggaagaacactttgtaaactggttcctagaaattttgttctgacctcaccttcaatccactactcataataggctttataaattagggcagttcaataaataaatagagaaaaagactcagcagagtgtacatgatggtatttttttctggcaacaatgaaaactgaaaaagatttataattagtaaccaaaagagaaaagacagtaagggttagattaagatttgtggttgtgcctgggctcattgctctttcatggtaaataagtttccttcacacgttaagagatatatcactgtggaaaaagaaataataaaatctggactcagtcttcatttctaagcttcagcattttatatccatttgcagactggattcttctgcagccctcaagaatgaagggaaaggtttttactttggaagatgggaataaacatagttttggactttaaatatgttgatccaaagcttctaaacttttgtctacatgaaaagaaaaatcatgaccaaacaggaaagctcaaacatggagctaaaacatctggacctcacactgaattttctgttggcaatgtgtaaactcaacctgaatctcggccacatcaatatgagacatgaccaccctaggtaccacagtgaagctgatgagcgttgagagtatatagaagcagataggccagaagacaagaccctctcaagggtgctataaatgggccatgcccaaagtatatcaattcccttgccaaatttctcttggaaataaggagtgttgattcgagacctaatgaatgatagaaaaatttaccatgaattatacccctcatttttgttttttgagcacctatgtccacagtcagagcactatgctgcctacttgcagataagaatagaattttgatttatcccttaagaggttaagaatccagctaggggccaggggcagtggctcatgcatgtaatcccagcactttgggaggccaaggcaggcagatcacttgaggccaggaggtcgagaccagtctggccaacatggcaaaaccctgtctctactaaaaatacaaaaattagctgggtgtggtggtgcatgcctgtaatcccagctactcagaggctgaggcaggagaatcactttaaccccaggagaccaaggttgcagtgagctgagatcatgccactgcactccagcctgggagacagggcaaaactccacctcaaaacaaaaacaaaaacaaaagaatccagctagggagatgaggaaattatgttaataaattctagtacttgcacatgctatttatctggttcctaactcttttttgctctgaaaatctttaaggcattttgtgaaatagaaatctaacgagaatgagaattactggtttagactttaattatttatgtctataaaattctcttatgcctggattgatctactgcggtttatttacagggaataaaccaagtgatagagtaggaatctctaggattttctaggaatttcctactaataaaatgccaaatgcatagggttttattatctaatttaccatatgaagttttaattaatttggatatcagaaaagtttggtttatattctccgttatgtagtgactgatctgattgttttaataattttatatgggtattgacaataacatccaagtgacacatacatgtcttggtcaaaatatatggatatactcttcccatctatacatcccatcttaatcaaagagtaggattcaaccaatgtcctttctttaatgcagtaaagacatttttagagaaatgcaagaatacccaacaggtgacagaaaggacagaaaaaagaagataaacacattttcaaaataatactatcaaagtacatttgcaagttttaaatcattttcagaagatgtgcaaattcacaagtacaaaaatactcacatttaaaaataaaagctgagaaagtaagttccttttaaatataccttctctcaaagtgaaaattagtatctttacaaagactgaaagctgagtcggcaagttttcagtgtttgttcattttttttttttttttttttttttttggtagacctgttggatcacgaggcaaatagtacaaaaaatgctttgactttcctttttttaataatgggaatattaaaaaagggacatttctatatttctgccttttattcattaggggagttaattttaagcaacatttaccctgaaaccactatttttaaagattaacttaatatatcacactgcttagcatttctagtagaagttttaaaatctttactatgaattgttcatcaggttcttcaagtcttagttttgccttcattatcacaactaggccaaattaggtgattgggacccttggagtatttttattggcttgttttaatttgaatgcctggttggatgtaattgtcaaattttaacatttgctcattaattcaattaacacttatggaatagtttccatgtcttaggaaatgtcctagggcctggaaatactggtggtaaaggtataattgttgccctagcaagagcattacatagttgaagaagaatcatattgattgaacaactatgatgctcaaacctttttacagaaatctcttcacttatctattccaagaaaacaaggaagatgatcagataatttagccaatttctcatagctggatagaagtagtaatggtatctgagcgtctgacttcagaagccatacttttccctgactaaatgatgttcttagaagttggtagaacaatttctcccttttatgcttagaaacacacacattcccatactatatccatgggtgagaagttagctgggtttgatcatgtcattcaccctcaaaacaaattgtcttggtaatggctcccataattgcattgtggtatgcatcacatgatagaatggacaaaatctagaaaatgtctgtgctgccactcacttgtattgcacattgggataccccttcagtattccaaagaatgaaatcatttaagtgaccattgtcactatacttgaaatctgtttcatcattacaattgcatgaatcattgttctcactatttgataagcaaacttaaagacccaatgtacttcttcagctacgattaagaagtagaataagaacacaatgcagaaaaagagggaaaaattaattctcactttcatgtgatctctgcaaagaaaaagaacattaaaacaatgtgtcactaatatttttgctcaatgccattcatatattacctgagttaagtaaaaacctttcagcgatgtgacaacatccctgaaaggttttattttcaaaaataaatgttcaggctattgaaaaatataaaatcacaaatagactggatttggtggattcatagatgtgcatggtatgacaagagtatgtagaactaactatatttacattaaatttatgataccccttgaaaaacataaaacgtgaattcataggatcttgatgtgaatcattcgcaatgaggagtgttaataaaaactttttatttggtaatatagaggagtgtcagataatagactaggtgcacaatgtaattagaaatactgaactttctattgcgtacacaacagcttgtggcaaagctctgagtaaatcataaacataagaatggcactgcattgcacttcatagaacatcctcgggccaaaaaagacaaataggagaggttctgattaaatatttgctctgaaaatacccactgataatatactgccaatttcctaccttgggtaaatagcatccccctctcccaaggtaagtaggtctctgcttatattagattttatttacaaaaaggaaatctggccacaaaacacaccacagttatgtgaagggtatggcccagcttgtctcaaaacattgtcagtgtgacctttggcaaggacccagtaaaaaagcactttctctaaaggaaatgaacaccttttcccctataatcctgctagcaagatgtggcattaatgaagcaatcccagcttccagtggtcatagcacaaatcagctcatttggcttggtcagtggaagaatgaatgccaggtggatatgtgcacataggagcatatgcaatgtttccatggaaatgctcctggttctgcccgaatggccttggggatgaatccagcccttcggggatgtaccgtctcttctggaggtcagcccagtggaaagtaaagccttaagagaggcactggacttcagattttatgtgttcatctggagggtgatttggagactggattatcaatctcacttttaatattcactgtattctggacaccaattccagaaacagcagcccaatattcttttattgcagaatccaaacataaagacgacaagcttttccaagcatatctaggaacactctcagtagtttcaaggacagtattttaaagagacaaatattctgggtaattgtgctgaaaaatatgctttctagctcatttcatggctgccctacctacctgactttctcttttcctttacttcatacatccgccactatcctctcctatcccctcattacctgtttcccttatttacaaaattgtctgtgtccctggagtccttcggaaggtcatttggctaattaaagagtccaacaagctgatgggtaatttagtatacaaagacaaagattataaacatacaaatagaaaacttgtgttgattatatctcaacggtataggtacaaaagtaggtagccaaagttcttacatgaggtggcttgtccttttgaacatagctcagacatctaatacctgattggaaaaatattaagcattcaataaacaacaacatggattacaaatgttgtcattttaaaggcttcagatctgcaatgagagatacttgtaattttttgtctacatcattaagtgtgttgaaaatataatttgaaaatgggcttctttttgatggtaataatgggaatccaaaataatctattcttattcttactttttaattctcactctccctatttttaagtattttgtaaatataattttaaaaataaagtatagaaagtacagtttttaatacagtgtatagctacaggtttttccacattgaaaaaattacctacccagaaatcctaaacatatatgtgggtagagatcatatctatatagatatttttcttcccccttttcctctcttttcctcctcctcccttttcgaattcttccacttctctcactgggccttgctctaatgagtgtatgttgttctttagtcattcaaaattcattcacttcacttccggtaacaactgtttaaggttccacactttttttttttttttttttttgagacggagtcttgatctgtcgcccaggctggagtgcagtggcacggtcttggctcactgcaagctccatctcccaggttcacgccattctcctgcctcagcctcccaagtaactgggactacaggcgccctccacctcgcctggctaatttttttgtatttttagtagagacagggtttcactgtattagccaggatggtctcgatctcctgacctcatgatccgcccaccttggcctccctaagagctgggattacagacgtgagccacctcgcccggcctaaggttccacacttttatcattttcagcgtttgtaggttggccgaaaacttgctgactgcagggatggtactcaggcctgagccaccaagcaatgaaactattatgagttgaggtacaggcatgtgacccaatcagggtcagtgaaataaaatgagatggtttgagacttttactgtcttctgggaaagagatacttgctcttcccccaagggacttaaagcccagaagatgcaaggcctggagcttctgcatggccatcttctgaccatgtatagagagtctaccagggaacaaatcaatagaaaagcaagtaaagcaaggcgtagaaaaagtggtcatcctacatttgcagatacccctccattttttcttttcacttacacaaaccaataatcttcctcgttgcttaggctctttaagtcaagttttctgtatcttgtagccaaaaaaagtacttaatgataaacccaacccacagtgtcaaacagagagagagactgagtcctataacagtagcctcctaaatttcttttctttttctttttttttttttgagatggagtcttgctctgtctcccaggctggagtgcagtggtgcgatgtcagcttactgcagcctccacctcctgggttcaagtgattctcgtgcctcagtctcccgagtagctggaattataggtgcacactaccacgcccagctaatttttgtatttttagtagagacggggttttgcaatgttgaccaggctggtctcgaactcctgaactcaagtgattcacctgcctcaacctcccaaagtgctgggattatgggcatgagccaccgtgcctggccttgctcccaaatttcaaagtccaagaactcctttgaacaattgctgctatacactgaaaactacttttctaatctgttgtagctcaataacatgttaactatagaactatcaaaaaaaaaaaaaaagtctaaatggctccaaattaacatccctggaggccttgaaagacaagcatctttaacctggtagcacataccattccccataggacactcagcagctgtgataagcctcagccagcaccccttagcaatgaggattgggataaagaaaatgcaaaaggtcaagtggccttcctcccactgctccacccctgagggattatttgtaataagccatgttgattcatctttcctttgtgaaacaggtactgtaaggacttgagcactaatgagaaatataatcttccaccacataacatgtttctcgtgaacttctcatgaatgaaaagtccacaaatttttaaggtggcgagtagtctcagccaatcttttctctcgtttttttcttaacaaatgtctcctttttcttattctctcctttttccctttagttctctctcttacatctcataataatttagcacttttatttctctgaaactagaataacttttaaatttttaaacaattagtaattatgtcttggcttgcttcagtgaatgagtttatagtttatgttggccctggaatacatatgtcccaaaatacatgtgcttgaattaccctgtgatgttcacgtgagagaacctctgtctccctatcaatctagtccctgttccttcacaccatctcctacacctcttccgtgttgttataaatgaggtatagggaagggtttgacaaaatagaatgagatcttggttataaatggtgcctcagatcactaaaccaaagttttgtgacacggccaagcctcttttctgtgtttgaaggaaacagacattttcataacaggaagctgcagaaaaaagatttgaaagattagcacttgccttcttgttcaatcagctataggcaggacaaaagataaattcaaattctacctcaggtgcacaacctaggaaactttgagcagttagcttaaacttggtgaatctctttccacatttacttttttttccttttttttttgttgttgttgttttgtttgttttgctttgtttttgttttttgttttggagataggatctcactctgtcacccaggctggagtgcagtggcgtgatcacagctcactgcagcctcaatctcctgggctccagtgatcctcccacctcagcctccaagtaactaggaccacaagtgtgtggcaccatgcctggctaatattaatttaatttaatatatatacatatattttttggtagaaatggagtctccctatgttgcctaggctggctttgaactcctgcatccaagtgatcctcctgccttggcatttcaaagttctgagattacaggcattagccacagacccagcctctttccatatttaaattgaggaaataatacctacgtaattatttcaacatctatttttgagccatagctaggcattattctagggttctacaatacactttgattaaaataatcaaaatccttttttcatgaagtttatatttcacttaatagcatttttgaatgaactaaatgatatcatttaaataaatccagagtatagtatataccacaagataaaattcaaaacatgatatccaaggtgagttctccttcccaattggtgtattcccaactttttttctgttatgaatttggatattgacttatgaggctacaaggtggcatgacccacattagtgacacagatggaacaaactatttttccagtctcttagaggtttttgaagaagctgggaaggaggaataagctttggactgaactagaatatgatctgaacaggccacagcattacctagaataaaagacggggtctcatttggattgatttagtccaagctgaaaatgacaggagttattattggtttaaaaaaaaatttctcaaataaactattttcaagccatacttgattcttctctttaaaaattctctttgtgaaattaatcagcatatccaacaaggaaaatacaccccatgcccatttacatttacctcccttcatctccactgataaagccctagtacacatgtctgtaactttattataaatcaccaccatcttttctcttcccagcagtcagaattaccttaaaaaaaaagaaagaaatcagactgtgtgatccctatcctcaccagctccaaaaatcttctagtggctatccagtgtgtttaaaataaaatccaaactgtcataattttcaatgtccttacatgaccttgcctttaagtcatattcggccaacccatccccttttcaccgtgcttaaggtatcctggacttcctcatcaggcttgttgccgtctcagagactttgctcttgcagttccctttgcttcatgtgttcgtccaccatcttcctcaatatttgcattgattattctttcttagttcaaatcagagaggcctgtgctgaccacatagcctctttccatcctccagtcactctctttcacattaccctgttttagttactttataacagtgcatatccttctttgagatcataagatccatgagcagagaacttaccatccttgttcttccctctatccccagtgtctccctctaggaggtactcaataaatactgctgtgtacatgaataagatctatgaaattagtacttctatgggaatccacattaatatatctttctgaaattttgctgggctctcaataatagtataaaaatgttattgatggactgtttatgatgtgtaaggcactacaggagtatagaaagcactcaacatacatcactaaaacgaattttccatctggttttcactactttgagggggtgcattattatgttcataaccatttatagcttagggaactaaaactcaggaaatgaatttattactcaagatctcacagctcataaatggcaacactaggattcaaatctaactctgacactaaagtcaatgctcttaatattacaaacatcaccatccatgtatcttttcatatcagtcctagataccaactagaagcaaatatctgtcaaaattaacaacgtttataaagggcattcactgagtgcttactatgtacaaggcattatctatgttaatttcacaactgtgctgtgatgtagataccttgttattcagatgagaaaatttcagctcaagtaggtcagatggaatttgaacccagttttgtctggctctggagactgaactgttaactactatgggatcgtattttcctgacccagtgaaagacagtattacttgccaagtcacagatgacagaaaccactagactaggcctctgctgctacaagctgggtgcagccctactgcctgaccagtacattcatcttggtcaaatgacagatgtattgtgtcactaaccatggaaaccagaaatcactgctggctgaccaccaactccctgtcaagtagaggaaaaacaaccagaagcctaaactttcatgattacattagtggtacctccttcatttattttaaaagcaataaactgtgcttgtccgttgtttcgattacgaagtttcaaatgagattgaagataatgcatcccataatttctcatccttccttgttccacaggctcaggcaggctgattccagggtgaaatctgcactttcctgattgatgaggctaataaagtgcctttattgtgatataaatagccttaaaaatgtcctagagagtcaatacccatgtttgatggcctcacacaagcaaggtccttgtcttaagtagcactaaagcttaatgagttatgtttttgaaaagtttgtcattgaatttggatattgatttgtgaggctacaaggtggcaagacccacattactcacacagatggaacaaactattttaaaaccacccatttctttcatatacctaatatatcaataattgtaatatctggctggatcatgtagcattggcaagggattggagcatgtttggaacaaattacaaaggtattcattcagtcagaccgatagctactttcttagccacattttggttgtaaaagagtgcagcagaggcttcctagaagataagagtgtgcttttaaacctcatctctcagtcacccaggtctatgcacatgcacccacacacatgtgcacagatgtcaacccaggcatcataaaagaacaaaatgctataactctaatgacttcaaagtccctgggttaatctgtgattgctgcattaaatttattaattcgcttgtgtattgggaatatcataagccacaggttttggcctttattaatatatctattccagatctttgattcttttaaacatctgccctcccagtttcaaaagttgctttaaaaatcctactttgcttttctcttttctgccattttttccattcctgatggtatcaccccttcttatccacttgttcacttattattttctcagtcttcattcatgtgtgcatgtgtcttgccttctgtgcctacgtatgtgtctctacacttgcagaaggaagatcagagtataatatatgaagtaatgtaagggtgctatggtaccaagtaagaatatcataatgtcaaagtcactcattcaatcaccacaccaccaaacaatgagtttatttagctcattacattagtttcctagggactgccataaaaaataccacaaacttggtggcttaaaacaagagaaatttgttttctcaaaaatatcaaggccagaaatccaaaaccaaggttttggcaaggttctaaaggttttagggaagaatccttctttgtcttttctggcttccgatagcagctggcgatccttggtgttcctggtgtacagacatagcattccaattgctgctggattcttcaggtggccttcttcccagtgtctctctgtcttcttctttttatttttttttctgtctcttatatagacacttgtcattgggtctggattaggcccaccctaatccaggatgatctcattttgagatgcctatcttaattacatcagccaaggcccttgtgccaaatttagttatattttgaggatccaggtggacatctttgcaaggggggagttagtaatcattcaactcactacacctatttccaaacttccaatgtaattaactaaactatactgagttttattttaacaagtaataaacatttcatttgtcaataatatggatgctaagactaaccaaaagtatcaattttggatcattacatggaaatattaagaaacttacactagttactttttcctttatccttccaatggatttacatataacatatacatcctttgagaaatagtgaaacataatctttaatgctgaaaaataatcacaaggcttaaactgatttgtttttatggctaccccagctaatcaatttattctgaaattattgattgatcttcattagagtttgaatcaagacagaaaaatcttgaatacttgtaaaatgaaatattttgtattctagagatgagaccattgtgctttgtgttagagaagatcaggctgatattaacctagataatgatggccttatcaaaggataatgaatacccacaaaaaggggagggtgtgtttttgtttttgcctattggcaatgaatataaacaggtcctctctgcccatttcacttaaggatgccataggaatcaacagaaaactaagaaatatgttcaaagggcaagagctaaggaaaacaaagcctgaccagcctaatacaagaataggacttatttagaagcagtgttgttcacatacagatcacctaggaatctagttacaaagcagattctagtatagtaggtcagtggtaggtcttgagattccatatttctcacaagttctcaactaatgaacaaggactgcactttgaacatcaaagttgtaaagaatcaaattattccaacagggcttgcaaattattattatgtcacacaagctaaaaattatgcggcttttagtcattcaacaaacattcattgagctcctattctacacaacttgtgttaaaattaaagacatatgaaacataattcataattcaatcctcaactgtttctctctcagtcaattgtggatattttctttcagttataaaatttggcatcaactttctattttaaatattagggaaatagtagaaatacaatttttataaataaataaaagttaatcaaccttaagcaattttctaaagattgacgcaattgatctctattctaaaagatacaacttttcagcaatgcggacagtgtctcttttagggactgttgtcagagatgccatggcaatacaacttttgcttggattctaggagcagcattcaggatggcgctgtgggttccagtctggaggtctcagtagatgcagcaatgagtagggatcagtcacaaagtgaagataaaacactttcagaagcatgtatttaatttatagaaaaatcaatatgttcttattttctgtttaatttaatttcatgcattgccaaagaaatgtgctacagagtaatggctctagttgctgaagtcttaccttacgtaaattgacttttttttttttccattttagcttggtttaatattattgaattcattggcaggtggcagccaaagcaatctatggttgttgttgagtcattttcagtaagaatccaccagagactatggtgatcataatagtgatccagaaatttgcactgtctactaaaattatacattgagcattatatacatatataatatataatgcatatgcacattacatatgtatataatgtgtataagtatatataatatacattatcaggagggtctttaaagggctgaaacttgccttattaggaatctgctcataattctgctgtgaaaggtaacagtacttttaaatttttaggcctgaagagtcaaagaaagttgtagtatcctgacttttaccaagtacattctcacaaaagagcaactattctgcaccatggaaagcatgggcccaattttgaaaggatgactctttgcctttaaacttattttgatcagaagcttttaagaccacaaaatattctgttctgacattaaacatgaatctccaccaattagaggaccaaggtttctgaggccaacctggagttcttcattatgacatcaatgaagttggcaaatgattgtttttactgccataaatgaatctcacagcagaaggtaaagactaaattctgtcttcaaaattttaaccgtatctcttcatccccacaacagatacagtggtctgaaatgtttggatttgctatcttcattggtcaaatgagctagttaattgccaagtagatgctgccagattcattgcaagttgtattgcctaagtctttcatcgtcaacctaggggcctttattttcctccttaaaggcatatccagatcaatatattatagcacacatgaggcttatttttagacctgtaatgcttctcgtgatgcctgctttgggggaatgggaaagatgcagctagagacaacaaactgctctctgttcttttgctagccaggcactctatgactcatttcagtatagagaggggagcattgtccctgtagacagagttttctatggggttacagtatcttgtctgtggttcttgtagaatttatggcctacttttcacaaactagcaaaggggcataataagcagagatggttttattagtccaaaatgttaccaagatcccttcaaatttctgcaagttacaaatgcatgtgataaaagacacaaaagggtagacacaaatggtccctgaacactaggttagacctctcaaaataagaaatggtcttaggtcctataatcttaaagtcttatggcatgacagaaagggtttatgtagttctgactctgaaatacacttagtaaattaagatgtggtgtataatttcttagatgtggatttattctctaaacatggacatcgaaaaacttgaagaaaagccaagtgcaataactctaacaaaccaccaggtgacagtgtttctaaaattaatcttcgattctagagacaccagacttgtttttttttatggggccatattttaacagacacatgaatggacaatcacatgattgctttttatacagaaagtcaaaccattaactgaatttattttcatgattacaattatttaaacgcgatgagatcccacacccaagtgacggtggtggaagattaatcttgttctgaattggccagaataactggatcatcttagaaaaataaagtgcttaagcagtttgaaaaactaacattcagtaatccctctgaagctctagatcaagtaaattgaattaaaaaggtgggaaatataattcatatttgttatatgatggcagcaaaatgcaacaacattgatattttaaggcaataggtagtaatcaattcacagcacactaacattcacgaagctttatccacaatatgtatctgctcaagggtgcatattaactgatacagataaaatgagtatctgagattcattttctgaaatggtcacaattttaagaaagtaaaattatagagggaaaaatgtttaaaccaacccaaaggaaattcaggtttctggaaaagaagaataggaagaaaagaagagggagaaggataaaagatcagtggttttctctgtaggctacggtttgactaaaagggacttataatggcctaaatggaagaattatgaaaataatacccaccagagctagcttaagcactaaggcatccttgtatctagaaagaaaatgccattgcccactgtgttagaattgatgacttaaggcctattccttccactaaaaatgtctcatctgcattgactgccaagggactaaattttatttataggttacttgaaactatatatattttatataaagatgtatttacggtaagtgacggagtgaagatacatatccagacctgctgattataaatagtgttctctgcattgcacctcatacatctgtgatctactgcctctatttttggacaattggaagagacatgcaaagaaggggatgcggagaagagtgagaagaaatggaggggggattgcttcagaaagatgtaccttagtagagaaaggtgaaaatgtaattatacctagaaaaaaaaagtagcacattctcagacttttgtttcacctttcttctccctctcctccatttccattatactctgcgattttcgtttctacctcctcccccaaatcccaagttaaattacagaatgtggcaggaaaggtcttaggtcctaggtctcaggtcctctttaacacttttgaatgactatagcaatggaatcatggcacctgggagtcatcatgtgattgtgtgggtcagcctagtgtacatgccacaaaaaggagccctgatgacataagaaatcacactatttttcaatctcagattccccaggaaacagcctcagagacaaagatttgcttgtgagagctccggagctaaaatggcctttcagaatcatacaacctttgggccagggagtttttaaatactttatcagactatcattggttgtggactatcctcaaggaaagaatatgacttaggcaagtgattgtcttttgttgaaagcaatgccaagcgaggaaattggtcaagggtaatgtatcaacattagcagcagctgatgagtcagttccctgacctgaaaaggggatctgggcagtgcactataacatccaaactacaatctggatttcctcagtgaggcaaatcatgctcacgagtatagtatagcggtaggtgaattggttatgactaaattaattcttcaggatttaaacacttatagcatggacactaatgactgaagtagtttatttttttggacaccccacacccgcctgctgtaggagttcagtgtattcattccagacattgaaaagttgttaattgcaaagggtggctagagatttattttgcatttgcctaggcaaatcataaatttacatgggatgactgacactgtttcccaggaatgacccacctaggcaaacccagaaagtatagtttttatgttcacaaaattaaactccaaaagacatcttgttccacctgtaatctgctgtttttgtcccctctgttactcctaactaagtgaccatccagcctgtgcaggtgcaattccggagttaagaaggttataatctccagccataagtcattccatgttgggacagatccaactgctagaatgttagctcaacataatgacagaccattcatttataattttcatacattgatcttagttttctttttagggaccatattatacatatttaattattctgcatgttatcccttcagatagttgaagacagctcatgacttaaaacatagtttaaaatcctctcatcattttagtcattctccttagaatatattccaatttgactatggcctgttacagagtgatattcacagtagaatagaaacatcaggtttcatctgaataacaacaaattcgggtgctacttttttattaaggcagattgaaggtgatatcagccctttaggctgctacattacgatggctgaaccacaacttttcacaaagtttgtgtcctcgttcatatcctgtgctgttatttcaggatagggttcacctgaggaactggtgttttaatttttttccaaagtttaacattatgtagttatatacaatataacttattatatataaaaatatattatctataatatataactacattatatctatataatgtatttattgtttgtccaacatgatataacatttaagcatggatattggatagcattcgtattccctccaagtgttcctttttgccttttcagtaagttagaaacgccttacaggcatagttcctattgaccactttctgaataacgtgattaaaaaatgattaaaaaaattttctcatttcatcatgtatcagttttgccatttttttctaaaaatatccattttatctgttttcaaatatgtttgcatagagttgtttatttgacactcttatgttttaaaatttctactaaatgggcacaaaaatagaaagaattaataagacctactacttaatagcacaacagggtgactatagtcaataataactaattgtacatcttaaaataacttagagtgtaattggattattggtaactcaaagggtagatgtttgaggggatgaatacgctgttctccataatgtgcttatttcacactgtatgcttgtattaaaatatctcattaccccataaatgtatacatctactatatattcacaaaattaaaagtctactgtattttaactatgacccctttcacctagcagtgattttcctgccttgtctttgttttacttgattattcattgtgtatgtttcctattttattagcttttcaaaaaagtagcttctgaatttgtttatcttctctattgttttcttattacttatttcataaatgtgttgccttgtcgtttatttccttccacttatttaggttagcttccctcctcctttgctactttctataactaaatactaggctgatcaattttcaatcttattttaaaaatatatttatttgtaatattgctagaatttccttctagactctctttagtgccatactaaaacatttggtataaagtgttttcatgaagtctaaatattccaagtttttgatgataaattttgctctgacgaattctatatttaaactgtgttttttagattccaggcagataaaatttggaagtggggaagtcattgcatttttatcagttacttttgagacattttatgtggtcattttttttaaatgaaccattccttcttgaaaagaatatatattttccaattgctttgtgcagggctttatatatgcttccacttaagctcattaactctgttgttcaaatactttatattaggctgggtgcaatggttcatgtctgggattctagaactttgggagaccaatgcgagaggattgcttgtgaccagcctgggtaatatagtgagaccttgtcactacaaaaaatttaaaaattagctgggcatggtggtgcatgccaaaggtcccagctacttggggagctgaggtgatatgatcatctgagtccaggaggatgaggcagcagtaagccatgaaggtgccactacattccagcctgggtgacagagtaagatcctgtctcaatacaaaacaaaataaaatactctatatcatcaccttacttttttttttttttgtattctgcatctacaagttttaagtgaaggtacattaaattttccactatgtttatatttgtcagtgtttttttattaacctggtcaaatgtatttggatataatttaaagttttcatttggctacatttcacttcagatttattatattctgttgatgaaagtctattttgttttttattacatcttacttttaattcaaatttcccgggtgcttttgtttgtttcaaactttctatgttctaggtatgactatagtttaaaattttttctatatctattcacatacaaacacataggctcagttgaactaattatgtaaaataatatagttggttatagaactgtagaaaatttgtttaatttcatcacattgaagataatcctccactgtcttctggtctatattgttgctgatgacacataaactgaattgatatttctttttaagtattctgtcttaattttgtttgattgattttaatattatcgctttttctttggtgatctttagtttatctacaaggtggctttgtggaaatttgcttttgtttatttcgcaaatagactttttctatttgaatcttaagaccttcttgttctttatcattttgaatattttttcttccccattttatctattttctttttttgaaaattctatcaggccatttttggaattcccattttgtattagtcacagttttccagagaaccagagaaccagaactaatagcttatatatttatatatggaaagagagagagagagagattgattttaaatattgacccacaccattgtgctgtctggcaagtctaaaatttgcagatgaggccaacagtctaaaaattccagcaggcattaatgctgtagttgtgagtccaaaggcagtctggaagcagaattccttctttggaggacctcagtcttttctgttaaggcctcaactgattgaatgaggtccaagggtgatctattttattcaaagtctactgatttaaatgttaatcagatcccccccaaaaaataccttcacagcaatatctggactggtgtttaaccaagcaactaaatactgtagcctagccaaatagacaccataaattaaccatcatacattgtatcttttatagaatatataaaaatatataggaatattactcattgaatatttaatatgcctttattttgatttgctacattttatatgactttcgcagatacaacttccagtttattaattttactttcagctgtgtctaatctgtagttgaatttttgcatagattttttaattgtattgactacagtttttatttcaagaaattttatttgttagttttaaaaataaacttcttttatattataatcacttagtatttataatctttattgctacattgtctccattttaaaattatgaattatttaagtcagtgcagtcttggtttcaatttcacacaagaattttttttcccactgaggcctggctaggtggcaaactttagtgttgacttttgctccaattagcaaaagtttcatggctcccttcttctagggagcaggctttttaaagttctagctttattcagtagtgactcttcctgctttctgatctgtattggcctataaagcctgactccacccaagtaccctataaaacatgtatctcctgtcagttatatcttgtcatgtatggcatcagctcatgttatccccaggctttgaatgtccttgtttctttcaaagatttctatttcgtacctttgattcagctctttgctacttttaaaattgggcttggaacagagctattagcatgactaaagtaggtgagacatggcttagcagctgctattacttaaaaagcaaaaggagccttagagattttagttgacaaaaagctcaatatgagtcaataatatttgttgacaccttttagaaaaagtgcctctttgagagcagagaaaaaaaatctacttttgctatcaccataccagcacaccaattagaaacagtaactttgtgttgcatgaataaacagtaatactaacaaaaaagaagatgttgagagaagatgttgacatgatagtgtatattttgcagggaaataccatctgattaggataatgaggtgattatcagataactaaaggattgtcaaatagaagatgggttaggactgttctgtgtggttcaaggaaacagaatcatatcaatttggtaaaagttgtaggcagatcaatttggacctaaaataagatatttttcacattttttaagaaataaaaatggaatgacctgtttttatgatattcaaggactcgaacactacttatcagaaatatagttggttatattaaccataaacaaaatgagcaagatgacatttaagtgtccttacaaactgggggtcccaggatttcatggttaagaagggtcaagttggatcatcatcttccttaattctactacaacttaaagttctctttattgttgacataactatgtcagactattgatttgagctgaaattgcagtcaactcaaaagccaatttttttacacatacctatgctaagcttgacatacgttctatttgtcattattctaaattcctgaaaacttaaaatttcaagtctcctattcagcatgtgatgtgcttatccacattcctgttacacacatcatctctgtgtttaatattcccatacaatccattgacagaaacattgatccttataacatgccttaagaaatttcctccaggtaaactcagctttattaacattctattcattgttctctgtctgtcatcaatggtatcatggcatatattctccaatattttgctactccattcttctaattaatagtcttttaaaatggtcaagaaagtataagtttaatttcacataacataatttttggtgactctatcctggttcatggtgatcaccactttcttttctcacaatcaagttagcaattttgtctataatatttttcaagaattgacaacaggccctacattttatggttagaacatccaactccttactctttttacaaaactagggctgaattttcccatatttagtcctcgggtccattatccttgatctttcaaaaaatcccaagtaagtgtcattgattttatcagcaggcagtggggcatatttcacctggccaacagcaattgacctcacttaagttagtcagatggtgtcatgatttctatgttttgagcttcatcttttgcaatcttgaaatctttctcctttacccagctgacaattgcaaaataggaaaaatgtgataccattcttttcgtctgggtctaactcttccttattctttcacttaatatgaataaaactaatatatacaatttttttgtccttagaaattattcccagagttgacctaattctatagcaagacttcaaaacactattgtggaggtttgtgctatgtttaaatatttttcctttatcatatctacttcttaatttgcttgttctacaaaaacatgtgctttttttttttttaattcatgaggaatgttatccaatttgcatttgttctctcagaggttagttaaaataacagcaacaacaacagaaggaagaaagaacagaggattttatttgattcattaattatttattcacacaaattaatcatttagtggatgtccttttaaaagaaataatcattttgcaaaccagtattaacacttatataatgtcacacaggtgactcctgctcacctcctctagattatgattactagcaaagagctcaaatcagcagagtgagaggcaatacaagaaatttgtctttgttttcctgtattttgaagcaaaaactcgacatgttgctacaacataaaggacattcctcatattacttttatagtcatatccaatagcaaataaaagttgtttgggggcacaaaccagtgatcaagaagtagagaagtagatattgaacccgtaataagttcaaggcagtttctagtcctgtgggaaattcatagatatataagttccagtgagttaatgacaccagaagctaatgataagccatccaacatctttgttccatgtaacctcagactaaatttagtcgctttttaaaatgcatctgtcagagtaatttaacatgtgattggtaaacagagaggggcctattgcagattcagaataaatcagtaacaatattggacaatagtccccactatgtttcaaaagaatgtcagtagtttgcatttaacaaactactgattttggacaacagcacctactctctgctatctgcaatcacagaagtcaatagagaaaatggcacaggctatgaaaagactagttataataggaggcccactgctatgctggggcacagccacagagcaactgattgcacaagatcatctattcagcctttaatgagctgttgttagcgcttcgttcaaccttccactagtcaccaattatgtttacagttagcggtttgagtacatatttacttctctagagagagggttcatgtgcagaatggtggtgaacagttcacagtatggccctcatgccctcaatgtgcagactccaggagaccctgcagtatagttagattttcactagaaaaaaagggaaagaaaaaaagaaggaaaaacaatatggggaagaaggctggaaagcagagcagagtaggagtggagggtgtgcactgcctttgctgtccctaacaggaaattacaaatccaaaaggcttgccctgtgactaaagaagcatttgttcctgaccattaaacctggcttgctcaccagaaggattttacagtccctttgaccatgttgaaaatttgaggatggagataatccctttcactcctgtttttgttagtttgcaaaaccgtttgagagattgaaccttgggcatttgtcagcgaggtctaatgcacattttgctctctttcaatgggtattcagcagatttcagatctataaaaattctacttagttgttgcctattttctgatcttttgggggctgggcagctcagcgttatctgagaggtgccagctgttgctattacagacagcattcaatggttcatttatctgaatatgtactgttactccgcaagatctcaaggaaggagactttgttgtaatggtgatgtacttcttttttgatggagctcttgaataaatatctttcataaaaggctctatgagtgactggaagcatttcttatacacatactgacttcagcagctgagagatatatgaacaccccttgtatatccttacccgtaccaaaaaatatatgttgttgaaatagcaaatatctttctaactgtagcattgaatattactcaggttatgtaagttaaaagcaataactacattcattaatctgactgcaaataacaagttcaattattagatgacttacagaatgtggaacagaatgtacaaagctgattcaaaagtatgtggacttcattaaagccatttagtgtgttttaattagtaaattacagtcttctgacctcatgaatgttagaatttaatacacttgcttttcacagcaggggcctgagtttaatcatcactttcatttaaactaacacaagaaatcaaggcctagggtttacttaagtcaccaaatatttttgctttaattcataaagtggaagttctttagtcatgcaaatagttctttattcataaaatagctattctcccctctcatggatcttagctattgtctaataattgtctctaacacctatgcctgtagatttaaacatccttagacacttggtttaaagaaactttcaaaagtttcagaatagggggttatgattgtggcatttttataataaatgtctgcttcaggtgaaatcattcaaatatcaactacacagcagcagaaagaaaagtgaaaatgatgtttctattatcaataataaaaggctggccagagaaaaagctagagtggggaaaaggagttgaagtctgaatggggctgagggccaaggaagagtttggtaagtgatgcgcagtgataggagtcagggttatcaagatgcagtgaaacaagaaatacagctacccacctgaagggctggaaaatgccctatgagaggacaagcagttttaacttgaccctgaaatgttagaagcaagttttaaaacagtaaatacaaaattatgaggatgtaatggcataataaaaactactaatttagaaagaagaaaaacctgctgaataggcaaaaatctaaattgctaaatatattatagaaatgtcatttcactcttagcatatgcaaagtaaactatctttggctaataatagtgttcccaggtggtgccttactggatccgttttaagaattggatgagacatttcacagaatctcagatgagggaggggacatagccactccctgttttccattctgaacttgtgcttatagaactgtttgccacagcccattttaaaccctattatttcaaaatcctttcttatattaagcaaagataaacccctaggatacacagcagaaattcagtcattggtatgaagaatcttactttaaatgaggaaaacagaaaagtgatagaatttatgaccatgagagaaatgatgcacagagtgccctgggttacagaaaagggacatttatgtatctcaatctgagcagtcatggaaaggacatagtaagaagaggttttctggggatgacaacatgtgagccgaacttttaagaatgtgtagaggttaacccagtacaagaagcaggaatgagtgtcccaacaaggaaaataatatattcagaggcctagagatcagagggagattgttgtggtgagtgaacatataatgtactactctaaacagggaggccagatacctttctgaaaatgcttctgctttttaaatacaaaaatatctattatggctcgtccatgcatgagctccttctcttccctcaagtcgctaagaattggaggtaggagcagggtggaggagagccagggaaatctgacattgctattgaaccttgagtgaacacgatacttggcatgtcgctggacttgtccgtaaagaccaaaacccaggaacttgaccaactttcctcaaaggagcaggtcctcaactctctgtcacttcttcattataatgcagtccatagaaccctgtgctcgccactccacaaactctggtagccacttgcttctcaatacacgaagagggttgactaggcacatgtttctttttaaatgagacacccaaaagtgacacaagactccagccacaatgagaccagcaattagttggagaacaaaataataagaatgtacttatatttgtctccagtgttttctttttaccttttaaatttatctgatctatctggtcttgacctcaggcctacctaacttattccttacctgcagtctaagcaaattcttctgtactaagatggttttgtttctgcttctgatcaggtctgacataaactcttgaggcatacattattattttagttttaggctttaaacgttgtaaatgccaagatattttggggctttttctcatccctagtcttgcaatacactctactattaatagacagaaaacacactgagggcatactatgtgccgggcacccttctaggtgctttccacgtacaaacgcattcatttctgataatcacctaaaatttatctgcaatcggtacccatgctttaatatctaaaaagtagtttaaaagctaaggaatgtgcagaaagtcacacagctagtcagtggtggagctggggtgcacatccaagcaatctggtttcactgcctgtactgttaatcatgacactgcactgcctcggccacttttcactgcacttaagtgtactaaattgagcttgtataatttagaaagactattcatttgttctctccacttaggacatttattgtaacaattaattgattaataaatatttaatgagcaacatctatgtgccaggctcatagatacatggggagagaaatcacatggttgatgtttttatgcagattaaattcttatggcagtaattgaaatgaaagaagatcatgtgagttgggatgtataagaaatccaaagctcatcagattcaatgtacacaaagcagaaaaataaggctcaaataaaatttgttagaaatatgtacacacacacaactgatctaaagttataaacagaccagtagaaaatgagaactaaaatcaggtctctatttcactaatcattacttacacactgtgaagagcataaacaatgtctttattaaagaagagcttctgtgtatggtctcagctatacaaatatataaaaaatactcaaaaggagattagaattgaggtgtcaaaatactctcaatgtttgctttctatatttaaataattttaaaagctatctcttatcctctcaaaaatatctatattaagaatatactagtagaatgaaagtataaactgaaaaaatttgcctcaaaaaagaaaaacaactgaatgcttagaaacactatgtgtgccattacaaaatttcttcgagtttgatttcatgctctactcaagttcctctaaagttggagcccccctattatcttttggctcactctagaacatctgagaaatgcaagggatttctcagactacacctacgtgacatccatgattcaagctgactgtaggaaaatgaaagtgattccatatttaggagctcagctttgcagggtttctcctgaataatggctttaaattatgccacatgctatggagagcttgctttttcttaagaaaagatgacttatcaaactgtgctatctctttagtaaactgactaggcaaaagaactcaacaaggataaaaatagtttcagggctggaaagaccacacatatctcacaaattcgtggaaaactatgtgtcctcatattatttaaagaagaattggcattagatcaattagatcgtctctcactttttctttagggttcagaaattgttctaggggcacgaaacactttacttagaaatcttttaattcaatcttgtaaaaaaaaattaaaacatagttttaactctttggctttcacttaagcttaaattacaatatctacagtacttagcaactactcatttattgccttagcaaatgagatgtaatagatttgctaggtaaataaaagaaagtagaaaaagataagttttataaagaaattattttatataaaattattgtaaaaaatattggttttagggcatcaaaaccaaccaagcaactctagctctagtgaactaagcattctaaatctgtgtttatttattcaaaaaaattgacaatctcccaaaatatttcatatagaataatttgtaacaatagtctatgacataagcaacatgagagttatcctgagcctatgtacctcatggagtggttgtgagaattaacggagttgttccaagtaaagtgctttcctgctgttttgttatatatttttagacaataaagcaatatgctaaaagaaacgtgattcagaatgatgatcatgggccttgtcaggataattattaatcacaaatatctattggcctgtcttgaggagctgcaagaccaaagatttaattatgctcattatgctacttggtacactatgtaccttgactaacttagaaaagcatttttaataacaaaagttggaacacaaataatattcccataaagtttaattcaccttaagcaaaatcagttgcccaagatttaacatgagctctgaaaatccattctccacaataagatacaataacgcttttaagactcaaatggaatcttctaacccactgattaaacatttcacagcttgccattcgttttaggttaatgctctaagactttactgggttctacaatgccctgcctggtctgtaacctaaattctttagcctcacctaaaggcatgccctccctcccatctgcattcagctccactgggctcttttcagcttttcaagcacaccttgctcccttcttctccaaggccttcacacatatccttcccccatccctactcattttgcttagtcattttattgataacctcaaagaggtctccaaagtaggatgtgagcattctttgaggaatatgagacaattcttttggggactggaaaaaaaccttagagcttttattctgcttacttttacctaaacttaaaagtaaattatgctttaaagatattgaaatagccatctaggtaggagtgtatacaatttatgcataaacatatacatatttggagtatattgtataaaaaagtttgtaatccactgcttcagatctcagctccactgtcatttcttcatgaatgttttggttttttttgttttttgttttttgtcttttattttttttatgtcagaccaagagaaaatctcaccttgtagacccacataacaccagacacttctgggaagcattatgctagttataatcatttatttctgagactatttgattaatgtctgttctcattcactggactctctcatgagggcaggtattgaggtctgttttttttgttttgttttgttttttttgagacagagttttgctcttgttgcccaggctggagtgcaatggcatgatctcggctcactgcaacctccacctcctgggttcaagtaattcttctgcctcagtctcccaagaagttggggttacaggcgcccaccaccatgcctggctaattttttttgtatttttagtagagatggggtttcaccatgttggccaggctggtttcgaactcctgacttcaggtgatccacccacctctgcctcccaaagtgctgttattacaagtgtgagccactgcactcggccctatttttgatcatgttttaccttcataatacctagcatgttgcctggcttatcacaagtacttgataagtatttaatgtgatgtatacaagagggtgtgtgtgtgtgtatatgtgtgtgtgtgtgtgtctgtgtctgtaaaacatacatacatatatatacatacatatgcatataaaaattagccaagatgaaagctctgtaagtagagatttgcatttttttacctctatatttctaaccaaagtactttctccacttctctagttccttttccattgatttcagttgactatctttgtgtcatatgtttatctgccacagatttgttaggacaaagctcaaatatcagctgggtccatgatgcccacagtaattgcaaaactgtttgctgtaaaacagattaagaggtcctactcagcaagcagtgagccaagttcttccctggttgcttcaggaacatgtggcagggctctgtaatgtgatggataacatatgaagtgcaaggggccgcccatatgctgctgcaattttcctgtacaggatgtgctctttggacttaataatggtgatttaggacactggtgaaaattccagctctctttagatctcattcagagtccccaggcagggggtggcaaatgtataatcccacactgcaggaaaggaaatgaaagaaggggaaaaagacctccaggactgacttatattagaattgatcagatcagcttgtactacctgttacagaaaggaacagatatcactgctgaaatcctaacgttgagtaaaatgcagaaagtcacataaaatccttctaatttggggtggggtcagaggaaggaatgctatttatttccatctgaacacttattgatacatataaccaacaattaaattaacaaaacacatatttgggattaggtgaacagcatgacatggtgaacagcagtgtacataggaggatgcctggatgtcggtggacagaaagtgtgatgtgatggtgatattgctactaaatggtatgaattaagtcaggctttattgataggaaaaatggttcaaagtgctacattttttctgtgtctcaatactacattcaacagtattaatcttctacacagtgaccaacacagaatgctacattttaaaaagatgcaagccaaccaaaaacttgacagaagagaggaccagtatgatgagatgacacaataccatacctgaaatgaaatggtttacaaaaaagcaaatcataatcaggacataatcacaggaaaagaaggctctggaaaaatgtggttggttgtcttaagtagaaaaatgtgtcgtgtgaaaggagcatcatcaggtagagaatgaggcatattctttagatgcttaatgagcagcactgggacctgtggatagatgcttccaagatgagtttaacttcatataaggaaggatattctaaggactctaatgattgagtaggcagtctcaggaaggaggttatatgcggagcactggaggtgatcaatcttagcccagattagtggttttcaaatactttggattattagaatcacctgggggaacttcctaaccaggcccagacccaagtaccagggtggttctaacgactaggcaagttgtggggacccagtgctagatgatcattctgtgattgtacagacataattcaagcagggaggggaagctgatttctaagagtccctttatcactgagactgtgattctgtctttctccataacttatagggatagtaatactaaaggaactgaaaaaaaggaaaaggggcatttctgaagttgaagaagatttcagtggaaatgttagtttcctcaggcgctcctatgttcattactttcttctctggttatgttccctaatgctgcaatcattggtaacaaggaggaataaagatccttgctaatcagttcatccaaatcatgtggtaattactctccttatgagaattacattatgactccaaaatacatggcaaaaatatatttcaaaaaaaatagagaagaaaacgtaaaacagaaataagtaaggaaagaactactttaaataagatatacttaggatatcctggaaacatacacctctccaagatgaacccagaaaaaattaaatccctaaacttatcaataatgattttgaaactggatcagtaataaaaagcctaccaaccagaaaaagcctatggatccgatggattcacagccaaattctactagatatataaagaagagctggcaccattcctactgaaactattccaaaaaattgaagaggaaggactcctccctaactcatagaatgagaccagaattatcctgataccaaaacctggcagagacacaataaaaaaagaaaacttcaggtcaatattcttaatgaacatagatgcaaaaatcctcaacaaaatactagcaaaccaaatctagcagcacatcaaaagattaatccaccgtgatcaagtaggctttattcctgggaggcaaagttggttcaacatacacaaatcaataaatgttattcgtcataaaaacagaacgaaaacaacaaaaaagagatcatcttaatagatacagaaaaggcttttgttaaaagtcaacatccctttgtgttaaaaaccttcaacaaactaggcattgaaggaacatacttcataataataagagccatctatgacaaacccacagccaacattacactgaatgggcaaaagctggaagcaacacctttgaaaaccaaaacaagagaaggatgccctctctcatcactcctactcaacctagtactataagtcctctcagagccatcaggcaagaggaagaagtaaaaggtatccaaataggaagtcaaagtatctctgtttgcaggtgatatgattctatatccagataacaccatagtatctgcccaaagtttactttatctgataaataatttcagctaagtttcaggatacaaaattaatgtatacaaatcatcagtagcatttatatacaccaacaacatccaagctgacaggcaaatcaagaacacaatcccatttgcaatagctacaaaaagaataaaatatctagaaatatagctaaccagggaggtgaaagacctctacaacaacaattacaaagcacaactcagagaaatcagagatgacacaaacatatggaaaaacatttcatgcttatcaagaggaagaatcaatatagttaaaatggtcatactgcccgaagcaatttacagattcagagatattcctatcaaactaccaatgacactcttcacaggattagaaaaaactattttaaaattcacgagaaccaaaaaggagcccaaacagccaaggcaatcataagcaaaaacgaaacaaaacaaaacagaaaacaaaacaaaacaaaacaaaaaacaaagctggaggcatcatgtgatcttcgacaaagtcaacaaaaacaagcaatgggtaaaggaatccctatccaacaaatggggctggtatgcaataaatggggcagaagattgaaactggaccccttctttacaccatatacaaaaatcaactaaagacagattgaagacttaaatataaaacctaaagctataaaaatccttgaagacaacctaggaaataccattctggacataggacgttgcaaagatttcatgacgaagacaccaaaagcaaattgcaacaaaacaaaaattgacaaatgggacctaattaaactaaaaagttctgtgaaacgtaagaaactatcaacagagtaaacagacaacctatagaatgggagtaaatatttgcaaagtatgcatctgacaaacatttgatatccagaatctataagaaacttagacaaattgaaaagcaaaaaccaaccccattaaaaagtgggcaaagggcatgaacagatacttttcaaaataagacatatatgtggccaataggcatattaaaaaaagctcaatgtcactgatcattagagaaatgtaaataaaaaccacgagataatatctcacaccagtcagaatggctattattaaaaagtcaagaaataataaatgctggggaggttgcaaagaaaagggaacaattatatactgctggtgggagtataaattaattcagtcattgtggaaagcagtttggtgatttttcaaataacttagatctaccattattggatatacacataaaggaatgtaaatcattctactgtaaagacacatgcatgcttatgttcactgcagcactgttcacaatagcaaagatgtgaaacaacctaaatgcccaataatggtagagtggatgaagaaaatgtggtatgtatacatcgtggaatactacaaagccataaaaaaagaatgagatcatgtttttttgcagcaacactgatagagcttcaggccattaacctaagctaactcacacaggacagaaaacaaaatactgcatgttctcacttacaagtgggagctaaacaatgagtacacatggacacaaagaagggaacaacagacactggggcctactcaggggtagagggtgggagaaatgtgataattgaaaaactaccggctgggcacggtggctcacacctgtaatcccagaattttgggaggccaaggcaggtggatcacttgaggtcaggagtttgagaccagtctgaccaacatggtgaaaccctgtctctaccaaaaatacaaaagtagccaggtgtgatggtgcacacttgtaatcccagctacttgggaggctgaggtaggagaattgcttgaacccgggaggcggaggatgcagtgagccgagatcgtgccattgcacttcagcctgggcagtaagagcaaaactctgttgaaagaaagaaagagagagagggagggagggagggagaaaggaaggaaggaaggagagagagaaaagaagagaaaagaggagaggagaggaaaagagaagagaaaaggagaggaaaagagaagaggaaaggaaaagaaaagaaaagaaaagactgcctattggatactatgcttattacctgggtgatgaaataatcagtacaaccaaacacctgtgacatgcaatttactcgtattacaaacctgcacatatacccctgaacctaaaattgaaaataaaataaaataaatttggaatatatttggcaacacttgatgactggtatgtgaatatgtaatggatgtgaggacatactctatgaagcagtctgaaacttcattgcacataaagaacatttaagaagtttgtttacatgcatattttaaggctacaccttagagattctgatttagtaggtcttgaatgaggccagaaatctgcattttgaataagcagaaggagcaattctacacactgcatttagaaaaaataatactttacattgttttccaataaaaatttttgcaatgatggaaatgttctacatatgtgctattcaatgagatagtctccagccacgtggggctatgcaatacttaaaaagtagctagtgcaagtgaagaactgagttttcaattttattaattttaattattttaagtgtgaatggtcacatgtggctagtggctgccacattatagagtttagcttcagaatatactgtatttttttagggacaagaagcatgcaaaggtttttgcattgtacccaccacagtgaggaagcaagagaagctatacatatctccaaaatagcatgaaataacactttctgcagagtgtttccatccaatccatgagtgaatatagcaagatgattttacattagtattcagaattatcagagtaaacatgtttattcctatactagtctgtaaatagcgagtaatattatagtcatagtgtgaactaaatgtgccatctgtggttaactccatttatttgtacttgaaatgactgaatactgagcagtgggtatgccattagatgatgtggcagcctcacctgttagctctatgactgttctgcctgtggctgatcagatcaggtacataagcctggactaagtgttagaaatggctatgttgtaggcttcaagagctccccagatccactgacctccctgttctaagcaaacaggaggaatgctgactgccaagaaagtcacaaaagaaactgaggttccaaactgtctacagatgggcttagtgccaataaatattctaaatcaaagcatcaatatgtagtatccatgcaccaaaaaagatgacacagcagttcttcttccaaaaaaaagttggattcctatgtcaggcttagtgggaataagaagcctcatattcattggatctgtgctgggaagcatttagataaatgctagaaaacgcagagacaaaaacacacacatatacacgtagattcaatagatggaggttggcaggcaagggtggggaatagcggatttgaatgcagaaatgagagtacataatcatgtcaaaataactcacccccaagcagaaaagaaaatgaaagggaagtagggcaggaaagaaagaacattaatggatccaccgcctcctttacccctagagacaaaggttctttctgcacattcacattagcattttggcatatgaaaatgaattctagtgctagtctataataaattactgctctccaaactaaaatcttaggcaagcttatgtggctggtaataagtggtcttagagaattgtttttagaaattctatgtttggcagtacacatgccttgtgcatggtttggtgttggtgaaatttcatatcctgcacagcttggtgaagtcaccttgttcctgggagaaactcccctagaaaaccagttctggccagaaaacaggaagagggagggattctggaaccaacacctctaaatctttttctgatgatgttaggatatagtgaggactcagcacatacatttgtttcttaagactcactttgttatcagagttgggaaactattccctattaaaatgtttcattaagcgatcctccacatattatttttataaacacaactttgtttttctgtctatacaggtgtgtgtgtgtgaatatgtgtatgaatgtgtatgttttatatgtgcgtgtgagtgtgtgtgtacattatatatatatatatagtggctcttcactggttctctctctctctctctctatatatatataaagtgaaagcaaagtgtgtgagagtgtgtgtgtatatatacatatcgtatacacacacttatacacacacacacacacacacacacacacactttgctttccaaggcagtaatgttcctggatgtcccagccttgataaatatctgtgacctacagttctggaagaaattgtaggctttgttctccctctcaaggtgctccttgacaggatcaattttggttgccatggcttgacctccagcctacatgttcccccatccctggacctgttgcttactgtcctcactaggaacactagaaagagcttgggaaagaggggcaacagcaaaatgaaaataattttaaaaatgaagaagatctttttttttaaattttattattattatactttaagttttagggtacatgtgcacaacgtgcaggtttgttacatatgtatacatgtgccatgttggtgtgctgcacccattaactcgtcatttagcattaggtatatctcctaatgctatccctcccccctccccccaccccacaacagtccccagtgtgtgatgttccccttcctgtgtctatgtgttctcattgttcaattcccacctatgagtgagaacatgtggtgtttggttttttgttcttgtgatagtttgctgagaatgatggtttccagcttcatccaagtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttataatcctttggggtatatacccagtaatgggatggctgggtcaaatggtatttctagttctagatccctgaggaatcgccacactgaattccacgatggttgaactagtttatagtcccaccaacagtgtaaaagtgttcctatttctccacatcctctccaaaaaaaagattaaaaaaaatattgatacaagttcttagactcttctaattttaaaatttcatgccacatttttcatattcattctcatgttttcttaatatctggatttccttcattttttaaagatttttccttaaaaaaacacaaaaaaaacgaataagatcacacatatataatctggagttttcaaaatgcttttgcatttggaaataaggatcatacatacatgttgaggagtctctgagttatccagacagattcatagctgaggttaaagtttgctagaaaaatgtatgtattactgactttcgttttgtattttaacattatacctactaaattatcagcttgagctgggtcctttgaatcatgaatatgacaaatatttgtacaaatattgggtaatagtgctttttaatccaaacatacaccatgcttcttaaattcctgtcctatttattgattcaaaatgcagttagaaagaagtgtctggtttccacagttagattatttaacactcaccaacatactattaggatggatagagcaacagaatctgcttaaaactttttgaaattgtgcaacagaggcaatcattcttccttttcattcctgactccatcatgtaagagttgtgccaaatactaaataaaatgaggaaaagcagaggtttctattaggttggtgcaaacataattgcggtttttgccattaaaagcaatggcaaaaaccacaagtacgtttgcaccaacctaaacagacgaagataagagtgtggagaataaactgtttagtaagtaatcttgtttcatttgaaatcaacatggggtcactaatccaaatatatatatatatatatatataatccaaatatatatatatatatatataatccaaatatatatatatatataatccaaatatatatatataatccaaatatatatatataatccaaatatatatatatataatccaaatatatatatataatccaaatatatatatatccatatatatatatatatattttttttttttttcaagtagcatctagcttagtaaggctgatgaccaggaaacaatgtcagtgccaagtacatggtgttgggggagtatgaaggagtcattcctaactagtactgaggtatcagcaagaggcttcctataggaagagaactaaacttgtctattatttatgagatagagtcttcatcaggttatctgcctctctgagcctgactcctcacttgttacttttttaaagcccctcacaggtcaaagactccaagatacttgatgtaaacattcactaaatctgttctctccatattaatcatgcaatgcttcatccaggtgtacagatagtatgtctgagcagaccgtgcttctaggttgaaattttgctcttatagcaagcataccaagtctagcttccttcaccctttgcctgtgggcaggagttgatctcagatgtctggacttggctgttggcagtcattgctgacctctccccagacacagtccagctatacgctgcagttgtgcccccatcattgcagctttctcctcttgtgttaaatcaatagtttatgacatctacaagggaaagctgtaaatttaattttgtcccctgcagtgcaattcctatcttgtttgctggcaacataatgaatgtgtttgccctccagaccccccacctagtggagcaattggaggataaagaaagagaaaatagcaaagcgcaatgaggtagatagattaaaacttggttaatcagaagcttagctatagataggcagatgtctgaacacaaacacacatacacacacacacacacttcttttcagaaatccaccaaagaggaaataataattaaggaaaatttagatctatctgtgctttgcaaattaaggatggtccagatagattgtgtttaattatgagagaaatgtgagcagggcaggctagtcttaatgggttagtttttctctaccccacaggcctcatctgctgtcactcccctcttgttcttaatgctacaaatatgccaaacttcttatcaccaggggcctgcatggctgagccctggaatatctctccctggttccctgcataattggcttcttctcatcttagagttctcagttcccttcccaccccatccagggtatcctgatccctttagctctgttgcataatctctaaagcccttattaccatctaaaaacatcatatgtgtgtgtatgtgtgtatttccttgttctttatatgttcatatgtttgttgcaatagagaatgctaattgtggtgggccagggaacttgtctattttatcccctattcagccccagtgattaccataatacctgtcatgtcattgctcaattacatgctgaatcaatgaatgaatgattgatgtagtagtaaatactcagaaagaaaaactttcagcagccttctgccattggaacaataccccaatttatctcctcacaactgctctctctctagcacttgccatgtgccaggcacagttctaagtgctttgcatactaagatatttagtccttacacaaaattaaggagccaggtactattatgattcctattttttagatgaggaaactgaggcacagagatcttcagtgacttgtctgtatccacaaaattacaagtggcagaactaacaagtggacccaggcagtctggctccacagtctatgctcctaggaactatgctatactggctttcaatttgcagcattgttataagcaactgcaggcattcagcactgaaacaacgataacaccattttgttatgcctgtgagtgtgtgtctgtgtatatatgcatgtatatatgtacatatatatgtatgcattttttataattgcattggaccataggcttcaaaaatatatagtcattgtatccagaaaaaaatctagtatatacatttagaatccatttgcagaattttatgacctgatgtcacatcatcaaacctatccagctcacaacttttaaatctaaaatttttagttttttttttgtttttttttttttttttgagacggagtctcactctgtctgtcacccaggctggagtgcagtggcgcgatctcagctcactgcaagctgcacctcctgggttcacgccattctcctgcctcagcctcccaagtagctaggactacaggcgcccgccaccaggcccggctaatttttttgtatttttagtagagacggggtttcaccgtgttagccaggatggtcttgatctcctgacctcgtgatccgcccgccttggcctcccaaagtgctgggattacaggcgtgagccgctgcgcctggccctaaaatttttaatttttttaaattttaatagttttttgggtacaggaggtttttggctacatggataagctctttagtggtgagatgtcagtgcacctgtcacccaagcagtgtacactgtacccaatatgtagtctttttgcccttatcccccctccaaccttcccagctagagtccccaaagtccattatatcattcttatgcttttgcatcttcatatccagctcacaatttatgtagttgtactgcacatgagtgaagacatatttcttcatagtattatttggactgagaggttattacacaaatccactcatccaaaaggatagaggaaaagatgtgactatgtaaacacaatgaagttgaattgaaatgagaaaggatacaggatctcataaagagtgtagctggcctttctatctgatctatatacatctctctgattgtctatctatccatccatttatccatccatctgttcattcttccacgcttctatccatttatctgtccttccatccatctattgaattcttgtcatggaccaattactatataagtgatgtaagtagagaatataagcagtaatcaaggcagatactgcctctgccctcatggagaaacattttggcatatgctattctcaacacctctcagcccacaccccttatatacaacatactatgtataataatgtagggttattatgtactgccaattcaaaaacagggcagagataaatctgtgtgtgaatatgaagactgaaagctgagcaggaacagaggcacagccatcaaaaggagaagcactgggcaaggggtaaaagagcagtgagagtaaagtagcaagtactgagccaggggatgaaagaaaaggaaggggcccatggaagagtagaattgaagaaggaaaaccaactctgtcccaacagactcagcaggttgagcccatattcctaggataagcagaactatccatcttaaagtattttttaaaaaatatttcaagatatattggtggaaataaacaagttattcaaattgttcctttttctaaataatacaaagaactccaccagcccatcaccactgtgtttgatttgggaaagatatcttgaaagcttttattattattattttttttttactgaccaatggatctgtcaggtataagagatgatatccctggaggggagctctctctgtgccatggtgggaggcagaactatagctgcatttcctgagaatcaaagaacattcatttacatttgaaacaagagagaaaaaaaaacccatcattttattgtcagttttgttccaatcaatccaccccttgtcatgattgccaagttgtcctttgatagaaattcatcccagagataagacataaaattttaatgagattattttgatgtttacaacctctaagaatgtcccccaaaagtcctgtggagaaaggcatttccttctgctttttctcagcatatatctgcttcctaacttatggagttctgacacaaattgattggaatacccctggctatgcaataggtgtttgctcccatggtgtgaggtgacagggtgcagggcagcctcaatgacccgaacatcttccccactgatgccaacaattccaccattagtgattaatgcttaggataaatcaaggagctattatggattagatattggtaggtaccagtttttaatttaattcccccaaagcacagtacagttcattatatatttctaaacactaaatctaactctgctatcttaccattgtccttttttaaaatgaatactattttgagagagatagagatataaaccagggctaggcacatgcctgtaataccagtaccctgggaggctgaggcaggaggatcatttgaggccagaattttcagatcaccctgggcaacacagcaagacacggttttcacaaaaaatttaaaaaacaattaactgcatgtgatggcacatggctgtagtcctagctacttgggaagctgaggtgggaggatcccttgagcccaggagttccatttacagggagctatgatcacgccactccattccagcctgagtgacagattgagaccctgtctctcacgataatagataaataaatagctctgctctctactgttgggagtcaggataaggcatatggggggaaaaaaagcaaggaacaccaaaacttaaattgcttttctcccaaaatggctgtagtgaatctagaagtggaacagttgtgcttgaggacctgtttctgttttctagttcacatcctgaccagagaaaaaagtgggaagataggcttaggaaagggatgagcacatgtgctaaggtatccatcataggttaagcttccagagcctgcttccctcccattcacattcttcttcctttcttcttcacattatgaaggatgtagcagtgaacaatacacagccctacgactgtgttcagaaggtccaaagcccagcaatgccaacagaacaatccccattcctcacagagaaagccatcactgtttgtaaggcaggccttctaaaaattaagctcattttataaattcttcattttaaagccacaccctccaaagacaaccttattttcttaaattcatttcattctttgtagaaacagaagaattattgaatttttcagctgggagtatttcttaaatctaattgacttttctcgccactcatgctgttgattactgacagcgggtcttgtgaaaattgagtcattcatttttgatgcctaccattcaggaaacttttaaaacaagtgggcatgagtgtgagaaaggcctgtgactcttgttacaggctgtaaacaccagtgatgggcactaacaatttccagcgaattaacgagcttaaacctcacctatgataaatcataatcatacacccagctagctttcttgataattattaatctatatattgtgcttgtctgtgtactttgctttagtgtttagatttttaagatgccaacatttttttaagttgctcttcaataaggcaatgtggtacaagcctctatgtataagattagacataactaaataaaattcaatttggaaatttttttccaatctgcatccaaagcaagaaaaaagtaacgaagaagtcacaatgcctatcaattgccttggcttgttttataagccaatcggaggaagccagtattttttatttaatctaattgcttagtggcataagatagcagaatatatataatgtactcgctttgtggctactctgtgaaaatttaacaactgaaaacatccagattttataattacctttcatattataagaagtaaaatttgttttgtataacaggcactggataaaaaagttattattatgagattatgtttataattgggaaaatagacatagttgtggagagtgtttaagaacatgtgttataagagctagcataccagcctctgacattacttgctatacgattgtggcgaattagttaacttttctaaccctcagtctggaaaggggtataataacaacgattttaggttggaaggttatataagacactacatgtagcacacctgctatgtgagaagcagtgaaattagcattcaatatattaataactacttggatgattttggctataaaagaagagaacatcctgactcaaactgatttacacaatgaagacttttattatctcacataataagaggtacacaagttgggcaggctccagggttgtgtgtctgaccattactttgctgtctctgtggttcctggctcttctttctctatgttcgttcaatcctgaggtgcaagaaaaccgagaaattttcaacagtttatttttctcatatctcatggacaagaattgggttgtatgcaggttaatatagtgctaaaagcatgaaaactggaataagatgacttgagtttgaattccagcattgtgcatcagaactatttaactttgggctttgctttatttctctgtgcttcaaattccttatctataaatggaggtcataatattgcattccacattggattgttgtgatgattacatgggttaatacaaatcatgtgcttagaacagtagctggcacatagaaaatgtttaacaagcatttgatttttacattctataccaattgctgagaaggggaataggattactattattggtttggattaataagactatattagctagagatgagatcacatttcattgaatcatgcaggaatatagaaacctcacaacaaaattgagttatattaaatagaaaaccaagtctgatcactacactcaaagtattatcactcttactactgctcctattatcttaataccatcatcatgttacctccacaaataacaatcaaatgacagaacaactgtaggtggccctacctgatttttttaaatctgataatctgaaccatgaacatatttttgccagcaagtatttgggcaaataaaagcacaacttcttatcacccataatatcaataaaataggattttattttggccttgagtcatctctaaatccaaagaatccagaatctctgggcccttctgtcctctgagaagccatcatccatgggaccctagtaaggtgaagttttgacaaaaggaaactataagagattggagtataaggagcaggtggagaagagaggatcaacttttagacaggagcaaaagagaccatttatttatctctatctctttggagttcaaacagtgaccagttcattgtggttcctcaaaaaatgactgatcgataaaaggaagactgaataggcatgcatggatccttcatggggtgagcatccattcactcaaaaactttttatttacatacaataaaattacttattttagtgcacaattttattggttttgatgaatgcacagtcatgtaaccaccaacactataaaaacagaatagttttattgaccttcttccaaaaggttaaataaataaataaatttatatatttaataaatatcaattgagcttctagatcatgtcaggtactgagtaagtgtctatgtacagattaatgattaaaaaaatgactgctggccatgcgccaattacagataatagtttatatgtagtttatatgttcacaaccgtctataatctgacagcaaaaagggttaaaattttaccagagaattggtaagaagtaaaactggatcaatttcattattttaaggctttccttttttttttttttacttgaaagctgttaagttcttttaccgtaattgtcagtgtctcttacttcttctggggttgagaatatctatagacgctcaatataaatatctggaatttgttactggggcttccccaacaactaatattttttgctttagcttgtgatagagcataaaaaatgcagtagggacaaaggcaacttcaaacctagatttaagagcatttgaaaactcccaagaaagatggtagcaatgttgttgagaggataagggatagaaatataagcacctagtttctctcaattcttctctcaagaaggactgctttcagaatcatgttgttgagaggatgtgggatagaaatataagcacctaatttctctcaattcttctctcaagaaggactgctttcagaatcattagtgtaatggatgtttagtgtcatgattcaagttttgcttgataacctaaaggtaagggttggttcacttatattggcattgttgagtgaagtgtttctttcccctcttcatgacaggaaacataacagtttccacatcgacaatggctactgggaaagaggatgggaaatgatagaatgagagaaaaaaaagagtcccaccttctcaaataaaacacagagctgagtaaattgtaaatagtgctatccactaaattctcaaaaatcttaagatcgacttatttcaacatacatgaatgttatgataactaaaagaacaaggttagtgttcttcctatggtcaaagtcctttatggttatgggtaacttgcacatccctgcaatcttaacacaaaaatggagctgagtacagaactgtcattcaataaatgttggatgaataagtgacaaaaaaggaggcaggttagctgtcctggatgcaagcatgggcctcttgtaacaaagcagacctctatttgggtaaatcccactacatttgttttaattgcttcatctaaatgttggtgcaacagaatatgatatagaccatggccttttcagtttgccaattaaatggctgaacactgaccaacttggggataacaaagatccattagaaaaacactaatagtaactctagaatttataatccagtggcaaatgcccactaataattcaggagttaaaaaatgtgtaaatcattttctgtcaccttctgttaccactttctttatagtagggataggaccattaaaaatggaaaatatatgtgtgcaaacctatacacatactaggtttctattatgtgtataatactgctttggcattaaatattttgaaaccccagaaatttgaatcagtggaatatagaagaattacaaaggcaagtgctttaattgaagatgagcgagagcatatttaacattttatgtcctgccataatagaagaaatagaagaagaggggaaaacatttttttttttttttttaacaattgggaaagcaatctccagtttctcttgccttcttcctcttcttccatctctccttgttccgaagatgcatttcacacagttaccattgttattggacaatctatttcctatcccttttgaaaaagtatccagcactttgattaaacagcttttggtcctcacattcctatacttttcaactctgacagtttaatttccagactcagaacttttccaaatcagaaaatgccagatttgtgcattgtcacaggtaaaaatcaaagcagcctcatttatttccaaaggctgtttagctgcctttggacatttttaatattatgacccaaaagattatttctatagcttatagctgcagtatgagctgccactgcaattagttcttataaacttcccaagacaacaataacaaccaacactgttatgactattgataatgacaccttgcttttttatggtgccttttatgtgagctgatcccaaaatattctgcaagccatattcttgggtatcacttcacccatctttgggaagcagccgccatagggtaataagtaatagctgtttaacacagcactggcctaccaaacaccacattaagactattattctctcttgaaatctcgaaacagatattataaaaatagcaatcataatagctatgtcttttattgtgctcattcttttggcctactcatggaccagaggcatttttcagtaaagaaaactgataacttcgctaaaaagcacccaaagaattagcctataaaactactgctcatcaaatctagccatattttatatttgtcccttctccttcacttcaaccagaagactaagcaacttattacctcatagggtgatttttgtgaccgtctttcagctgactttcttatcgctgtgctcttcctctctacatagctaagtccatctcacaaaacaatactcactcaatccaaatcatggacaatgactctctgccgtctaccacatcatatacaaactccatcaatttcccttcaaaatcacccaccatttagcctatccaccactctcttttccatccttgtctttgaacctggctatatgtgtgaccctttgcttcagttcatttcctatcgcctgtccttattcttttgtgtctcacttttgtgcactggcttatgccgacttctccactatccaccttctcaaatgtctcctccatcaatatgaggacaagtctaaactgtaagaattcttctttaataaatatattcaccactggaattgttctttaacttacatgaagagcctttactcacagtatataacactcatcctgagacagctaggtttattgttctttagttatttttttaggttaaactattcaaaatatttttttagactattctctgcaaggccaagggtttgcttgctttcttctttttctttctttgggaaataaactttttcatttttaaaaattcttaaattgacatataatagttgtacatatttatgttacatataatgtatagtgatcagatcaatgtaattagcaagtccattatctcaaatatttattatttctttgtgttgggaacagtcaatatcctccttccagctatttgaaacaatggaatatattattgttaactatagtcgtcctacaatggtatagaacactataacttatttgtcctatctagttgtatcctgctttgatttaacctaaacatccagagcagtgctgggaagccaggaagtataaatatcaataaacattgatatcaatcaataaacattgattcaatgtaggagaggtgtacacccaaggaaagtgacgaggaagcagatctatggaagcacatacccatacccacattaaatcatacatatttatatcttataatctttcccttttttttcttaaaaaaagagactgggtcaaagtgagtgtcatatgggtataagtagatatatttgcaggatgatttgtgaaaaagacatttctatgctaagaagcagagccaaagtttctggtactttcagtacaatgcagagaacactgctaatggttatagtaaatccaatgaaaactcacactgaaggatatgaaagcctaacacccaaaggcaaacttatttttctgtttataaaattgcatccttgtgcaataacacagaatcgtaaaaattaagaagtagaggagctttggaggtcacccaatttaacactttacttgatatatacagtcctgacacaatatccctggtaagaatagtcttctaccttgacagagcttggcatgaggctcaaaaatacctgcaatagttcagtcattatcctcactcatagagccagaaatgcagaaatataactggcaatttcagacactttatggagtactctatatgtgtaaagaattgcaccagaagcagtagaaaatggaggatttcatgaatttataaaaaataacctctgctatcaaaagaggtagggaggtattagcttgcaagaaaaacagggaaaaataaaagggaaattttaagtacagtactagtacagaagtaacaattccatatttaaaactggaacgcaaaggaccattgccaaagattattgcaaatggaagagcaattagcaccattccatcatgttgccctgcctcaaccgctgccatgatcttacttgtcaaagtagtgaaaggatgaagcaaccaactaaagaagccaataactaaacaatcaaccaggcaaccaaaggttctttgttagtgtcaggaatgatgggtatgaaaacacaagctccattagataataaggtacataatgatgggaaccataccaaatttttgtttgtttgtttaaactagttgttataactggcatcatatctaatatctggcacatggagagactcagtagatacttacaggaaaaaataaatcctgggtcattttttgaggggaagtggtgtgattatcatatcaataggaacagaaaccagtaacatctggtctacataagtgactttcaaatggcatgagcattaaataaaatgagaaataggtgttaaaaagcttccaataatcgaagcgttctttaaggttagtattaggtttctatatctttctatttatcttctaacatagttaatttcactttttttttgttaaggtttgaaaattgtggtgttgtgttttttccaaagtaaatcttacttggaacccaagttacataattagataaaagcaaagttggcaaaagtagtagcttttcttataagaaacatcttgagaggtttctaatgaatgctagaagtccttggaatacagtttaaaaaccactgccctgagattcagtaagttcagtaagcattacatacctaaggtgcagtgcttgtgtgcttctgttagggctttatataacactgattataggaaggaacaataatttccaaggctgacatctccgaattgtagtatgtctcagagatttaagataaggaatacttggatcctacattttataagtgacacaggaaactagtcaaaatcaaacaagagacatcttgctgtggtggaagttaataggaatctgtgtaatacagagcacatgaatactctacataagaaatctcccacaaggcaagcaggatataggcttcttgagattcaataaatgcaaaataggttggtaagttttcacaatgtagccacagatgtgatatatgcattttacaatgtgaaatgccacatgtgaataaaccaaaagagtgaaaacttaaaaactaaactaaactaacaaaataatacaataaaaataattcttttaaaattatccaaggatgagaagtataatcaaccttgtggaaagttttaaaaattagtttcatgagaaaaaaagtgaggggagctggtatttttatcaggtttctcttgtggcctagatgagattgccgtcaaactcaggaaaagtagtcaccccttcatttagcatttattgagcacctactatagggaatcacatcctagttattatggggatgaagcagttaaaaaaatgtccctgacttgtaaaagctcacagtctaaatggagagaattatgcttctataaaacagctgctaggatatatggcagattgtgctaaattctatcagagatactggagttaaatcaatgggcagtcttgaaaattgaaaagaggagcttagagcttaaatgatgaaatgagaaaacactgaaagcagggttagtaggtaataatacctgtctttgagggctattgctctgatagtcttgtgtacgtgtgtgtgtgtgtgtgtgtgtgtacatgtgtgcttgcacatgaatacatatgcatgcaaaagggaagagacttaatttttatttattttgacagggtttcgctctgtcacccaggctggagtgtaatggcacaatctcagcttactgcaacctctgcttcccagtttcaagtgattctcctgcctcagcctcccgagaacccgggactacaggcacacgccaccatgctcggctaattttttatatttttagtagagatggggttttaccacgttggccaggctggtctcgaactcctgacctcaagtgatctgcccacctcatcctctcaaagtgctgggattacaggcgtgagccaccacgcccggccaaaagagatgagatttaaagcaagtacatcagttaggaggcaatgataaatctaagccttagtacctaaaccagcaacatacagagagagtagaaggcacagtatgaaatagaggaaatatactatgaatgctaagaaggactaggatggtttaagatatgtaggtaacagataatctgcacctctttaaaaaaaggctaccaaacaaagaaacagattcttgtcacttgggagcccaagataaaccaaatctatttctcatctggctctctatcccacccttcaaaacagataataaaaataaataaattttaaaattaaataaaaggaattcagcagtcatttgagacaaaactggaagttctatcttgataaaactccctacctgaagttcctttagtgctatatgatctcactgtcttttctttcctctttcctgctcctgtagcagtctcagtctttgggattttatcaaattgggttttaatcactttacatttcatgtgaagatattgtatcccactgcctctgcaatggtctcagctacccaacttttactacctaaaaaaaaaaaatgcctcttaacagcagtggcctcctcctccttcctgcaggataatccctatgattgtgatgcagtttaaatttctcaagaatataatcaaacagggtgaaaacaaggacttacacactaaggcttctttctgtctgcttatgctgcttcctgctgtacttcagtccccacaaaacccaaaaacctttgtagacatctggaaacagtttcatctgtggtcacttcctcaaataatttccctgcttagaaaataaacacactagtaagatcacaggaccacataatttctgtactcaagcactccccattggagaataccatctatgcttgatggttgcacatcagaggatgaatttgggtagagggaagtggttagagagggaataattgattaggtgagtgtatcagtcccttctcatactgctataaacaaatacacgaaactgggtaatttataaagagaagaggtttacttggctcacagttctacagactgtacaggagcatagctggggaggcctcaggaaactttcaatcatgctgaaaggggaagcaggcatgtcttacatggccggagcaggaggaagagagtgaagggggaggtgatacacacctttaaacaaccagatctcatgagagctcattcactgtcatgagaacagcaaggggaaaatctggccccatgattgaatcagctcccaccaggcccctcttccaacactgaggattacattttgacatgaaatttgggcaaggataaaaatccaaaccatatcagtgagtatgttaacagtccccaagaatattaatgtcagaaaatgtatctaattaattgctgctagaaagaaatacttttgacctcctagtctttttagtagtttttgttgttgttgttaaatggaatgtttgtgcttggccaaagaagtagtatttgttctaagtacttataacatatttataatagcattatgacaaacagcttggactcagatctggagatgtttgctcattttcgttcaatcattttttcaaattacaaatgtttttgagattatactcatatacttagtctccagaatggcagaggtaatatgtacaatgaatatatgtcaggtgctatgctttgtcttgggggtatatccgtgcattacatgaatacagtctctgctctcatggaacttagagttcaactgaggcaatggacattattcaaataactgctcaaatgaacatataattataactataaaggaaagacacacaaaatacaagatgcaatgagagttcattacctgaatgtggagttaggaagatttggatttttttatcccagatttttttttttttatcatttttctgttaaaagctagagcattataaatgatattaaactagttaaatacctgttacggtgaggaaaagagctgttccatagggaagatttctgggagagtgaagaacataggtggtgtgatttgaaacgactattggctaatagaaaaaggtcacacaattcttcttatgatgtaataaattgctctttttcaaggttgaggaagtagaggaataagagaaaatgtgaaatatgcctgtatttgatgaccaatagttttataggctaattattttgttacatacaaaagttatgctttctttactgaattacatctctagtttataagtagggcaaagcaaccagcataatacaaaatatagccattatgatggctattactacaaaatttttctaaagttttgaggagataataataacctcaatgtaatgttttgcaggccggtgctgtgttaaacagctgtcactttttaccacaaagatggttgtatccttaacatgggttaggtgattccatgaatatgatttgtagaatattgagagagctgctgaaataacagcagcatatgagtgctgctgaaagttggccaagaacagtccaagataattttcatagtgttttgtactccaagtgactcttttaaccattagttttgccctgtatgtaggaattgtgcttggccaaagaagtagtatttgttttaagtacatataacatccttataatagcattataacaaacatcttggagtcagatctggagatgtttgctcatttggtcaatcattttttcaaatgacaaatttgaaaaattcatacttcatccaggtataacttagttgtaaaaatcacaacactgccaaacaattcaaacacctttagttgagtcattatgtttaagcttctttgatccttccttctctagagttacactaacatagtaacaaagggcagatttacagtccaaactgaaaagtcataattcaacacataattcctcagttgtcagccccaagtacaagattgatgatgaagttttgaactgacacaattattttaaaaatacttacttccaaatctacacaggaagtttatgtctataatgacttaggacatccaaaatgaacctatttcctaaggaggcacatcattcacagtatcagaaacccttgcaagtgttgcataatgatgacatcaatataacttatgcaaagtaaaagcgttaaaacattcctaaatacttagcctttatatgtccccttattttcacaaagcactttcagacaaattattgttattattcatcacaatatcctaagatagacagccattatcattcagataccacactcccatcttcattgccactgtgacccaagactgattttccaatcagatgtctacgcatctgatttccttacaatgagatttaagaatttagatttacagatcccatcacagacttgttgaatgaaaatctctttcgtgggaatcaagaatctatattttgataaagatcacccaggtaactgtgtttcagtctatccaatgattgcatttaggaaccattattgtagaacagtcatggaagaaaacttaaagacaaaaagacacaagttttatttaaaatgcatagaacatgttgtgtttcagtgtcaatgggaattgctagcctgatctgtgcagatagtctccaaatgtgttatgtttgaaaagttcttttaaattaaaaggactagaaatcattctcccatggaaataacttggtaggtactggtagattccaagagcattcatgacacctctgtagcaaatgatgcagccaaataataatgctatgaagaactatttcagttattcctaaggttcttttcagaaaatacattttctacagtaaaatagataccatattttagaaattagttacctcatttatttctttataaaaacattggatttttaaattaaatatatattgaacttatatatatatagaaatatatatacaagatggtgaacaaaatagaaatagtctagcactcatgaaacttagagcctaatctagaagtctgccaattaaaacaagcaattagagcatcatgagtgctatgacaagatgctatggagatgcccaaagatgggactcaattttttcagggtaggtgtttacatgtgggtgaagaaggggtagatgaaaggttaaagaagataagaagactgtctagagaaaatctttcctaatatttctaaacagaatggagaaaaggcaataaagaatcacctgtttttttgatattgttgttgcttgcttgtttttttggtagagatgtctgattcccataacagacctacagaatctgaattttaggagagagttgatcctggtaatgtatatttttgtacattctcataatagatatatttcttgagtttttattttatagtaacctttgtgctatatattggtaatacacagataaaagtccaaattttgccatcacaatgactattgtagatttgctgagagatatctgtaaacaaagaacatggggtggagttgaagcttaggtctaattgctggtctctgtttacacctgcataacatgtaataaatattcctttgatcagtatctcctttgagttttcaaatttggccttattgatagattttgactttaggcatatgcaggctattagttttgatacacattgaagcagagaattatccatatgtgacctctagagacagaatgattgaagtgatggggataaaactaaactgatagatgatctcctttttaaggaaacaccctagatttaaaactgaggaaacaagacatggttgcatcccacacctccagcatggctatgcacacttttgtaagtaccagagaaattcaattaaattcatcatgattgcatgcttattgcatggaaggcacagcataaagtgttgaaagatatgtacaagtaagacaatgaccttgaaaaggtttttaacttgtgggaatagaggatagtgtatcaggtaagaaataaacacatacacaggtattagggcagtgttatgggttagttagagcatatgggcccttgaagtagatagaaatgggtatgtacatcagtctcaacttttgggttgggttattttgaacaagttactttacattttagagcataagtttccttatttctaaaatgatgataatggtagtatttacctaataagatagagtttctggcatactgttattcaaataaatgacagttgcccatttagtattaatataggggtcatctttatattttagtgaatagtcaccatttctgattagaacacctataaaggtttctaagaggcaaagattacatttaaaagcatccctgataataaaaatagcaagaagaaaaataaagtgatatcaaaattaggacacattttgaggaagaaccagtaggacacatcagagtagagagaaaaataggcaaatgagcagaggaaaagttgtagatactgggttgattgattcctaatgatggaggacattaaatatcatgtgaatggatacaggagcaattctataagcaataaggcttttgaacaggaggaaaaaacatcatcatatgtgctgtacgatgtcaactttagtacagatacgaaagttgaactcgagagaacagaaagtagaatctgggagactcattaaaagaccaggtcacatgaaggattagaaggctctgaaatcatttttatcatcatcatatcttcatcatcagcttccttatcatcatcgttatagctaaatgtatcaaactttgcatgtatcaactaatttaactttaccacaacccaatgatggattttactaccattatttccagtttacagatgagaaaagagaggcacacagaggttaagtaacttgatagctcttactaagtggaaagacaagggtataaatcctggcagttgactctactatctttattcttagtcattatattacactgaatcttggaggtaagtacagaagttcactgtcatttcaagacggaatctatatgaccaggtaactgagtgaggtatagaaatgaggaagaataagggagtcaaaaataactcagacattttgacctggggtaactgggatttgggggtatctttaaaaatataaaatttggtgcaatagagtttaatttttagcaggagggtttgaagattgtgttgcaggtacctgcaggcacacttgagcttcagatacgattgcttgctaacagactcagttaactgattgaaagacatttttagtatgatatatatttttagtgccttttatgggatcctgctatatttaggggccttctagaattctgcttgcttggtgctgaatcttgctggttgatttttcctagttccttttctttgtttttctctttctcaaagattttatttttctctttccaacaacagattctttgacttcactggatattcacagttttgttttcctttcaccattccatgatctgtttgattctcagaatacatatatattgaatttctaatgaagtcttctaaatgtttccagatttcttgtggtttaactgcagattttttctttctttctttctttctttttttttttttttcagttctcacattttggcacagtttcctttcctggagattaatagctgggtgatagatttcttcatttttcccttctccctccagaattttgtgattttattttttacacatttacacatacctccagcatcagtttttgtttaaatataaggatcatctccagacatattcttttcatttgagttctaaacacctactgtagaatgtagttagttacttacctcatctgaaaatcttatcatgtcttttttccccaatgtgggtattcatacacttcatatgtggccagctcttaaccctgaatattgatacttgctcttcttttacagatgctctgggttgcttcatattttaagatcaggctcactgttttgaagagacaggttagagtgtatccctatgacctcattttattatttgtattcttccacacacacagggattctatcatactgggttttctttatactataaggtttttactcagttttcatttatactctccttcatgtacaagatgtcccttatgtatcttcctcatagattttgcaggctacactcattatactctattggttaccttttctccttcaagccacctagtattaaatacagttatcttaacatattcaacagatgttgaatatagtgcagtgctttgaaacattctaattgtcattcttcaacagtaaattaatgttcaggctttttaaattcactgtagtggcatgaaagatttccaggagaaaattatttatctagctgtttcctgctccacacccagtgctattacttactgctgaaaatggaggagttggggtaaaaggcgggaaggaggaaaaagaagcaaaaaaaaaaaaaaagacctctttagtttctcctttaaagaaaagtaatgattttctcctggaaggaaatcaaaggctgcatgaaatgtctacccctttaaaaaaatgtaagctgatttttttaatgctaggtacttttatctttgtagcttaaaggcaaagaatgaatgaaatgtggaaaatgaaggacatgtgacagcatcaaagaagtgaagcaaagctggagattgtgtgtctggctatgtcaggccagggtggccctttttaggcagaccattaaggcaatctggctgccagatgaagtcttcatgaaagggcagaaaagatgtataaagtctttttgatgttttaaaggaaactcttctttatacctacccctccctcttttcctccatcatcttgtcccgaccaatgccatctcctcttgcaaggcaaaccacaaccatctgtagaagtgttttatgttttagagcatttggatcttggcttgatctctatcttgagtgatacagggtacatttttagtttctgctgggagaaaatggtgaattcctgtgtagaattggtagaagcctctaggacattttgagaggcagtggttaatcagagtagaattaatcaagttctgtttacctaatcaagataaggataatttcttgaatagaattaattacatcacactggcaccattaggacatcctgacaaattccctcatgttatacagagaaaaccaagcttcaaggactcacaattaatccaataaaattataagactgcaatccatttctccacactcttgcttctcacacgatataatctttctctttacttgcagaagacctaaattaacatttctacttgtggcttctcttccttggtattttacttttactccttccctctgtcctagaaaatcatttgaccagcagggcttgcatcaactggatattatacttgaatcagtatattcaagtctgtggctttgaacatagctgggtcagcatagaagaaaggccttgctatgcataagactatttctaatggtggtaggttgaaggaggggcaaccaggtggtgggaggggtggtgatgtgtatgtagtaatgctcatattcactgagacaataaaaaacacaacaaagaatgtattatgctcttatcctgatgtctctgatcttcatagttcttctaaattaaatgttttcaacccctttatccttcagctctatgtcagcttcttggcctattttgcacgcttttcatattgcacatggtgcacaggtggtgtaggtgatgccacattagtttagcagaatatcctagtgatgtgtaatgaaaaagtggactggctcaaggggaaaccaaagataccataaatttaagctctaactgccaatatccatgtgggtatctttgagcaaattacagatggtaaacctagcccagaaagatgatgaaaaatgaagatggtattagatttcctgaattttaaactgcttttcaatactagctatctcaaagaaccagagaaaaagaaaagaaaaaaaatgcagccttttattccttgtttgcctggtttctactttccactcttctttctcaattacagtgatctttctattacctcaaaatgtcagcagtgcattttttcaaagcatcaagaacccagcaaacatgaaagttttatattcttcctattccttttccacttgacaaaaacctcttccttcatagatattacacagtaaggtactgagttatgaaacttccctttgactcacacagcatctttcttttcccagcacatagcttctttacaatacccataccaaaggtatatcacattctgatttattttatatagttacagaagggataatcttccctttgtacacatttttttcacttttattttatgttcaggggtacatgtgcaggtttgttacataggcaaacttgtgtcatgggggtttgttgtacagattatttcatcacccaggtattaagcctagtacccattagttatttttcctgatcccctctctcctcccaccctccatcctccaataggccccaggatgttttgttcccctctgtgtgtccgtgtgttttcatcatttagctcccatttattagtgagaacatgcagtattttgtacacgtttttctatgcaaatcattccaacacataaaaacaacaggccctttcaaagttcattggtgctccttactggtgtcaaatatcatatctatatgaccttaaatgccctccccatccagaccacttgttagtgggagttctttgcctcacttagtgatcgtgctatgtataaggaaaagcagatgtacaaaagccatggcctctaaagggcctcctgtcagacccatgcttttccagggagaccccccaggaacagttaactttgagatcatatgcagctctattgattaaaggtctaatttgataccctacaacatatttatgaatgcctggtatctgcatgtttcctgacagaagccccttgggagccattaatctgtgaagcctcagggcttctttcttggcctaaaatcccagggactttgctgcttttcattggcagctgccaaaactgactccatcctcttgactttctagtctccctttagcctgtttgtggggtaaaatgcagtctgtttatttgctctcaagttcttgctggccctgctagattcacacaagcttcttttattgtaacctaatgatatattatgaatcactcctgggaaacgggataagaataacaaaacaaagtgatgcgtttatttgctcacttaacatgtatttcttgagcttctactatattgcgggaatgggggaattcaaaagtaattaagaaatgatgtctttctctaagaggctcccagtctaacacaaagctcacatatactcagcagaaactacgatagaaagatgaatgaggaatgggaaaagcacagtgagattgaccattgattaaaaatcttccagaactgttaaaagtctttgcagtcttcatctcatcagtattgatcagtcatgcattttattcattaatgcaacaattacttctgagcaactactacaagtcaactttattctaggtgctggaaacacgataataaagaccaactaattcataagcttctattctagtgagggaataataaacagataataaacaagtaaacatatagtttcagttcatggtaagtactatgaacaaaaagtggataaagattaatatatggtcattgaaggccactctgaggaggggacatttcagtggaagcctgaatgaagtaaggcagagagacctaagtggtggtctagataaataattttcctggtataaggaagtgcaatagaaatatttttgagaagagagtggtgttggcatttttgcagatcacaaagaaaccctgcatagatacagcagagcctctcaactggctgtagtgggaatatttacaccaaggaaattggcaagtgctacgaatcaaggcttcctctgggtctggatgacattcagaaaatactgtgtctgggcaatgtcacacatctacagaaaaagcccatttatttctcagacctcgaaaagcaaaaccacctcagttctagggaaggccttcaacagagatggacaatcccagaaactcagccctgtgaacacattgcctgcaaacttccaaagctgcttggattcagggtagaagaaacgattagagaaggtcctacaatgcattttggtgtaagtttttaagtggcctatatcattacaaaaggagtcatgatccccctttttaataattgcagaaccccaattttccttttgtactttttgtcatggggtgatatcagattcatcacatgtaaatgacaagtaaaagagacattggcctgtacaagagtgggaacacaaataagttgtacagaaagatgaaacaatcattttgtagtttaaaaatactgagcaaatttcctgtttttaacaagcacgagagattcaaaaaccagacacctagacttagtgattccacaatgcatatatacatcaaaacatcatgttgtatatggtaaatatgtacaattttacctttcaatgtaaaaaataagttttttaaataacagaaccaaaaaccagacaccactatgagcctcaggtccagtagtagacacacacacacacacacacacacacacacacacacacacatgcattaagaaatctccacagctaaaatctttttaagtctgctggatgatctccccacctccattccaaattcctggatggtgcacttgtcacgcaagaaactgaaacaattatatgtgatatgtaattaagcatctatacttgcagtgagtgatagatttaccttcctttcccccctttttattagacgcagcccagagataaaaccttcaagttatgagtaattataccctgctgagaaaagtgatagagtgctacactcagaaggacttacgaagccctgaaaatgtggagtcaacacttaagactttttttttttattattattttccccaacactaacagtttcccagcttgttcccagagggagataaacaaacagtgtgtatctgcattttaatgggaataaacaggactggcctattcacttttttacaacactggcttcatatttccaaaccagtgggatacagtaaaaagtgtatgcatcatagacagtggaaagctacaaggaaggtaatattttctattattatatatgtaattttggaataaatgggatcataacattttgttaacaagccttcttagccacctagaatcctctttcagttggtgctagacaatggagaattacccttagatgccttctgaggccttggtaagtcagatgccctcccatcttgggcatctttggtggagaaaaacacaagaacaaagaaccactggtcttcctagagttcacgtctattccagcttcaacatgtgctactctgaaaccttatttaagggtggaacaaaatagttgaatttgtgaggctgtgtcaaatttagttttctaagactcatggttttatgccaggctcagtggatacttaaaacattggttgtcacactgtagtttgtgtaaaaattagctgtattgctactaaaagtacaaaaaattagcccggcgtggtgactcgtgcctgtagtcccagctactcgggaggctgaggcaggagaatggcctgaacccaggaggtggagcttgcagtgagccaagattgcgccactgcacttcagcctgggcaatagtgcaagactctgtctcaaaacaaacaaacaaacaaacaaaacgaatgcaaatgtctatcctccatacacagaaactgttttgattggcttggggtgagggtcaggaatctgcattttaataagaacgcaacataagagatactgatgaagtggtccaaggggcaaacattgagacatcaccctaagggatctacaggtgggttttaggaagcccgtgaatgccagatactgaatgatattgtgtgagtttttaggactgcacatttttgaggggattcccaaatgactctgcagcccaggaaggttaagaacctttcagggcatgagacagtttagggctgaggattccagtcaacttttggatcccagccagcttcactgaatcccaggacaattcagcagcttggtttaggaaatggaagtaatttccttggcccatctagtttccgggtttagctcttctgtcttgaatcaggtttttgtgccattccattttctcaacattcctgcatggtattcctgcaattagccaatgacttatttcaggaacctaatggggcttctaaagcaagattttctaaattataatagtttttttttgattagtgaataataaatgttaaaaatgtacaaatcatatctctgaattcttttcatccatatccaagcatcagatttaactctttcatcacttagataaacatgactaacttgaagtgtgatctccagtaaattacttagtagccacaggccttagcttctccatctgcatactaggaacacaaatatctgtctgaatttctgaattactgagggaaaaaaaagagataacaaacataacctaacctaataatcatttaaaatattctattacagcaatgtattattcttgtaactaaaacatttgtgtgacttctgtggcttcatgattgttaaattcatgggaacagatgtcattgtattggatattaatacaacaattcatgagccaaacaagggcttagacaagggctttctgattgttccgatcagtgagaggtagcttgagaagcacctcttgctgcagtgatgatgcaggagtaaacataagaattggaaggaaatggaacaagagcagatgtatgaggaaatgccagacaccagttctaaatcctagagctccatctacttcttattctttaatcacttgcttccctgcccagccatcctcaccaatattggcattccattactctctcaatttctctgtcttctttagtaaacctttgtctctttcgtttttcttctctctgcctgagtctttgcctctttcagtctcactcattttccctgtatctcccaatacactggtgggaatgagattagagagaataagttggaagatgtgaaggcatatgaaaacattattaataagtgacacctggaaagatggaaaattaaagaaaagtattaggtgatgagtcagcaaagatagaaaaatggtcaagtttctgccctactccaaatcatttctgttacaaccttgtcaatggttagtgctgtgctactccatgtttccagtggtttttcttttgaagcaattaggttattggaatagatgatatctaaggaccttttcagctctgaaagcctggctaatgatcagggagctattcatgacaaagactaaatttccactctaatttcctctacctggtaaatgtaattggattacattggtaccagaggtgcttcaaccaccacttaattagacaattttatagtgctttgccaacaactgcactgtaatagaacaactccacggtagatgaatagtttcctgtacaattacaaatgaggatgagggcgatgttattattctttacttttctaatgctttattatttataaagcacattcatatacataaacttactatgtcctccctaaaatcatgagttaaaggttttacaaatttacattttataaatgagactgctatgcttgcaattatttgatttgttcaaggttaaacagggatagtaaggcgtcttttatcatacaaaaaggtaaatcaatgcctgattgtccaacttctcctctggtgttagggaaactggaggacttgagctcattcaggcaggatcttcttcaaagttcccatctatggagttatttgtcataatagacatgactgacaagccttggaatcattaattcctggtagagaagttcaaaaaagcatttgtttttgaaaagcaggataccatttgtcttgtcatgtaaagatttttcaaaggtaaatgaaatgctccccatctgaaagacttggtgagccttgtaaaaacagcaacaacaacaaaaaaagtatatttacaaacaaacaaaaaaaacaacgcttgcagtaagccagacattgtgctagacaatgactgatctcgttttgcaacacatgcttcattttggtattgaaacaagctcaaattcatattaaaaacagaagctggagaagaccagaaatcctggccaccaaaatgtaggaaaatacatctagtatttcccacccttccacccatactatgtaactaaataaaacattacagtgaaatgaagactacaatgccaggaaagttaaacatgaaaacaccagctaaaacaacaaaataataagtccagtgctttttatgaattaaacaccacatcatcaccagctctacagtcatcatccctttgctgaccctagttcagtcacacatccacttctttagttgtgcacagtgtttgctaagtcatgatgagtttcagacagaaaacggaaagccagttgcagtcagggtgcaattggaactgaccattctaaagcttaccagttaacgcaatccgactcctataggagagaaatcagggttaaaagcacatcacattaggaggaggtggcaaaggtgagagaggtaaggggtgatggccattagaagatgaatgccagatttttccatgtaaactagtatataggaagctgaagatggacaaatgctcatggctcccatgggagacctcagatagaaatgcagagaagggtcgaggagcaatataggcagcggaagacacaaaccgaaaaaagccataatccttttcaatttctcccgtggatcccaaagaatcaaactgcagtactgatgtggggaattgttttttgtttgtttgtttgtttgtttgtttgtttgtttgagtcagagtctcgctctgtcgcccaggctggagtacattggcatgatctcagctcaccgcaagctccgcctcccgggttcacgccattctcctgcctcagcctcccgagtagctgggactgcaggagcccgccaccacgcccagctaattttttcgtgttttttagtagagacggggtttcaccgtgttagccaggatggtctccatctcttgacgtcgtgatccgcccacctcggcctcccaaagtgttgggattacaggcgtgagcctccgtacccggccgggggattcctaaatagcccactacgcctcctatccttcccaattcctgcctaatgctcagctaaatcattgatcgagattgaggtttggtatgatacaaagaggggcttattaagatgatcagagacaatcataggtcttgacattaaagtagatttgaaaaaacaaagtagatttggggaaatcattaaactagatttgggagaatatacacttccatgctggtccttgacctattattctaaaagttattcttcattctttcccttcttttctgaatcactgtgcagcagactggtacaggctgtatttcccaggatcccctgccaactgggttcattcagagagatgtgctaacagaaaactagagtatgagggcagggagtaggcactgtattgatctcccttttcctctgccttggtcatagtctttggagatggctatatttcctctagagatcaatcccttgactccagtaaccccaattcccctcctttgtctctccagttgatgctagtcactgggttactcactgccctctaattggcttttcaaaatttcatcacttctgtgttacaaatatttgaattgaatgttctttattttaaaactgagtgatttctgactcctgtttcctgagtgtgtcttcaccaatacaaccatctttttttcaggctttctattattaaaagcaattttaatatttctgattaaataaattttctcatatcagtattaatataccacaaatataattaaacagccaatatatacaattcaactatctcacctaaacagtttctaaatttctcctaaattggtatgacaataaaccaacatcagtttgtaatgtaccacaactaatattgtctaaactatgaacaagaagcaaaataaattgacagaaggaaagttgaaatagcacatacttagtcagttttggtaaagatggaagcccaaaagtaaatgaatatatttttaaaaaactgttctaggataaaagtcttttagaaaaaaaaatgaaaaaaaaaaaacatttaaaggaaaagtctcttcataaagcagtgttttgcaaagattttttcatagatcgattatgttggaatcacccaggttcttactaacaatattagattgttcctagtccctaccctagattgactaaattagaatctttggtgtgttggatccaagaatctatttttaaaataagcatacttagcgatgtttatatgtattaagtgatgagattcattgccctaaaaatgaaaatagaatactatttattggtcactataaatcaatgagctagtaattgtttgatagttagtgcaaagtccacgtttcagaaatgtaaacactttttttgcatagagactgagccataagggtcagtgcccttcacctcatcttctcattgatcatccgaggactttcaggaatattcagctaaatttttatatgcggaggtctttagctaaattctgatataattttgactaagattactagtaagtactcaaggggacagattttaatcctcatttagagtgatgttaggcttcatttcattatagcaactagaataattcctggctctaagtcttctgtaaatatttgatgataagattaattattttattcatctctttattcacagaacctaatacagtgtccaactatcaatatatattttttgacaacaattgatgagaattctactaaactcactcatgtcatgcgaattgaccagtgggtagaaacatttgagaatcctatctcaagtagatcataactagtaatagtattgattttatttctccccgatatactatctaagctataatgttcattattcagggatttttatttgagctattcattgccaggataaaacttcaattttatatgaaaactgtagggaaaaagaggtcagagaaataatttagattaaaaaaagtagcagaaattttttcctcctagagacctgccttatcacgtgtagtcaaaatataaagctagttcctgttatgggtaaaattttaaagtgctgaagtgtatcagtctcactttgctccccattatttcattcattgtactttctggggccctttcctttgggttaccctcccaccaggcactccttcattcaggatctcacatccttcttgggctcccactcctttatgcctgcttctgcagaacaactcctgagagcatccattaactgggtttttcattgctatgtctctcattcgttattctcttcatcttgagcccaaactgtctgcacctcccaaaaggtccattaaatgaaagggcagactagaagccattcagtgattctcttccaaataacaagtactttgtatcagcagtctctgataaaatgggggtcccctggtgaggcctaaaacaaaagtatcccactcggacacacacacacacacacacacacacacacacactctctctctctctcactcactttgtctaggttctgtcacccactccctgttgtaacctttctctgtcctctctttccagaataagtttaggagagagacaagaactgcatgagtgcagactataggtctgaaatttataactttgtccttgtcacttctccttccaaacgtctcacctccaaaactcagatggagccagctgcttcaagatgcagacaacatcatctttttttttaaactatagtgcaggcaatcatggtttacaaactagtttgaagtatacaaactcaccttactcagctagatcggataagttacaactctacagactcagcatattaagttaaaaattgcttaaagcactgtgccaactcttcaatgtctttcttatttcactttctaggcagggcagcagatttcttctcagtcattttgaattgctctattttcttgtcattataatcttaattcttctatttcagtatcaagccatctatttcaaattattcttaataatgagaatctctggttctgcggaagaacactgggaaactgacagtcagggatccgtatttttattttacagatgtcttttctgggcatctactgagcactggtatgagatccgatccttgcttccaatgatatatacagttcagtagtgggcaaacacatttatggacaactttattataataggatgtatagtattgtttatatagatattgatatatagatataaatatatatgacatttaagctggaacataaaggataaatccaatttcaccagtcaaagaaaggcaggtaggttactgcacaaagagaaacactatgagaaatggcatggagatacagatatatcttattcaggaaagcaagagccattcgtggtgaataatgtgcaaagttggaataaaaaaatgaggaaagatgacgttcaaaagataagggcagaatgatatgctaaaaatgcatgaactttcttttgtgagcatttctgtaggaaatcagatgggaagttgctactgttcatagtgagaaatggtgaagaccacagtttacagggataaaaaggggaaaatagacttgatgttcctttgggagataagaatctccagtggtcggtgactaatgtgttatgtaggttaagggagaagaatgagaacctcaaaatgcctccacagtttcaagtgttagtgagtgatgaaagagtttattatgaactgagattgagtactccaacaaaaaagatttctgggtgggagtgatgcttagttttgctatttagagaaggaaatttctattagaaaatcagaactgagctgggcacggtggctcacgcctgtaatcccagcactgtgggaggccgaggctggcggatcacgaggccaggagatcgagaccatcccggctaacacagtgaaaccccgtctctactaaaaaaatacaaaaaattagccgggcttcgtagcgggcagctgtagtccctgctactctggaggctgaggcaggagaatgacgtgaactcgggaggcgcagcttatagtgagcctggatggcgccactgcacttcagcctgggcgacagagcaagactccgtctcagaaaaaaaaagaaaatcagaactggactgggcgcagcggctcatgcctgtaatcccagcactttgggagcctgaggcaggagggtcacttgagctccggagttcaaaaccagcctgggcaacacaggaagaccccatctctgcaaatagttgtttttaaaaaattagctgggcatgatggtgcatgcctgtcattctacctactcaggaggctatggcaggagaatcacttgagcctgggaggtccaggctgcagtgagccatgattgtgtcactgcactatagcctgtgtgacagagcaagaccttgtctcaaaaataaaatgaaataaaataaataaaaatagaaaatcagaactcagtagaaaaattagggttgagatgtttgcttgtgatttttttttttttaggataaaagctataaggaagtttggagctgggcgggaagaagactgagtaggaaagcttagtcaacacctactgttaagaaatacatggttaattatttcttaaaactttaaaactcagttcagttaacattccttccaggatgcctttcctgatattcaatcccaacaattaggtgttctttcttcctaccttcaatcttacctcttttacactagtattatacttagccacaatattatgttagttcatttgcttttattttatccccgctgaagaaaagtgtctaagagtgggactgtgtcttattcaattttgtggtcccagaacatatctcagttcttagcacagagtagaagtgtaagcactagtcttagcacctagtctgctaggataaataaatgagtgagcaaataaatgagtgagacagccattatcaggcaaatgtgtaggcgagaagtagaatgaagacaagacagaatttccagaagatgaacagtatgaaatgttagagagcagtcaagtagagtgagattagaagaaggactctattattagattaagcaaataatatttaattgtaggatttataaaaaatttcaggggagaggggtcagaattaggttcattgataagtttatgaaagggagaaggtggttgtggcaaccattgactatacatggataaatttagaaaaataaggaaaggtgaatctatagatgtttatattgggtggcagatcttatattttaggaagacagaaacttaaaaatgcttgacaaatgatacatatttgcaggtgaggtaaactggaaatgaatgtagaaggagctgggaatgaaggctatggtaatagaataatcaaaaaatggggagaaaggtaccttacagttttactgtttttcagtcttactttacacacacacacacacacacacacacacacacacagctacatgtatagcaggaatttcctaacaacttgttgatcaactaataagaggttgaacagttcatacgaaatgctagcagaagagagggcaccattttctgtggttactctgagatttcaggaagcttcaaccacactacagggagaggaggaataataactggcaagctataagaggtggttgtccagccacatgcttaggttgaggatggtatcatctggatattgttccctaagtatagaaatgtggaatgtgccattcccaattaagagtctgatacatcctatctgttttcctaataacagtggatttttcagagtcaggtagttgtgacattctcatttactgtgcaattcagtttatcaaagacaaagtctagcttgccagacttgcttctctctagcttcgagacaatcagctcatgaccccaaacaggagacacatagcccccaggggcttcaaatattctttgtcataaaatcacccagttccgtttaaaaccctgccagcgagcttggttcagtgatctctgcagctgtgacttcaacaggttaaagctacatcttgtgaaaagtgttcatttgttctaaatttaccacccactaatgccatggagtgaccctttgttctcctatgaagcaaccaaacaaaaagcaagagaaaatagcagcccaagctcaggtaagcttgatgctgcagtgttttcccctttcttgttctcttctatttgtaggtaaataagcatccaagctcctgtctgcaaaattcatcccaagctcccaccaccttgtcaaactcttcaagggaaacattattgccttaattgcttaagcccaatttgcataatatggagctctgacagccacaaaaacagggatgcaaaaaggagattaacaagtgaggagcacgcttagccaaccctgtgcagtttggaaatgagagcagagaagaattcatcggatgggtgggttagctgtttgatccgctcccagtccctccccgctgtacctccttctccccatcccaccttcaggtttgtttgtttttcatttgcatgcattggctcctagcatgtgcccatgtgcccagactgttaattgccattcctagcagagcctccttcaggccctggtaaagctcaggcagcatcagccagtacagatttaaacacagcctttcctctttacaccaagctcatccaaatatccaaaatgttaacactgcttgggaaggcagggacagtgtcttagtcacctttgtacctttagtgtctttttataaaattaaattgatatctctttggaagagtcatggatagtcaactcccatcaggaacctcctgtgcatggctggcagagtgccccagtcgccacagcagaattctgtctgtgccattctctctcagagtattttgggctgcttgttgcctacaggttaatggaccccttaaaatagcctcaaatccagatccagacaccctgcattacttctgtaaaaggagaatgatctacttactcaggctcttgtgcaggagacatagaaactgaatgctgtgtttcatagccactcatagaaccagctgaagctgttcaagtacggtggactttgagtgactcttttcccctcagtattaacaccttgactggacctaactgaagactctttcctgaccaaggaaaagtgagacttattttaaccatctgtggagagaacaatagatttattcagtcctctcaaggatgctagcttttcatgtttaactggcacaaacaccagtagtgttttccattctattactcagaaaaccttaacatttcctcctcagccaactacttagtggtgtttcttgacaagttcataaactcccctcttcccctgtggtctttaatttattctctgacccttatgattccaggtttgcctacttcagtcatgactacccttatcccaccagtccacactcttctctcctctcctctcctttacttttttcttttcctttcctttcttttctttttttttttaggcagagtctcgctctgttgcccaggctggagtgttgtggggcaatatcatctcactgcaacctccacctcccaggttcaagtgattctcctgcctcagcctcctgagtagttgggactacaggcgcatgccaccacacctggctaatttttgtatttagtagagacggggtttcaccatgttggccaggctaatcttgaactcctgaccttgagtggtctgcccaccacagcctcccaaagtgctgggattacaagtgtgagccactgtgcccagcccacaccctttgtttccttctcttttttttgagacagggttttgctccatcacccaggctggtgtgcagtggtgcgatcatagctcactgcagcctctaccacccaggctcgaattattgttccatctcagcctcccaagtagctaggactacagatgtgagccaccacacacagctacaggagtcccgctttgttgtccaggctggtttagaactttggggctcaagtgatcctcccaactcagcctccccaaatgctgggattacaagtgtgagccaccatacccaagcaccctttttttggctcattcctaaatatattcaacactagttccagtaactcctactccgggaagcctttcctactcttcagtaaactcccctaggatgctacctccttgccttctggcctggaagttctcacctctgcaaattaagtattcaagtccccaatcattaagggtaagcaccactgaagttatagaggaaaggacacatagaaatgtgttctttgttgctgaagtatataaacacgattgatttttgtgtattgattttgtgtccaaccacattttaaaactattttagaggttctaagagtgtttaaatcctctagttttagagaatcatattttctacaaataataagagctttatttcttgctttccaatcttcatgtcttttattttcctttcatgtcttgctgcactggctatgaagctttcagcagcatgttgtcatattgagcacgtttgtcttattcctgatacgcaaggcaatatttaatttcaccattaggtatttcattatgttctcttcagtagatttcctttatgaggtcaagaagttcccttcaattctaatagacaaaatgtttttatcatgaatatatatagaatttgattaaatgtcttttctcaattttttatacgtacattttctcaaatttctttttatttatttattttttatttttttattatactttaagttttagggtacatgtgcacattgtgcaggttagttacatatgtatacatgtgacatgctggtgcgctgcacccactaactcgtcatctagcattaggtatatctcccaatgctatccctccccccaccccccaccccaccacagtccccagagtgtgatattccccttcctgtgtccatgtgatctcattgttcaattcccacctatgagtgagaatatgcggtgtttggtttttttgttcttgcgatagtttactgagaatgatgatttccaatttcatccatgtccctacaaaggacatgaactcatcattttttatggctgcatagtattccatggtgtatatgtgccacattttcttaatccagtctattattgttggacatttgcgttggttccaactctttgctattgtgaataatgccgcaataaacatacgtgtgcatgtgtctttatagcagcatgatttagactcccttgggtatatacccagtaatgggatggctgggtcaaatggtatttctagttctagatccctgaggaatcgccacgctgacttcaacaatggttgaactagtttacagtcccaccaacagtgtaaaagtgttcctatttctccacatcctctccaccacctgttgtttcctgactttttaatgattgccattctaactggtgtgagatagtatctcatagtggttttgatttgcatttctctgatagccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaactttctcccattttgtaggttgcctgttcactctgatggtagtttcttttgctgtgcagaagctctttagtttaattaaaccccatttgtcaattttgtcttttattgccattgcttttggtgttttagacatgaagtccttgcccatgcctatgtcctgaatggtattgcctaggttttcttctagggtttttatggttttaggtctaacatttaagtctttaatccatcttgaattgatttttgtataaggtgtaaggaagggatccagtttcatctttctccatatggctagccagttttcccagcaccatttattaattagggaatcctttccccattgcttgtttttctcaggtttgtcaaagatcagatagttgtagatatgcagcgttatttctgagggctctgttctgttccattgatctatctctctgttttggtaccagtaccatgctgttttggttactgtagccttgtagtatagtttgaagtcaggtagtgtgatgcctccagctttgttcttttggcttaggattgccttggcgatgagggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttcgttgagcagtggtttgtagttctccttgaagaggtccttcacatcccttgtaagttggattcctaggtatttcattctctttgaagcaattgtgaatgggagttcactcatgatttggctctctgtttgtctgttgttggtgtataagaatgcttgtgatttttgtacgttgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccatttagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatgcatctggccctggactctttttggttggtaaactattgattattgccacaatttcagctcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattaattttttgaagggtttttttggtctctatttccttcagttctgctctgattttagttatttcttgccttctgctagctcttgaatgtgtttgcgcttgcttttctagttcttttaattgtgatgttagggtgtcaattttggatctttcctgctttctcttggcggcatttagtgctataaatttccctctacacactgctttgaatgtgtcccagagattctggtatgttgtgtctttgttctcgttggtttcaaagaacatctttatttctgccttcatttcgttatgtatccagtagtcattcaggagcaggttgttcagtttccatgtagctgagcagttttgagtgagattcttaattctgagttctagtttgattgcactgtggtctgagagatagtttgttataatctctgttcttttacatttgctgaggagagctttacttccaagtatgtggtcaattttggaataggtgtgctgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctactgtattgggtgcatatatatttagaatagttagctcttcttgttgaattgatccctttaccattatgtaatggccttctttgtctcttttgatctttgttggtttaaagtctgttttatcagagactaggattgcaacccctgcctttttctgttttccatttgcttggtagatcttcctccatccttttattttgtgcctatgtgtgtctctgcacatgagttgggtttcctgaatacagcacactgatgggtcttgactctttatccaatttgccagtctgtgtcttttaattggagcatttagtccatttacatttaaagttaatatggttatgtgtgaatttgatcctgtcattatgatgttagctggtgattttgctcgttagttgatgcagtttcttcctagtctcgatggtctttacattttggcatgattttgcagcggctggtcccggttgttcctttccatgtttagcgcttccttcaggagctcttttagggcaggcctggtggtgacaaaatctctcagcattttcttgtctgtaaaggattttatttctccttcacttatgaagcttagtttggctggatatgaaattctgggttgaaaattcttttctttaagaatgttgaatattggtccccactctcttctggcttgtagggtttctgccgagagatcagctgttagtctgatgggcttccctttgagggtaacccgacctttctctttggctgcccttaacattttttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcacgtagttcttgagccttggttttcagctccatcagctcctttaagcacttctctgtattggttattctagttatacattcttctaaatttttttcaaagttttaaacttctttgcctttggtttgaatgtcctcccgtagctcagagtaatttgattgtctgaagccttcttctctcagctcatcaaagtcattctccgtctagctttgttccgttgctggtgaggaactgcattcctttggaggaggagaagcgctctgctttttagagtttcccgtttttctgttctgttttttccccatctttgtggttttatctacttttggtctttgatgatggtgatgtacagatgggtttttcgtgtggatgtcctttctatttgttagttttccttctaacggacaggaccctcagctgcaggtctgttggaataccctgccgtgtgaggtgtcagtgtgcccctgctggggggtgcctcccagttaggctgctcgggggtcaggggtcagggacccacttgaggaggctgtctgctgttctcagatctccagctgcgtgctgggagaaccactgctctcttcagagctgtcagacagggacatttaagtttgcagagtttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcaggcgcccctcccggagcctcgctgccgccttgcagtttgatctcagactgctatgctagcaatcagcgagactccttgggggtaggaccctctgagccaggtgcgggatataatctcgtggtgtgccgttttttaagccggtccgaaaagcgcagtattcgggtgggagtgacccgattttccaggtgagtccgtcacccctttctttgacttggaaagggaactccctgaccccttgcacttcccaagtgaggcaatgcctcgccctgctttggctcgcgcacggtgcgcgcacccactgacctgcgcccactgtctgacactccctagtgagatgaacccagtacctcagatggaaatgcagaaatcatccgtcttctgcttcgctcacgctgggagctgtagaccggagctgttcctgttcagccatcttggctcttccctcaaatttctatatttttagaagtttgtgagtttttgaaataatttagtttgttcctatgcatatagttttccagtctttttgaatatgctggattatggaagccagtaaggttcaaattgatatgttttgtgtacactgtggtttcagtatgtgtgtatgtttgtatgtgtgaagagtaagaggggggctttgatgtcggagaagtaagacaagctaaggtggagcccaaacgcaaacagtgatcaatgacttggctggtatttcatctttagtctagggtctctgattgaacaaatacattttgggatttatttattatttatttatttatttatttatttttgagttggagtttcactctgtcccccaggctggagcgcagtggcacgatctccgctcactgcaacctccgccacccgggttgacgccgttctcctgccttagcctccgagtagctgggactacaggcatccgccacctcgcccggcaaaatttttttttgtatatttagtagagacggagtttcaccatgttagccaggatggtctccatctcttgacttcgtgatccgcccacctcggcctcgcaaagtcctgggattacaggcctgagccactgagcccggccgagattttatatttttttaattgttcattcaataggaacctgtttacaaataaataatgtgcctttggcatttgtgtctcacgtttcatttgtgatgctgttgatgatggtgataatgatgatgattttgatggttaatattgatatcgagtgttaacttgattggatggaaggatgcaaagtattgttcctgggtgtgtctgtgagggtgttgccaagggagtttaacatttgaattagtgggtttggagaggcagatccatcctcagtctgagtgggcaccatctaatcaactgccagtgcggcttgaataaagcagtcaggagaaggtggaagagcaggcttgctgcgtcttccggcctccatctttctccatgctggatgcttcctaccttgaacatcagacggcaagttcttcagcttttggactcttgaacttacagcagtgatttgccaggagctctcgggcctttggccacagaccgaaggctgcatcgtcggcttccctacttttgaggttttgggactcggactggcttcctggctcctcagcttgcagacagcttattgtgggacttcactttgtgattgtgtgagccaattctcctaataaactccccttcatatatacatatatcctattagttgtgtccctttagtgaactctaatataaggatgatgatatggaaacataaatacacaaatataggccagaagtagagcaaatttctaatagtaaataacaatgaaaagtcagagacagataattaaaaaagcagtaactacaaaggaaatgaaatcagtgtgtcgaagagatatccagcttttatgttcattgcagcactgttcaaaatagctaagataaggattcaacgtctatgtctatcaacagatgaatggataaagaaaatgtggtacatacacacaatggaatactactcaaccttaaaaaaaaaaaaacaaaaacaaatcctgacattaacagcaacatggatgaacctggaggacattctgttaaataaaataagccaatcacagaaagactaataaacatgatctcacttatatgtaaaatctaaaaaatgctaaactcatagaagcagaaagaagaatgacggttaccagggatgggaggagggggaaggattggcaagatgttggtcaaaggatgcaaaattgcatttagacagcaagaataaatctaagatacctattttataatatgatgactatagttcataacaatgtattgtatacttgcgaattgctaagacggtagatcttaagtgttctctccacaaataaatcataaatatgtgaggtaatgcatatgttaattagcacaatttagccattcaaaaatgtatacatgtttcaaagcatcatgttgttcaccgttaatataaacaattgttatttaattttaaaaaattgataaataataaagcaataaccaagactctattaagctaattgggtttgtactctgtaaatacagaaatatgggaaaggcaagggattttagggggtccaaagtgaatactgagaaaccaaaaagaggataaggtgggcagatccattacttacagcttaaatatgttaatgggcagcaatatgctgattttacatgtatgtgagtgaactcttattagatatcccatatttgggccctgaacttaaaagaactagtcagtctggcaaaaacaatgaaaagtaattttgggccagaatttatcatcacaaaggaagaaacctatatcatttctggtctaatgtggatgatgccatcttccagcccttagttttagataaaaacaaaacatgagggatggccagcagatagatgatagcaggagacgttggttccatgggttagttccaagcttccatggggaagcttgtgtcagtattctgactgtgcttccattcatgtaacagaagagagaggtcaggttacaattgagttcttcttgtgataaagactatgaaaagagtgctaaagaaggaggcttttacccaatccagtgacacagaattttattgcttgacacagtttgctgagcagccatgaggcaattcacagcctactacttctggaaaataatgaaccatgtgtggtgtgatatcaaataaatggagttgggattgagagaatgcttatgatcagccaattggaaagatgcgcaaagttcagttctaggtgccaagtgattcaggagtaataaattactccctaaacaaattttaaagatgctaaaggtgaaggtttctttttttgttttgtttttcatttatggcaatatcatagtgtttcctgataaagatcagattaagtggaaaagccagttttaaacagaatagagaagaaagtcattgagaaattagtctatgaagactgacattctcctgaggatattcactttgcaatttcacttttaccatttaccctgttaaggctaagatttaatttaaagaattttgtttagagataaaataaaacttcaaaaaaaaaaactacagaagtaaaattatcttcaaagacacccttctgagttgattagatactaaaaatgtttatttaagcatttaatgaacatgtaactaatgtaggaaccttataaaaatcatcaaaacttgttttggagttataagtttttgtaagtgctagttccttatggcattcttcctaagcagttgggtgagagtataataacatagggttactttcatatgtacatagggttacactctcacccaactacttgagaagaatgctacaagggggatgggagcagtagaccacagggaatctgatttatttgtctctgtaagtacaaagttatactattttactgcagtaaaggtgtaatctgagtaaaaatgtaaagaccttaagtttcatcagtaagtaagaagttccagtaatgtaagattttgcaatgggtcactttgtactgtgtgcattttttaaactatattcaaagatcctgaagcttcactgtccatgaccaattttgctcttataatatttataaataaatatccagaggtgggataaatgcatgatatgatagttccatttttaattttttgtgaaaataccctactgttttccatagcagctttatcattttgagttgtgatatggtttggttgtgtccccacccgaatctcatattgaatgcccatatgttgtaggaggaacatagtgggaggtaactgaatcatgggagcagctctttcctgtgctggtcttgtgatagtgaataagtctcataagatctgatggttttataaagaggagttcccctgcacaagctctttctttgcctgctgctatccatgtaagatatgacttgctcctcctagccttctgccatgattgtgaggcctctccagccatgtggaattgtaagtccactaagcctctttcttttgtaaagtgctcagtcttgggtgtgtctttatcagcagcatgaaagccaactaatacaagttgaaatcaggatcttcaggtgatatttgcattttcaagtttattatgaaactcaatagccaacatgtggaaacaaactaaatagacaacatgtggaaacaaactaaatatccactgatagataaatggataaaagtaatgtggtatatatacatacaatggaatactattcagccttaaaagaggagattctgcaatatggtacaacatgaatggatcttgaggacactatgctaagtgaaataagccaggcagatggacaagtaatgcatgagtctacttatataaggtatctaaaataatcaaatttaaagaatctgaaagtgaaatgatggatgccaaggactagtggcaaggagaaattaagagttactaaccaatgggcataaagtttcagttgagcaagatgaaccagctctagacatctgctgtacagtactgtacctatagtgaaggataatgtattgtacacctaaaaatctattgaaagatatctcatgttaagagttcttatcacaataaaatgatttttaaaaaatttatgggatatttaaaagcatacacatctcatactgaaaaaagcaaatgtcaacattattaaccaagggctacaaattttcaacacataaattcacagctaaacttttaatggaatttaatggcaaattatgactcaaaataaagttgtttactttctaaaaaggcttatcattatttcagctaatgtgtatattaagctcagcgctgtaggtcaggtcgtgttcaaagaattgatcattttaccaaatgctctataattctccagcccagagtgaaagtgcattgctgacctctctatgagaaaatgtttccctgctaaaaagccaggaatcaggttatatcctgtggcacaaggccctgagttttctgtttataatgtgagccctcaaataaagagtaaaaatgggtcttttttttttttttttttttttgagacagagtctcactctgtcacccaggctggagagcagtggtgcaatcccagctgactgcaacctctgcctcctgggttcaagcaattctccacctcagcctcccaattagctgggattacaggtgcccaccaccacgcatggctaatttttgtatttttaggagagacggggtttcaccatgttggccaggctcgtctcaaattcctgacctcaagtgatctgcctgcctcagcctcccaaagtgctggaattacaggtgtgagtcaccacacccagccaggatgggtcctttaaaacatatgaaggagccatcaggggagaggtatgacagggtcatctctaagtggtaaagagagtaatgggaagaggagaaataataaatttcaatgaactgtgactaaacctattttaaaagtcttagaaggactggaagttaacgaaataaccaccctctccaagaaatactaattggactttaaaatgatactttgggttatctattaattcaataaacattattaagaactcagtatgtacataacactacactggatacattgcggacggatggaccaaaaagagaggacattgtccttattctcaaaatgcttatgaaatgtgccatcataataaggaaaacgaaataaataaacaaacaaataaaggaataagttgctgaagtgtgctgtggtcaactgtgagatgctcttcaatattcattcttccttccatctatgatgaaatcttagctggtctttggtcactcaggtaggaccctatcttcctgtgttgtttgcagttgggtataaacatgagaccgatttctggctaattccatgtgagtgcaagtgatacctgccacttccaactttgctttttaaagtattgagcactcactgccttaggaccttttttttttggcccgctgctgcaagaagaagagaaagaaaagagctgcctaggtcccagaggtggaggccgcttattgaaaatgcaaaactatcttcatcaagaccacctacttctgaacctttacttgagagaaatgaacttctattgcatttcagccactggtttttgtctgtctgattttctgacatatttgttgcagaatcttaccctaaactttaattagctgccaagcaatcagagagatgcatttaattagagaagactccttgagttgattttgagggagatagggatgaattgcccaaagttgggtatggttgtacaatggcacaataatcaggatacaccatggtaggcggggataagggagttgattaaagcaaaacagaggcacgaagaaattggcagtgaataacatgcttagatgattgtagaagcacaattattcaccattgtaaaggattccaaggtcatgtggtctatttcccttacctacacattaatattgtttaccaaatttggagtaagtaatcatgcaacagctccttgaacagaaaagtcattgtatcacaaaggtgcacattagctttttatatagctctaaacattaagcaatatttttagatgaatctgaaatccacctatccatagtttccagtgtgattcatgatttcatgaatcactttattcatgaaagtgacagaaaactaagtttaagcctcttattatgtgatatccctttaatttaaattctagtcatgtcttcttttaacctttttattttccaataaagttcctcaaggtttttcacttgtccctcatctcccatgacttccagacccatcgctgtctggaccactctgtaacggatcctctttggtctgttgacattctttaggtgccagaattgaacatgctaccctaggtatgctctgataaggacagagaagaaaaatggcattaattgtccttgttctgagcagtgtacatcttgtaattgatcaaattagtctatttttcctgaaagtactgctactcttacatgtaaaatgtaaaaagtgcatttactcttaacatcttgtatgatggtatgggcatgggaggatccagaagcaaagaatgagaaaaaaaaaaagatttttgtaataatataatgcatgaagtgaataggaagtgggagacacaaaaaaactgtttaggaaaaaaaactagcaggcacagtaatgaattagatgtgaatagtgaaaaaaaatcaacatcttcactgaaataattatgagtttaaaacaggagattaaggaagaagtgttggaaaggtagtattaaaaaggggtggaaattcttgcagttctgttgaaatattcacagctagtttctgctttacttgatggggaaaggagagaaataaactactttggaaatagatcgtgttcagatgcaaaatggaacaggaagaggaatgcctgttcttatgtactgttcagaaccatgatggaagaagaacagatggtttagtggttaagataagcacttaaagtgaggctgttcttattctaagcttattccaaacacccaagtttcttgacattggaaatatcacaatcgggaagctttcaaatgaatttctggcacattctgaggcagttgtattctccaaaggctgttttaattaagactcgggagattaattctcactgctggtggctgttctggtacgagcccccaccttcaccaaacaggtaaattcatgcaggtaattgagccaaaacactttaatatcaagtctcaaggatttatggcgttttcatcaccaagcctgtagagctcaaggaatcatgcttgaaaacgcaaaagctaaccatccacaaactaaagaaactgaagacacattcacgttatagaagagtgactggcaacataaaataacatatatctggactcaaattctagcttttctaacaatggctaactttgaacaagttatttaattatctgagatccagtttcatggtttgtttacaaatgcacgcattcttgcattcatttcttccaaattaaccaagtgcctcctatgttctgcacagatattaaaacatagtctctgcctcgaggcattctacaggcttgtgagaagaagtacattggattgcagttttctcttcacttattgtaaagtgttcccatgtgccaattactgtgctaaacattttgcacagtatttgcttatttatttcacacaaaggttctatggagatattagtgtcttcaactatgaatgagaaactgagaatttgaaaaattaagtaatttgcccaggttaatgtttaaaatcaggtagttttgatcctgacacttttgttccccatctctgtagcacactgcttatatatgcataactgctgaggtaggaggtgtagaggggaccatgagaacccttgaggggctcctacctcaggccataacccagggagtcctttgtaaaatttgaggaaggcttttattcccactgtggttcaggtgaaaagaaccacatttttaaacttggtataaagcatgtctagtcttaaactttttcagcatgtgaagttgctactgagcagtctgttgataccgaaaaaaatgggcgctgtggatccgtggtcttggtactcaggaatgaaagacaattccgaagagttcgggtgggagaattaaagagaaggagtgggagttgtccttccatgctgtaattttccaagaagagtaaggcccattagatatttggaaagtcagacttacctactagatttaggagaaagaagatgcaaactaatgatgtaatcaatctcagaaggaaataaaatggatcaattatcaacattctacctatgtatactacctgtgatttgcaataaattgtgacaggctttatctgatgaattctgttttagaaagtacagcaacactgggtttttttcctggttatttgtcaccagactatattcacaaatttgctgtgtaacttaaaccactcctcgccaccactgaatttccattttcccctcccacaacctgtcaacagttttaatatagatttgtcaaattcacttcccagtgtacaacattgatgacttctttgtgcccagcaataatgtacggagttcactgataaccttacattaccaggtgtttctctactaaatggactacctctcccttttacttttttgagctgacagtgtcactgtattgcccaggatggagttcagtggctattcacaggcatgatcacagcacactgaagcctcaaattcctgggctgaagtgaacctcctgatccttccacctcagtctcccaagtagctaggactgaagttgcataccaccgtgctgggctgctttcatttttaatgccatgaaatcagtccttagcttttcaacttactctgagtgggttcaaattttctattggtaacaatgtatgcctctgcttttgaacccaagtacaaaagaaccatatactttttctacttcattgtggtaagaacacttaacatgagatccattctcttaacaaattttaagtgtacattattgcttactataagtaccatatcatatagtacaatacagatctctaaagcttattaatcttgcttaactgacactttatgcacattgattagtaattccccattttcccctgcttctgatccctagcaacaaccaccctttgattctgtgaatttgattattttagatacctcaaataaatgaatcatgtagtatttgtctctctgtgactgccttatttcacttagcataatatcatcaaggcccatctatgttgtaccatattgtggaatctcctttttaaaggctgaatagtattccattgtatgtgtatatgccaaactgtctttatctgtttatctgttaatggacatttagtttgtttctacagcttgggtattgtgaatagtgctgcaatgaacatcggagtgctaactagtatctctttgagatcttgattttacttattttggatacatacctataattcaatttctggatcatatggtagttccatttttaattttttgaattacctccgtactggttttcatagtggctacaccattttgcattcccaccaacaccttaccaagaatccagacaacaaaaacaaaagtaaggaagtgggactacatcaaactaaaaaccttctgcacagcaaaggaaataatcaatgacgtgaaaaggcgacctatggattggaagaaaatatttgtaaaccatatacctgataaggggataatatccaaaatatataagaaactaatacaaataactcaaaaaaataaactaatattacaaataagctaggtatctgaagagacatttctccaaataggacataaaaatgacatatatataatctttaattaccagagaaatgcaaatcaaaatcacaatgagccggggacagttgctcacatctataatcccagcactttgagaggccaaaatgggtggatcacctgaggtcaggagtttgagaccagcctggggaaaatggtgaagtcctgtctctactaaaaatacaaaaattagccagtgtggtggcacatgccagtagtcccagctattcggagctacttgtgaggctgagccaggagatcacttgaacccaggaggcagaggttacagtgagctgagactgtgccactgcactcctgcctgggtgacagagtgagactccatctcaaaacacacacacacacacacacacacacacaatgagatatcacctcacacctctcaaaataactattataaaaaaacagaagataagggttggtgaggatgtggagaaactataactacattattttaataaagtatcttgccattttgccttgtcatttgcatatgacacacacacacacacacacacacacacacacacacacacacacaaaagatacttctaaaaggaacaaagtaccaaaggaagagtggcacttggctggggcagctgaagttagaaaagaaaccataagtggaaaaatgtttaatagaggataatttaacagtcattggaaaagtgactattgggacttagggacattttgagttgccaagcattggagatggcacatagtttgcaatatcaatttcttattcctttcaggtgtcaggatttgttgtatgatggagcaatcattacggattctcgagcatcatacatttaagagttttaggatcaaactggaatggaagaatgagataagggatttgggggccacttatctactactgtaatcaagcacggtggataggagaacaatgttgacatggccagaataagcagccattctgtagtcaaaagaacattaagtcagattcaggaagcatggttccagtcttggttctgagactaagaaaaggggaagcggctgggcgcagtggctcacgcctgtaatcccagcactttgggaggccggggcaggcggatcacgaggtcaggagatcgagaccatcctggctaacacggtgaaaccccatctctactaaaaatacaaaaattagcccggcgtggtggcgggcgcctgtagtcccagctacttgcgagggtgaggctggagaatggcgtgaagccgggaggtgcagcttgcagtgagccaagtgtgccactgcactccagcctgtgtgacagagcgagactctgtctcaaaaaaaaaaaaaaaaaaaaggaaaggggcagcaatatatataaccgaaacatttatttaaaatatacaaactacttgtttacatatactgcttcattttatcttaaaatttgcctagagaaaaatgcaattaaccccattttgtatacaagaaaattgagactctgcaagttaactcttgcccaagttaacacacatgatgaactaatggaggcaagtggtgaaccaagaacctcaggattccaagctatagccttgtccactctcccatcccagctctgaactagctacgctctgaactagctagggaagtcattcagccattccacttgtatgagcctccactcatttgtctgtaaagtgagatagattgtctagatcagtgatttccaaagacatgtgtttgtgtacatgcctgtgtgtgtccttctagacagaaaaatctagaaaagtctctctgtttgtgtgagaaaggcagaaccttcatgaacacagattcttacacataccattgatatatgcaatatattctggcagagctgttctgattaacgcaccagtgaagatcctggtgtctcactacttccatcctcactctcgccctggagagatgcgaaggaacacttacaattaactttacagagaacagattgaaaacctctatgtgcaacattctgcgtgatcctaaaaagaagtgtgtgtgtgtgtgtgtgtgtgtgtgtgtgtgtaggtgaggggtggcaaacacactgtcctgatctttttctgtttattcttctcaaaagactttttggccacatggggatttattcaaaggacaattatgaagcatctcttatgagctggttctgagaagccattcccactccattggactcacctccattctccatcacttgatattggtggctgcttctctttctaggagtaagatccctaaagatgggtttatacaagcctactgatccgggttctaatcctcctccaacactaacaaattgagatcttgagaaccatgttaactctctgggcgtggttcttcatgtgtaaaaggagggggattcctaagacttctggctcacatatcctatgatgttatccctattttatgacttcaaaaaaaaaaaaaaccaaatcaattagatactttttttttaatgcccacagtgctgcatcctatgggttgacagttgcttgccatggatgaagctgctttttaataactacttacttggtgctcattttaaacttttaaaaaatgtccccttcagggcatgaacacatttttatatctaccgatttaaatgtgaggtaggaaaaaggcttaaactcataattttccatcctacttttgttcgttggactttcagtctgggtgtgaagtccgtaaaataagagctatgtttgagagttttgttctgtgaacagaaagtataggctggggcatgggaaaggaagagaggaaaagtcaacatgtaccattttatagaagccaggagtgggctctctgaaggaaatcaacatcttctttgagtctgctgctcttttttgctcacctttcatcctctccttttttttttttttttttttttttttttttttttttgagatggagtctctgttcgcccaggctggagtccagtggcgcgatctcggctcactgcaagctctgcctcccgggttcacaccattctcctgcctcagcctcccgagtagctgggactacaggcgcccgccaccatgcccggctaatttttttttgtatttttagtagagatggggtttcaccgtgttagccaggatggtctcgatctcctgacctcgtgatccgcctgcctcggcctcccaaagtgctgggattacaggcgtgagccaccgcgcccggcctcaaaatacataaactgcacaaagggtgtaaagtattctctagtgtaatagacacaatgccaagaaagcaaattaaggaagttttagcccagatgcatttttaagcgtttgcttaacagataaaaaatacttaagaggttgaaactaaagaatacagatataatttggtgacatggtaacagtatatgacactttgaataagtaatagaaattccaaaatcagaatgacatttctagaaatactagctaagaaaagacaaaagtaattgtatttagttccttatcaaatatttattgagcacttacactataccaggaactgttttaaccagtcaaaaattaattgcaaatgtagctataataatcaaaaattagaactattctaaatgtccaaaattgggagataaatttaatgtggcttatcaattcattaaaataatatgaagccacttagatttaaaatatgtaagaataagaaaactactgaaaatattgagactatcattttaagtagaaaaacagaccgtaaaacaatttgcatgctagtatctcaacagtattcacatagagatttgaaagaaatataaaaatgtgaaacttacagtttttattaaagtggtgatactgtaggtcattcttctgaggatggtatttaatgttgacactatagtacatttgtttaatgataaaaagtgccaagttccctaatgacaggtttgaaagtgacagcatttaactatatgagagtcttcttaaggttcatggtgattccagtcccacaatgctgctgcctgaggtctgaccctttatgcatacaaactatatagagaagattgtataaccctttggaaattgctgatactttcacagctctaattcttcctccaggggaatattttaaagtggcttctttgctgatttaataaattttcatttcaaacttttcccctcagtctctttctaatgaactttcttaaaaaaaaaaactttcctgaaattccatgctgtagtactacctgtgggtctgattccacatgtgagtatgtcaaatttaattagattgtgctctctgctgcttaatgactcaactaggcttacaagttcaagatcataacctccctactaggctgccaggttagctgtttcaaggaacaactattcatgttatccagctataattattttactccatgcccagaaaataataaaaatagtaatgctcacttaattagacccttcacccaagaatcctcaagcattttacaagatttctttactcagtcatttgcataacacatccaagaaacaggtgaacaatattaaaaatcatgcttctaaggacttctttttaaaaaatgcatagactcatccttggttgctgcctttccttttagaataactgttcaactcactggcagattgcaatggaatctgatagaaggatacagaactcagaactaggtaatgcaactcagattggaacagggatatatttttctgggtctaaaaatgtttcctttttttctgcatatcttcacaacgtgttcacgttctagttcataatttatcgttttggtctataaagtgcctataaacatgtaactatgaaataacacatgacaaaaatttagacacctgagagaaaggcttgtcaagcttataccagtcaaaaggtacaatggaataggcaatcttaaatccctgcatggaagccgtagttcttgagcttattcagcttgaagcaacacttgtgaggtcatgttactctgtgatagtgctaccagccctcgaatgatcttccaaatgactctctattttggtcaccactatatgaccagcacctagaacagtaagccttgcctatagcaagtacttagttttaatacatatttttaaaataatgaatctacatattttgatttattgatcagagacagattttctcagattataactgattttgtctcataaaataaggaatttgacaagaatgtcagcaaaccagctgtaaagcagatatgaagggacatttgagggaaatttgaatatggacaatgtgtagattcactagtggcccccacaaaagatatgtgcaagtactaactcccagtacccataaaagtgactttatttggatgtaagttctttgcagaggtagttaagaatcttgagacgagatcatcttggttttagggtggttcctaaatttaatgactggtatttttataagagaagacacaaagagacatagcagaggacattttaaaccgaggttgagattggaggtatactgccgcaagccaagggattctgggagctaccagaagtcgcaagaggaaaaggaaggattatcctctagagccgtcagagggagcacatcattgccacaccttgactgtggacttcagcctcccaaactattgttttaaaccacccagtatgtggtaatttgttatagcagcaccaggaaactaatacaacccttctagtaaacgttattacaaataacaaaattattgctatttgtgttagatgtgacatggtattgaggctatgtagaaaaatatactttgttgacattcaaaatttgactcctttgggttaaatataatgtctttaattgactaaaatgcatcatcaaatatcgattacatggcaaaataatagcagttgttaagcctaggaattgaatatttgggtatttagtatattattgttttttttttttctgtgcaattaaaagtatttaaatcgtgagcaaaaagtgttcccctaagcactcttatattatgatgtttggttctttaactaaaataacaatcagttttgcaaataaataaacaatcttacaaatcatcttccaacatctaaaagaaaagctttaaacctcatagttttcacctctacaccttgtattggctctttttgcaacttatgttctgtgcatctttctgtctgcttttcaaaatcaaattgaaagcttttcatggtacctcctcaaatcttccttttcctcaggttaaaattagtgatgtaactaatgaacaatcaataagtttctcccaaattctatttctaattctcccctgctgaaacttggtaagctgctatacaaaacggtaaccatgatttccttaccccccaaccctcaaaacacctcttctcctgacctttaggtcctgggctgtgccattctcatgctttatagtcaagttctttcctcagataatagtctcctcagcttctgaaaatagctgattatctattccagggagagcaagatcaaagtttgataaattgccatttatttcacttctactagaaagtgatcccaacaaataaaattttctttctgacaccccttggttccttctcatctcattgctgatctttgctagagggataaagccatctgtttgctctgttttatcaccagaagctgttctctgtcagcgacaccatcctctggcttacagacttaactgttgatcactgaaatagcactcaaggccccaggaatatggacaatccacttctctggaatcagtgtcatttaacattggttgttcatctttttaaggcccacattcttgcagaattacatattaggtagttgaaccccttcaagggttattgttctctctttgttgtatgtgtaatggacatgtcacagataggcttcactttgtgtgtgtcgtgtagacacgtcacagttaggcttcataaagtgcatggctgcatatgataacaggaagtctacctcttccaacctgtcctgcagtggatcgtgaggaactgggctccgtgagttttctctcacccaagctcctcacacgccaccactgagttgccttttgtagcccttccttctccctccactttgtaacaaggtgaaagctgggaattttttttcagaaatacataaccaacattttattctgattttgtctgtccctgacatccaaggaattgaaggtgtttttttttcctgaaagtggcctttggttttgccactgtgcttcaggttcctctaaaatcaagtcccctttatagtgatgcatctatattatcacatagtcacttttttaggattcataaaatgactctgctaccattactaacattttcaaggaaaatctacccatatgcttgtaaactacacctacatagcttcccttgtactgtactacactcaagtagagcctactcatctttctagtctcaatttagtcactctttcaaattgtcttatctgaccatttaatctcagaaatatctcccagctaaagtcccatcatagcactaattataatatatatttatatagtatttgtgggttaagttttacttccttctcttggcttccagccattttccatatccactttcttcattactataaacttagcacaataccaaatacgaatcagacagtaaactaatatttgttaaatcaatgagtatagcttacatccaaagtccagctttaatctgcttaactgatgttgaacatatgtttttcagtcaacctattttttctctcagaataaaatgtctccttttcttacccttctccatttttttttatctctcctcttatttttcctattatcatcttgctccgtagttccttttttttccctcccctgccaatgtatggatgactttttgggtgactgctcacatatggaagagatattcctatttggagtttattaaataataaacagaagaatggaaataattgattcacattttaaatggtcataacttttaactacatgattttgcctagtgacacaataactgattttaaacatagaaattcagtcagactgatattggtctaaaggagactgaagataaaacattctacacttgtctaattaatattaaccatatacagggccgtaactatttaaatgcattgctatatgcttgtaaatagtgaccacagtctgagtattactttttaaaggtagcctaagcctggcccgaaacagaagatgtgaaattattagtagactttgccttctaatgggagagaggaaggacatcattcctgttgatttctttaaacctttaaaaattgtccttatgtggtccacaatttttctaatattcatcaaaactcttcttgtagagattgcaatgtattagaaaagatactcttcataaagttttctacaatagtacttattgataaatcaatattgctaagactaaacatatattaattgttcttaaaggatatgccaaagtagaaataacatccctaaatttagaatgtacaatgttatcattactatcactagaataatcacaactcagcctctgaaatctgacagacttaggtttgagttcaggtttcacccctactaatgcccaatcatgtcaaccttagacaaaatcactaaattctctggatatcaatttcctcatatgtaaaatgagggtatacgtaacatagtgtatacctgatatgatgattaaatgaacctagaaattgattagtccaatatagtggtaaatatatggagtaagtacacaataaatgacagctgtaactattactatgattcttaccagtattgctgtgttgttattgtggtagaagcggagatcactttgttattaaatgtaaaaacaatttagcaaaataagagaggccaattctaagtgttatcatttggaaaaatgtcaagtaaatcaaatgtgggtactataagaaaactagcccgggctctcaaagggagattagcattaatcccctctgtactcattgagaaacctggaggcattagggaaagcaggtggtatattcaatatctcatccagtatttcctacaggctctttcaaatgataacttcaggaaccacttggaaaatatcagttctatcacatttctctagggatcagtgaactcatttggattaaacaagtagtaaaaacacttgacaagttcaaatccaaataaatgtcacatttctcaaaaattggaacaaagtcagcaattaattttctttattttttgaagtatggtttgtaagctttttcatgggaattttacaaaagaaaagacaacataacttatcttgaaagtgtttcttttgggagaagtatagtgttattctatgaaattcagatattcagagaaaaacaaacaaaaatacttgcctctcctttctcttacatcctttgaacatgatttatttacttaagaaaaaagaggaaatctagaagtcataatatattctcagagtctaagtaaaatctaaaccatgaagctaaaattgtttggaaatccctgctttttaaaaatgttgataggctagagatgaatttgctagtggatatcattaagttgaattcttgaagatgaatagatacaggcaattgccaacatacaaagcacacattccaaaatttcatttttaattcagtcgttcggaactggaaacacagttttcccacaggaacacttataatttgtgtttaagttcacagataagaccacaaatgctacttttacatgaaatcactatgaaataacttagatttacagaagaaaatcaattaatatacactttcaaaaataaaaatagaactctaaaataaaatttaaaagtaccatttgtatttgtatttcacatatttaaaaaagatgacaaaactcaaagaagatcagagatatggtatctttggtagagtttccaaagatttaagggtattttcaaggtcttcaggagtcattaggccagattttctttttccctaaataatttcagattgtacagggggcacagttatcttttcaggagcatagcagttattgactaaaaaatgtaatggaaagaaagagagggtaactgaattataaggagatggggtggtgggtggaagattatacatttggcatttacaaatatttgggaacaaagaagaatgactgaaaaatgattactgtgctgtaagcagagaaagaggcacagaaaaatcctttggcagaagaataagaaagtgttgaggcagaaacaggggtccacttgttttatgagctgtctctaaagtggcaggaatatttcctcatgacattttgattgccaaagaatacacacaagttgcaagaacacagatacttgggctgtagaatgcacttattgagtctttcacacttgtgggtagaatactttttttttttgtctttgatagattagtacagaaattttctgatctcagaaatactcaacgttgggcagtccttcctagttagggcttcagtattgagttttagctttttagcacatgagattgcttctaaattagtacagcaaaaagtgaatggatggtaaaaagaaggatgtttgacattatacttatacctatcatactgctatgctattgtagctgttttcatatatttcaaaattcgatttcttggttcccatatgacagtagactcagcaagaagtccagagagactctctgtgaataacctttttcctgtaatgcaatagtgctgtctctagtccataggctatgtcaccttcaattaaacagtggctcaatcagtgtgaagacagctttcataatgttaccatagaaaggtctctcctttgtgactaagccttttccagttgttgaaatgttcaccaattgctgcctcagctccttggaacccactcggcttttgtgcgctgatgcatttacagtactagtaattaatgccgttagctttgtaattaaaaaaaaactttttgcctttatactcagggtgataatgctgcaagtaaaaattaattaaaatgagatgaattgccttcagttaaacgaaatggaaagagaaaaggaggggtaaaggaaggaggaacctgaggaagagtttgtagtcttattaatgaagcaaactgaggaggttgggctttaaattttctcctgactctttttcctttgtgttagaccctggattaatggagccaaaaaccttcagctggtgagagaacacaaagaagctatactttctctgatttgtctatgggtcactataaagaccacaaacatgaacgcccatgtttgtttaagcacccccttcaattttctagtaccaggctgcttgaagtaatgggctgcgaaattggcttttgtactattattaattagatctgatgcctgattttcttttaacatttgatgcagtgaaaggttctggttctttacataggacacagttctcacatattcaatcattgatgataagagcttgggtgtgaaaatctgactgttctccatgctgaagcaaaggcccagtgagagccaggttcttcatcttctgttgtcctgatttttccgaattttgcttccaatttctatttgagggacacaacttcttttaaattagcacaatggctagggatctaaattttataaaggagcagcaattagttaatcaataaacatgtgcttaatgggatcctagtgtatatcttaggactatgtcaaggtgcttcagtgggcacggtaacagtgaaaaacgtaacccttgtcttcaaagaattgatacactcaccagaaaaacaaaagctaagctgcataaatcacagagaagtgggcaattaagggctaaaggctctggcacttggagtaaaataagagttctgttaaagagaggggacactgtgggctgaggaaatgagtaatgacttcacggagagaatgaacccaagtaagaaaaaaggacacagttaaggagaaaagaatttcctcggcagctcagaacttagaacctttatatatctcagtcacccatcaatgggggaaaatactgtcagcaggtaaataattgtgaaattttctagctctctttattgcactttaacaatatctggtagatctcttaacttctgtttggtgttccacagattgtcacaccttgaaaattccaccttcttaagtcttgtatccctgatatgcctctgttgtattttcaaccagaaacgtatttctacaacttataaatgggaataattacatgcaccatctttcaaagtcagggctctagtcttggtgcatgaaataagcaaatttggagaaatacacattaaatcaatagctctctgcatgggttttaatggtagtacaagaagagaggctggagagcctccaaacaatctttgggagtactaaaatgagtcctccaaattctacagccatcctatgtttagggccatttcactagcatcaccaggtaacagctttccaggaaaacgatagtaagtgtgatcgtatgacttacttctccttctgttctcaatcccacggattataaaattagatttccttagatttaaagatttaaagttgatattctcttagtaaaaccatctgtatttgtacaagagaaatttgtaaaagtcccatcaacctaagatgtttagagaaaaatgttcacttggtccattcagtatcgagatagaaagcctgctgactgttcagccctgtagaacctacctggttgctttataaaggttttggcttggctgtgtagcatttgcaatttccaagtgtggaaaatcaatcctacctccagctagttcagcctgagaaagagacaatttaaggagcattttctttttcttttaattttcttttctttctttctttctttttttttttttttttccagcaggtagatttgctgccagaggcaaggaaggtcctagtctcagatgagcataggtcttaaacacagaggaagtagaactattaggttaaatgaacctagctgggttttgatggatgtcagatggggttctgagcagctgatgaactactcaaactggagaaaggcccctaccagttgcaagaattctttggccattttagtaagaaattagcaagccagggaaatttatttaataccccccaaccccaaccagcctttctcatatttgtcaattttctgtcaagttttgtggtattgactaagctaaaatacacagttgattcttttctcgctgcctttaattattctttagaatcttgtattatagaaaaggaaactgccatttagaacatctgagagcttgcaagaaaaaatgtgcaggcacatttcaattaagaaatgatggcactttgggaggccaagacgggtggatcacaaggtcaggagatcgagaccatcctggctaacacagtgcaaccccgtctctactaaaaattcaaaaaattagccgggcatggtggttggcgcctgtagtcccagctactcgggaggctgaggcaggagaatggcgtgaacccaggaggtggagcttacagtgagctgagatcgtgccactgcactccagcctgggcgacagagcgagactctgtctcaaaaaaaaaaaaaaaaaaaaaagatggactaggtaatacttatatataatatttctttgtgtttgggacattcaattccactcttccagttattttgaaatacacattaaattactgtaaattatagtcaccacaccaaacactagctcttattccttccatctaactatatttctgcacctattaaccaaccgctctttatccccctctccctacttccctttccagcctctgataatcatcaagctactctttattcccatgagattatattttttttttagctcccctctccccgccaccaaaaaaagaaaagatggccttgaagtaatgaagcagtataggagaaaatgggccaaaatagaaatgacagtaaattaccagtttaaggggaattattgatatcctgtgacctccagtgtatgaattccacactgcagttcaatttttaacagtcacatggtttatctgattctcccctcctccttccagaaggcataacaacatgctctatgatctgcagaaaattctcctgctgattggtttgtagactctccacttgaagtgctggacttaaaatctggttcaagcaaaaaacttctgactagcagctggaacttgctcagctactggctcaaatatttttaagacgtggctttcagaaacaaatacagtgatatcaaggatcacggagtgggctgcacaggacacagcctttctctatgcatactcttcctgtgatagttcagtctttttctgttgtatatgttgaataggggcttttcttagctgtttacaggtctgatcacagatcccatggattggagaacacaagctcattcatttttcattttaacttctcttgggatatgaatgttaggagaaagaagaaagaatgaaagggcgttcacggggaataattcatgaaatgaccaaatgctgcctgattgataagaaggtagaacttagtaacagaagcacatggtgaaggacactgtagccagcttagagatttcattcattcattcatctatttatgaaatatatagatatatttatcatatatctatgaaataaattaatctacttatttattaaaataaatcctgttaccaccaaaagaaaattactcttgtttaaaattcaacaataaaattaacatcaaagctgaccacattagtactgacagagtagtttcaatagaaaacttaaaaaaaattaaactacaggttttaatggaaagataactaaaacaagccctctaaaaaatgaaatgcatcttttcttctctatttgaatatttaattctctgcttttgaattgaggccctgagtacctagatttcttgatgttgctaattgaaacagctaatttttacagattttttttctattacttaaattctgaagtggaatgtacctcccaaaattatatttcatggcacatgtgcattctttggaaaataagtttggaacactcaaataataatatgctttcttcaaaattgatagctcatataaagatactaaaggcactgagaagtcctataagaaagactttaaatcagtatctaccagtttgacaatgaactttttttatgtagcattatatttccacagaaaaaatattctaaaagacataatttggaacatgccattatagtatagaaaatagactgagactcaagtaagtcaacattcaaatccttgttttcctgctaaagtgtgtttttattaactttattatttatttattattataaataataaacagctcactgcaactttgaatacctgggctcaagtgatcgtcacacctcagcctcccaggtagttaggactacaggcacatgatactatgcccagctaatttttaaaatattttgtagagacaggagctcactatgttgcatagactggtcttgaactgctgggctcaagtgatcttcccacctaggtctcccaagttgctggaattataggcatgagccaccacacccaggctttattaactttaagaattacgcatcctcatgcatgagtgcacaaaagggagaaatggaaggagaaagggaaggagagaggaagagagaaagagatagagatagagatacgatgctctaagtgttaaataattgaatctccaaaactgttttatcagtgaaagtattacttcatatcaataaaggaaaaggaaatgacattccaataaataccattgtcattcaatttttcaggcactttatatgttatttcatgaaactaccagaataattattgcaaaaagcatatttttctctgaagcaatctaagtaagttcaaaatatggtcttactatatagaaaaaattagcatagttctacaattcctgtaacttctatattctgttcttacttttgaaataaataaagaactgaagaataaatcccactgcatattttaacccagatactgtgatggaatttagactaagaaagatgctctaatttctagcgttatgatctcacttctaaacactagtctttcacatgtttgtcaacatatgtgaaaataccagcagggacattacaggtgcggaataaatttatttggtgccttttattattaaaactgattgtacatctttacactgcttgtgtttttttcactttatattgactataatcaaataatgaatgatgagacacaatggagcctgattcattggtaactaggaaaaaaacccaactttgtagtgaatccatttttttcattttatctccaaaatatatgttcattattctaaaatcatgatttgcttagaatttgatgtttttaaaatattgttaatctattatttttaatgggctatgcatttccataaaactcaaaaaataaaaataatccaagtcatacttgtcagaagattaggcaaatgattcatttctaggccagtaatgtgtagtatagagaggttcaactataaggtttccaatttgttttaaggttcatgttaaaataaaagaataccaaatgtaaaaagaaacaatgaagaaaattattctcaatgctccataccccttcatctgaccttcatcttgattttcactcactattggtgcccactttgatttcacttctgaaatactaaaccacataacattgaaccatggcttctttatagccccaggctataaaattaggtaaaataacaagtatcctaaccaagatcataagaagacagcaaatgagatttacaattgagccaattattgtacactgcataatgcttagttaacacctttgggcccacaagttgcctttagtgttatagtatttggaaaaggtccattgtttaaagttctttacctcaagatatttgaataaaccacaatgtatgaattcaagaaatattcagacatattcctttaagatagactttaaacattagtctgcctatatgggccttagattctttatctgtaaaacaaaataactatactagatgacttataaggtcattccctactccaaaaatgcaatgtctttacaacataagccatatatatatatgcatatatatacatatatacacatacataggtatatttatattagacataatgtttgaaataaatcatttcaaagtttgtaaggtaaaattgaagacactaagatgactttctgatcatgacatcaaaaatatgcctatatgattataattcagttggaatataaggccatgtcctatcttaacatgtaataaaatccactttctactctctacagtcttccgcacaaaagctcaaacaaaacgacgaatgccattctcacatcagtattagtaacaatacatgtaaaccctataagtactgtgttccttttattgtaatatgtgcaactctttgttcagtgtgcttgtaagtaagtaaaacattcaattcagcagcaattttgtaaatatatccttttttcttcctttcttggtttaacctctgtggttatggtggcaatgctaatgattgttgataagtgaaaaaatcaggagacaaaaaatgagcatgaagctttagcaatacattcaaggtaagaagtatgaaatggaacaccaggcacagggccaaatacttaagcttcatgcatatctgcttacacaataatacagagatactgttattacaaggtatctagttccatcccttttattcattttcaccacaattcatttaatacttttactagcacttgagtcctcgccataaaccttagagatgttgttagcctttgtatatgaagaagttgaagtttggagaggatgataagtgagcagaggtcgcacatcttattgaccaggactcaaacacacgccattcaactctgaagttcatgctcttaattactgcataattcaacaacacattaactaagttctcatgcatattttagaattgatgagggaatagtttggagggcagacatccaagggccagtacaaataaatctcttgagcagaattttcagccttggcactattgacattttggaatgaataattctttattgcgaaggacagtcctatgtattgtaggatgttcaacagcatccctgacttctactcactagataaatgtagcatccatcccttcctccacccagttgtggtaaccaaaaatgtctcaagatattgccaaatatttcctggggggcaaaataactccatagtgagaacttccattctaaaggaatgatgtatttactatgaacacctgagtaatcaatcctcataggatccccgtatttatcaccaggccttctggggcttttacctttttaattgtctcctacgaagttattggctccctcaaaggttcacacacaacattttggtctttactaaactaacctaagctgttttagtcatttcataatattttgatcctgtctgacatttttgaaacatggttgagattctagaacaggagcataaaatagctgccgttttgaaaacatttttcaaatgtttaaatattcatgcataattgtgatccacacaaatacccatcctgactgatgcaggagttactcgcatatgggactatgactaggcagacagcacattttgagtccacctgtctggaacactttccctgtggccccaacttgggtgcaatatatccaggaagggaggacaatgaaggagaggaagaaattacctaacacctctatacaaagcctatttcatcatggtagtagagtctctccccagtttgtcatgtaagtttctaatctgtctttgctatgaccaataaaatcagtccataagattccagtccatctgcccctcctctaaaattagagaagaaaagataaacctgatatcaaagcattccatatggattggtattttctgtcttcagcaggaaatgtgctcaatataaaaatgaaataatgacatggttatcttttttttttaagttgcaatactaaatcactcctctgcactctgagaagactgcattgtgtgcttttatttttcccctcaccccatgtatcatcaacactatatcctatagccataacccaagtgacaaggttttgatgattcacaagttgagagtgcatttagcttagttctctccacgtggctaggcatagctatgcttttagaaactatgagtagtagacatgcatttgtgtcatgtcacctgtgatagtctaagcctagaataaagagaatctgttccagggtttcttctgtgaggttgctgacctcaccacagggctatgaaatgtatagagtctcacatgagtagagtaaaggggatgacttggtgtcccaatcagtatatgctgctgaatggtcaagtaggaacacacagccatatgtctctgtcttgataaagttcacttactaagctatagaaaactaaagtggcttcctgactcacgaggctttggaattataatttcagttccaaaaatcctagcaaatactatccagaacatatgtttaaaaaaaaagagaaagtaaaacatttcagcaataaaaagatctgttgaaatccatgaatcctattcttaaattcctgaacagtgtttgtaagacaaaacaagatagtatattagggaatatgttgtttaattcagtaaataaattaacatgttgtaccctaaattaaaaaatgattttaaattataaattgttgaagcatggaagataaattaacttgcagaaaatcaggaaggaccaaacagaacaacattgggtcttttaaaaatagtgagctctctatccctggaagagttcaatcacaggttacatggccattagtcaggaagtctgttaaatgcattctacatgagtgaaataagaattagatttaaaaattattctaaatctaaaatgtaaaactcttagtataccttctattctaccactaatagggggtagatcaattttttattgttgcttaatcctttggtccttcctgattttctgcaagtttaatcagttaaattacatttcatacttctttatatgaataagtttataatctactctgccatttagctgtcaatggtttcttccatttttaaaaagttgtatcatagtatatgtgtgttcagttacacatagagcacttagcaacataataattcttcatgtacttacaaaatctatatatacacaaaatattttcaaattatacaattgatgattattataagaaagtacggttctaagaacaggtcagaaagttttatggatataagtatccttgaagccttcctttgcaacctacataatatgaatacttgatttgacaaaaatgatatctatcatgcatgctatttatgagatctatgaaggcaaggtcttttggagcttttgtaagatggcagactttagtgagaaaaccatgtcagtggacctggatctgcagctttgtggttacaaaaataaaaccttggcagtcagttcagagttaaaaaggtcaggggagcaatccacactagcaagattaaaaaagacaataaggaagaatgttatgttataaatttacatagagatattagtctgccaagcaaacaaaaacgtttgtactaagtatggttggcacaatgtctcccctagagaaaacactacaggagaagaaaaaatgaaattaaacttcacttggcaagcatgagattaaagtaaagccaaagaggaaaaatgatccatatagctagcagcaccaattgtagaagttgcatcaagaattttttaacctcatgtccatggactgttggacttttaagttatctgtggaacccaagttgttgtaagaaaaaaatatgtttttatgcacatattcattttcaggaatgagaaggcaacagtttcattagattctcaagagagctgataaaacaaataatagcattaaataacatgctatgccagataaacaggaaaacatgtatcatctttctaaaatttattttccttaacctgcagacagctgggtgcggtggctcatgcctgtaatcccagcactttgggagaccaaggctggcggatcacctgaggttgggagttccagactagcctgaccaacatggagaaaccccatctctactaaaaatacaaacaattagccgggcatggtggcgcatgcctgtagtcccagctacacaggaagctgaggcaggagaattgcttgaacccgagaggcagaggttttggtgagccaagatcgcaccactgcactccagcctgggtaacaagtgtgaaactccatttaaaaaaaaaaaaaaaacttgcagatattcccattttttttttctcttttgcttcctgtccaaggtttcatgtagaccaccctttctgttaatatattctttatgttggccgggcgcagtggctcatgcctgtgtaatcccagcactttgggaggctgagacaggctgatcgcctgaggtcaggagtttgagaccagtctggccaacatggtaaaaccctgtctctactaataatataaaaattagctgggctggtgacacacgcctgtagtcccagctactcgggagggtgaggcaggagaatccgcttgaacccaggaggtggaagttgcagtgagctggattgtgccactgcactctagcctgggcaacagagtgagattctgtctaaaaaacagatagatagatagataattcttggtgtgcaaaatgtcttagtatacttttctttatattataaacttctgcccatcaaaataaataaaattatgacacagatcacgccattctagatctaattatttccccagtttgctagccatatacttaaggtccatttctgagggttgggtgcatctacaatcagcaaatgttgtccactgcatattctcatgttgtagaagcattgtagaaaagcttccaaatatgtttcctcaccactatcactgttagagaaagaacattgccaagggcatagccattggaattgggggtgtaaccctatgcagagaacagcagatttggattcatcacctttcatctttacatatcacttttggttacttgtattcccggaaatatgacataactaccataaaagtgaggctttctttttagacttaacttaatcagatgggtggaatttcattcctctctcaagtattccgactgcacattccctcccatgtgttattttgctctgtagcttctatctctgtggaacacaggagcagaaaaccaccaaaagaatgaagagtaaaataaaacaaattgccaaggaaaaatatccaaaaacccatcacagaaagaagggaaaaatcgaggtctccacagatgagtgcttttaattagaaagagagctgaacggcaaagagcttatgctaataagcagcctcttttaatcagcttattaaaaagaaacatttttaacagccaaaatagtttaaaaaatggtaattattagaaaagcattagcaggttgatggtgggggaaggaaacggctggtcacgaactgaaatttaaaagctttctggatactccagccaggcccagttgtcctgaagaagtgggacaacatcccaagtgggcatgtttggtgtcagcttcatttctttttctgttatgaaaaactctcttttcttttccgggtcccctgctttcccactattccgcctttcttttggactttattttttctctgccaccccttaatcatttctaacatgtttttccaagtactgtttctcttcctgctttttcgttccaaggctttggttccactttctttcccctgataaatttgcttttcttctgtactgatctttgcagcccaaacgtgttcaacctatctaacttgagttttaacattgaaaaaaaaaacactaaagattgtcttctaaaaaatatttccaatactttcactcttacctgcctcatagatagaagtgtccaaattgttattgaattattttcaaatatggattaaaatattaagattctttatcctgaagtaaactcttgatttgactgagttagtcaggtctcatcaggaaaatgtaattctctatgagtcattaagagtgagagaaattaatgtagagacttgattaagagaggatggaagagaatgagaagtcaaccaggggatgacaaggcaacaaagtgattagtcacggcaggaagctacttctactctctagttagaaagacagagaagatgatattacttgaacccaggggcaaattcagagcaatgcacgtctgtcctggggatctggggctgtagaagagattcagcagttgcccaagatatcaactgaggcaaaaaggacagagagaaatattctaactgttcccttcctcctgccctctaatttcccaccatgacttccactgggtgagcccagcatgaagccagcttaatagaggagtctgggaaccaaagacatgaaagtcaaactcctgccaggaagagaggagcagggcagtatgaagatcagatctgaggactaactgcctggggctagcacaatctagctctttagtattagaagaaaatggattattctatttttttcacttttctatgtgttagcattttatcaatgactggattgaaatagaattcaaatacctattcaaaattttctaagttctctaagtcttaactactcaatgcatgttttagctttgaatcatctaccctgaaacagtgagaactcaagaattcttatgcttgaagacaaaattttctctctgcagccattcaatttgaagagaatcagggctaagaaaaggtatctgtgcagctatcacctttatttatttcagaaatcatatgctgttactgaactaaatgtctataggaatgtggcaaggaaatatatgggattaaatgaaaataacatttgtgacatttttctttttttaacttaaagccaggcttaatttattaaaaattatttgaggattcacaattataaaatttgtatttctaaattattaatctgggcagtggtagaaaaaaacaggatagtctaatttcagtagaaagttccctgtgcttggcaaatcttttatttctccctagtaaattctcttgtgcacttcctatagtaggtttcctaaacttttaccgctgtgctttaaagtccacatcccaatgacttttaaaataaagacctctaggtaacagactttcctcaacttcccttccatttactttaacactaataagtttattcatcttcactaattctctaggaagcactctattccttctcccttgagtcctatgctatcctgagtcttaagtcctgtcctttctcaacttctccagcaattggttacatcaggctctttctttgaaatgttctactttatatctttttcaatgacaataccacttcaattttcctctataatctggttattcctaaatttatgtcctttgacctaatccttcatcatgtcctgaatatatttcccaaagcccatcaggcaaacccatgtcctcccacctaacatgtcctctatgaagtcattatcttcccttccaaacattttctagtaccaatttaacttctaagattggaacccgttcctgtgtctgttcttcctgctctttgtgtgactgggtcattcttgtcattctccccattgctgcagtgagactaacctaagcatgctatcttcaaacagctgcccagggactctcacacagcatcttgtattaataatccacagagcactctcatcatcagatagtgttatttatttgtttatgtatgttctgtcccctccttattagaaaacaaactccaaaaacatcagggactcacatttatttattgctgacacatagtaggtgtttaatacttttgaataaatgggcaatgacctcattctattcattatccagtcagtaactgaattttgttgatcttacctcagaaatatatttctcctatttttcctttagttgctcttgttagcattgttttcctgaactatttcaaatggttcgagtgttcagagtccagtctataagtaaaacttcctttgtattatcatcagatcatatcatcatagttattaggttatcaggggatttcattcctccaaaatatatatgttgaagtcttcatcctcagtagctcagaatgtgactatactaggagatagagtctaaagaggtaattaagttaaagcgagatcattagggtgggccctaatcaatatgactgatgtctttataagaagaggagacaaggactcagacctgcatagaaggaagaccatgtgaaggcacagggagaagatgaccacctgcaagacgaggatcatggccccagaagttgtcaaccctgctgacaccttgaacttggacttttaggctccagaacagtgagataataaattttggctgtttcagtcaccccactatgatatggctgtcctatcaaactaatacatgttacagacaaataatctgatcatgttacttagctttcctcataaaaatctctattttcttattgcccaaggagtgaaattcaaattcttagacaggaatacaaaactctttaaaatttggtgcatatcttactcttagcttttaactcatgtctttttcatctacatcctatatgcaaactatatacaatttctcactttcccccaaacatgccagaattttcatgaccctgcatcctagtatgtattgttccctctgcataatttttctttcttctttggagaaattataaattatttttaaaaatcagaatgtatgaaaaagtaagttagttcattaaacacctgagagattatagccactttcttggaaattgtcccattatcttaaagagaacccaaactgaggcacacaagttttgattctaaggaaagagagaagggaaaaagaaaagaaaaatgggatgtacttcagaaataatatgcatactgagtcctatggccattttcattatgttctttctcctctagttccatgattctttaagctaaaaaaagtcccaaagtaggccaaaaggtaggtggcctgcattattgcttcactagttctcagaggaagagcaaatcaaagaatattagaattagaagaaatctcagcagtcatccagtccaaactctttacttcccaatgagaaaaaaatgaaaagtcaaataggtccgacctgcttaaaaccgccaattaatgagtagtagaaccttaattcaagtttcccaaacaaaagtcgatgctccctttatgacatcctatttctgtttcaagccttcaatagttcctagagtgtaaaacacattcttattcttccatcatttttctttctatgttttcaaacattctctatattcctgaatgcaatcttctgaggtatcattgccagaatacatttatgggaatacataggagcataaatatatattaaaaatttttcatatacaatatattcttgacacaaaatttcaggagtgcaaccacgttgtgtgcacacaacagcagtccacaatgcttaaatacatgtgatttaaaatctcctacctttttttgcagtactaccttattttcattgttatgttttgatgtgaatgactatagcaggcaaatgccagtattcacagccctagtcctagtttgtctgagaaaattatgccaagcgtgcagtgccatctgctcctgtagcgatgccatccttccatttttcagcaccgtgataaacaacccaactgcacatcattctcttagctccacaagcacctcggggcaagaaggggagggcgtgtcatcctcctaagttacatccaaagtgatgcatatggcagggtgagggaagggagaagcagtaagtgagcacttggaccagtgataaatgggctagcagccctagaaattcaaaacagctacatgactgagagactttctcatactttgaaaatgtcctggtagtggtgaagataagtcataagaagggtagagtggggtggggtggggtcgagacaatgttcatttcaggacactttgaaatcaacaaggctcacatcagcttttccatccccgatttttttgtgactgtggtcatcttcttactgataaagacacggtcaggagatggatatgtgattagaaaacaagctggaaaaattacatagaacagtatggtattaataattcatgcagggcttacattccattttcagttagacataaaagtaaggtcacagaactctgatctcaacaaagtaatgtgaaagttgggagaattgtaagtctgggagtaaccgctgcctgatatttaagttgcttctgttaatgtccctacctctgtattgtgctggtttctgcttatccacaatcaatgacagagaactcactactgtactctatcagaccagagcctttctatatacattcagactgtccagccctttttcaatatgtacctgtcacacggtttcttaatttgtgaataaagaaaattgctatataggatcaatattatcctctaaacacactaattgatagactgaaaaagtatttaagaatgtttacatgtcaagaggcatttttgcctacttgggaatgaaaatcttacaaatatgacatagaagaataatattatggagatttttagagatatttttgaagaaattgtgggaacaaagtagataacattttagaaagaaagaagttttgggactatggtaaatttacgagtgtactcagggaaaaagtctttctgtggatgaaaaccagggagaaataccaaactgaattttggcctggaaccaagtatggaactcagaaagaagagacttcagtaactaaggtttatcactaggtttcaactattaatgtacagttgaattgtgtagttaaacataaagtgaaaataggaacctggccaatgttaatctttatcaggccatattgactcatctgagacagtttaacatcacttacttctcctcacctaaattatagtgaaacatcatgtcctcataaagcttttcagatcatgtcaggtttaagtccacacagtacagcattgaaatcatgggagaaaaacaaagagtatggtgcccttgggaagatattttcaaggacatattctttaatgctgacactattaatcatctgggtgttagcagttaccagactctgtgccaggtaatgtgttacgtactagagatacaaagatggagcagataaatgccctatttctacaagctcccagattaaagggaaagatttatgcacaggtaactaattcatttgggagcagggaagggccatccttctggagaaagaaatggtttcagaaaggaaatagaatcttacctttcaggaccttgaaggatgagtaggattttaacagctagaaaaggagaaagggaattttaggtagctatcatatctaagcaagaactttggggcaaactggacacaggtgcacacacctgtaatctcaactactcaagagcctgtgatgggaggatcacttgagcccaagagtttgaatctgtctagcctgggcaatatagtaagaccctgtctctaatgtgtgtgtgtgtgtgtgtgtgtgtgtgtgtgtgtgtgtgtgtgtgtgtgtgtgtgtatcagactatggggacagagtaaaccgtttagtttattcctccattttgcaaatgttagcttgacctgtcaaaaacgcagggaaaggaggcaggcagtattctccaccagggccaacgtgcttaatttccaggccagccactttggaacattttggccttcatctctcccctttccttcccccgactcactgaggtttcttaagcaagaagccaggccaaggatgcctgtgtacatatgtaggcatgagcacacccatgtctgtgtagactgatgtgtgaaaggctggcatttggatataatccccatcagttcattaaaatggactaaactgccaggcgcggtggctcacgcctataatcccagcactttgggaggctgaggcaggcggatcacgaggtcaggagatcgagaccatcctggctaagatggtgagaccctgtctctactaaaaaatacaaaaaaattagccgggcatggtggcaggcacctgtagtcccagctactcgggtggctgagacaggagaatggcgtgaacccaggaggtggagcttgcagtgggccaagatcgcgccactgcactccagcctgggtgacagagcgagactctgtctcaaaaaaaaaaaaaaggactaaacttaaacaacacttttgatactatgagagtcaagggagaatcagtattcatctaaatgtgtccaaaataatatcccctaatttcagaattaacagcacatgtgaactctttatctgatatttttttccacttccatgccaagatgacaagacaagttttctgccttatcctggaagctagtagttctcagaagctttggagactagtagaagattctatattttttttttttgagatgggagtctcactctgtcatccagactggagtgcagtggcgcaatctcagctcgctacaacctctgtctcctaactttgagcgattctcctgcctcagcctcctgagtagctgggattacaggtgcatgccatcacacctgcctaatttttgtatttttggtggagtgggggtttcaccatgttggtcaggctggtctcaaactcctgacctcgtgatccgcccgcctcagcctcccaaagtgctgggattacaggtgtgagccaccacacccagccagaagactctttaatacatagtcttctgggtaccgtatatccaagagagtcccgaaaaattagtattttcagcaaaatcaataatagaccccattagatcatacttagccacagttatgggccagcactaccctttagcatatgtttattattattattgtcttaattattaccgatgacaatatcatactgtcaaaaactcttgccattaaaattctaatttagaatttacaaagtgcttctaagagcattatctcatttatttttcttatgacctataggatagccattattgtaaatcctattttattaacaaaggttcgtagatcgagaaagataactgacttgcctaggataacttagctatttcatagtagtgtacagaaaaatccagatcttaacattatgtcttttgttgtcccagaatttaatgagttgtgccatatagaatcatattcaatgaagtaaatagcagagtgcttgacaacaaaactcatgctatatttcttccctaatcttagtttaaatacatataatcattgtattgttatctttcctacaagtacttgtttcaagtaaggtaacatattttttttgctgcctgaaatataatgtcaaatacagagtaccaggagcctggggactttctatctactctaaaagaacatattctactcttcactatggatttggtaacatttccttcattaaagagttgcctcctttatcttgactttaattcactttcaattcatccatccctacaaaatattcaagaaagaaccatttctgtatagaaattaaacacaaattattatcaatactggaacggctattttctaccttcataaatgtctaaggttgtgatttaaaaaaacaaaacaaaaaggaacaaatatcaggcctggtggcttaggcctgtaatcccagcacttagggaggctgacatgggtggatcacttgagctcgagagtttgagaccagcctgggcaagatggcaaaaccttgtatctacaaaaaaaaaaaaaatacaaatatcagctaggtatggtggcatgcacctctagtcccagtgcctcaagaggctgaggtaggggatcacttgggcctgggaggtggaggctgcagtaagcagagatcgtgccactgcactccagcctgggtgacagagtgagactctgtctcaaaagaaaagggagtgttggggggaacaaaagaaagctataaaagaaaacggaaagtaaactcattgctgtccctgtgtgtacatctgtcttagaggcaggacaaactgtttctgcaaagaatggatgaccttagctggaatccactgaagggacagaaggttaactgtccatgtgcccaccttgttgtcatgagttcactaccctctttgctaagatatgctgcctccttgataagatatgtggtttcaagcaacagtttctctttttacaaaacgtgtccctcccatttggacagattagccaaaacaataaactgttgaataaattattgttaatttaaggtcgaaacatctgattaaacatcaatttaacttatgatttctctgatgaaatcctcactggcattctgtaatctgaaatctggaattcctaattcagccacaaagtttggtgttgattttttttgaggaggccatggttagtacaaaaggtagagatagaaaacaggcagaaagtacctcaataccaagaacacctttctaacagaagttgttcatgggagccaaggccacccagcaaatgctttacccataacgttaatcacaagcaggtgaagtcattagcaaaggataggtcagcaatacagatagagacaggtgagataagataatacagacccagagggtcattccttttatgtcaagactacagagggcagctcctttaaagaaactaaatggagctgagcaaaatgttacatcaagaatagataactgacccattcctcagaagggattactgcaaggagtggaagcttaggctgaaagacatttaggaacaattccagtgcttagattctattaaagatttcaatttgcaaatattttaattttatcttatgaaaaacttgcttttcttacacaagccaaaattcagttatgtagctcttaaatcatgttgtacctttaaatttaaatggatggtaaatagaattatttgttaagacttaagtcctaaaagctgaaaaactcattctgcttctcatacatttgaccaatagtgacaaatcaccagctgtaggcagcccaagaggccaatgtttattaaatgtctcactcgaccccaaatctcatgaattgtttaacatacaagacagacaaaaagccagtatttctccttgtgtcagctctcgttaggagcgtctctgctcctctcactgttggctagaaacaacattaacattcattgttcttaaacacatgggagaccaaggggtccctgtatacacagcctatcctatgccacatgtgtgccaatgtgcacctagtccataagcacaaagaagcaaatgttaaggccacattgatggtacccacttaaggagggcaaggcagttggcagtgtgtactgtcaccacgaggggcaactgaaatgtgctggagaaagaactcagtaatctcacaccaaaaagaaaacctcatgaaatcaattgtgtagacaaagtgagacttttcaagccatccatttaaagccagtcataatagaattggctttaggtggcctgtgacctgcaagacagatgcttatccagtctttgaagtagctaaagaattttgtcactgcttttttctcatgctgcctttctcaataatgtatgaaaaaaaaatagaaggaacactatcagcgtgatgatgggtggttcatttggaaaatctctagaggctcttgtaatcttatgaattctcgtgattctaagtgactaaacatttttaatgaataaaaattttctcagcaaagtaaatatttcagcattatgaacgtgaataacttgaggaaaaccttaatgcactaaatgtctacttaacaggcattcaactctaccatttctgtaaatagtgtggtttcggctagctccgcagatgtcatcatgaacttatgggatgttttcttctttgcaacagcctccagaaagtccaactctgacccccattgtcaaggattaggggcacactatacttaactggagacataagtactgatcaacaaagagagaaacctatttggtttacaataacctgaccatcttaagaaagaggctttaattattcaatcagtccagccctttctggacttctcgaatcaatacgacattcaactaaaccagcagttccaaagatgttctagccttggattattatcagaaatatgaagcacagcacatggccccaccctttcccccctttcttcataaagagagagctaggaattttcttgatatattactattgcaaaggggtatgagaaatggacgcattttgcaacttaaataaatacagaatacggaaaataaatacagaaaaaaaaacctcttcaccatttgcacatactgaccaacgtgatttgtagtaatcagttgtcacccatggaactacagaaaacaagaggtgatattttccattagccacatccaaaccccaaacaaagagttcctatggtggtggttataaacatcagctaaactccctggagagacacatttttcctagaacattacatataggtgatacatatagcatgtttttattactcttatttgtcttttatcttttacatgtctttgcagatggtaattcacagcaacccaaaataagactacagaggcaacagaaaagagcactacataatgttaagcataataaaccttaataattttctctcactcgttcacgtagctggagctaggctacaagaagtcctgtggagcttccttttctaggcatgaacatttctcatttgtttaacattgtgaatcagcagttattgtgcttcagtgaacccagaagttttaaagcaggaagaaagtaaataaataaatccgacaaagtttaaaacttaagaatgaaagacaatggcaggaaaacagagtagagtggtatgattcaagttgctgtaaggggcaggatgatagctctctttattcaaaggggccatgcaagctcattctcatttccaaataaccatagcattttatgaaccgcatatgcattttcagaccatcaagttcttcccaatttaaataccatgtgcttcttcacattatttcctttccctgcagttccatgatggtcttttatcttctaacgtccagtagcactgactgcatatccttcatagaggatgtttaatttgataacttatggagtaatctaccttttaacataccctaaatatatgtggaatactctctaaagacagggaccatcacttggtatcccaacttcttgtaccatccaacacagagaaggaggtaaaaaatgatctgttgattaaaaaaagcttctgtatcaattttataactattagtctgtccacaaattagagctgcatttaatagtccatgtattgattcatgtaacatacagatttatatacaatttcactcaccactgcctacttgcttttcagaaaagaaatatgatgtaatgtggccatgcaaagatggaaagtgaagagattattaaagagaaaaaaattaaagaaagaggagggggtgatagagggagaaagagaaagggaaaggaagaagggagaaggaggaggaggaaaagaagaagacccaatgtgccacaataaagatggctgttagggtggtttccaccatatctgcctctcatgaataaacaaaaccaattccctctattaacaccgttttgtttcagtaaggttatagcacagttctgctagaactcaagcttaaaagtgagggcccctaacatcatcagaactggaaaaagccaactttcgcctatggcttgatccaagcctctgactaccatctgtttagtgatttgacttttcagttttactttttggaagatgcaccaatggttgacagtatttcccagaatctcagattgctcaacaatgtatttttccacaaacctccctggataaaaactcatgattttgccaagaattttaaattttgcactgaatgttgtgcaatctctcagaattattctatatcctcggaattgatttctgatagaaaattaactcctaaggtacttaaagattaaagggacacttttcaccagttactgagattggatgttaggaaagcatctttctcttttgctctttggtcttaatatatctttatacagtatttctgcctgagacatgagactgcattttctctacatttccatctcatttcaatgaagagctctattctatatttttgtagacaaggccctcctcttcttgatccacccatcaccatcagtagtgatgtttgttttaataacttgcttatgtactgacttgagaattactgaatcaaaaaagaactcaacaactgagtgcactactaactaaagaagaaattccaaaagggcagttatattttatcaagtaagagaaggaaaagaatgttggccagagagctgcaaaatcatacaagagagagaaagaacatggtgctttaaatatgaatttattgacaagtttgctacagcttaaaagtctttggttagagcagacacaatgcaggagtccacaagctagaacagtttgattatgtgccagaagtctttttcaacagccattttgaaacatgtgtatttatagacaaagagaaccataaaaattgcacatggtcttctgaccgctggagcatttaactttagctggagaagtgaagtggaagccaatttaatcttttttcccctcttatttttaatactttggtagcacattatcacacctaccttacaatttgctactcttaagttaaatccctgaaggccaggcactgggagacctaaaaccagatgctggtgaatgtaaggaggggaagggctgagcttctatgacaattaagcaagaaatccctacagaaatccaaatcagctttggctataggaggaaaaaaatgtatgcttccaggaaaaacaaaaacgtgttactaacctatgctagaggcaaaaaccacactttagtaggagatactgctgagaggtttgtttatttatttattttttttggtgacacattgaataataatggaaatagtcagacaccagtggattgtatatatttggccattttccttctttttgggttttccttttccttgctgatccttccttgtttatccgatctaatgcaataaaatgcgtaattaatttctaaacgcttccattgagcggtgcaatttgtcaagtcgagttgttaatagaattaagctttttatcagcgattagcaaaagaaggttaaaaaattaattacgaaattgtatgcctccctggttcaaagccaggttttggattaaatgttcgataaaggtttcctgacacgttataaaacatttagcaaaagctgctttcctctagtgcatttaaaacctgtctctgagcaaaaccaaccagcaaagcaagagcatttgcgcagacctcagtagtgcacacaagcgtggaaagatagaatatcacttttacaaaatactgaagaaaacactggttttcctccccctactcaggaaaaaggacaagccgtgaccttgcaagtgtttttcatctttaacttttgatagtgtgatttgcagcttgagtaaaattgaagaattggttgaaagaagtaataaaacagtccattgatgatataattaatatataacatgcctttatctgtaattatatacaacatatccacaaaggttagtatgtaaaggatagaaagtaaagagttgaaagcatgctcaaaatatctgatcctctctaaattgctgttacaatttatgcatttctcctgtacctggtcctctcttttctttctctcttctgtgtgtcagtctcacctcacttttctatgagtggaataattcaatccatttcaccctatcactgtctccactccaagtgaggaggagagaggatgaatccgataaatcagaccctgacatctatccactgagtcacgtgtcatgagtggcaaaagctattgttccacagtcacaaaaatcaagtcctattttacctttctttcagctgctgcactcaggcacagctagcactttttccttgctttcacatctggggctgctatgcttcgactatctgcttccaaaccctatgctggaggcacttctgggcaagaccctgagagtggttttcatgggacggtgtgtgctcttcaaaggaggtacacactcctctgtggctttcaaattctaatttagaatgggaggtcagaggatgcccttcagccttagatctaggtagtgttctctaaactcccttttagcagggacccaagcgttatagttacagggaaattttactgactaatgtaattggtaacacatttacaaatggagtatgcccaatctgtgcatgtgtactccatccctcagaaggctgggaggtgaaggcatgaataataagccaaacactcactatgcaaaatgttctttttctattaagtagggttactcttttcttctgtttttcttagtcctttttctctcttgtgtcttttctgctttttaacattgtttggatagttttcttgagcagtcatacaagattcaatttgtaagaagtattcaaggaatggtgcagtgtgacagttttatgaaacaaatttggattataggaaacaataatgttattgcactttctgacataaaattaaagattttttttttctgaatatttgctgctaatgataaaataaacaacaaaacagaaaaaaacagaatcagcttagaaatctggtagagaattataatgagcaatgtaatttttttctggttgcttgaatttaagctctatgaccttcacggaaatttctagtcttgtttattcctgtaacctcattacacctacagagctgctgatacatggtgggtgctccatataaataccagttaaatcagtgaatggttaagtgaatgttattctttgtgtcatttttccttgttgcacttccgttattgaaattttaaaaaagaagtattctttgttttctcagtaaacatggaaatatactttgactttccttaatgactcagaattttgcagtgcctcattaagtatgagtaatattaattaacactacaaaattaataaccaggcaattatcaggtaaaataggaggaattaaaactgatcctcattgatcttagcttgtcaccctttttacttttgactgattctttgatttcagcttgttttcttgttctttatctcattctcataaaggaaagaagaatgtgcaattctttggcctcctaaactaaatttaacaccattgcctttctacaaaattgatgagtgaatctaaggattaatccgtcttctcccaaattattttccaacctatattataatcttttttttaccatttatatcagtctcctttgaattctcagtagctttcaaaatatcttttattatctgagtattaccaacaacttatttaaatatggatgtttcatttaattcttctgtatctttttttaaatcagttaataatttcctccattttaaaaattaatgctaggctagtatattagaaacccgtaatctttaaagtagtaaacagaatgtcagggatgaatttttctaagcttttttaaaattaaattttaacagaattctaaaagaaaataatattttaaaaagatgatcctttataattgtgtactataatcaggtgatggaaatttcttttaaggaaatgtatcatattctaagtaagagtgaggtccacagtttgaatcaatgaagcaatagcggccaataggaaaattatttttaaaatcatgtgtttgccctgcttcctgaaggtgaacacaacacttgcctgacagtaaaatagagttgttattttcagataggcacatacttctaaagtgacctcttatgattcgtatagtcatacagagactgctcaattaaaaagatagaggagagtgacgtctatgcataagcttgtaccttcttatcaaaaggtttacgtgtaacacttgaaaactattggggagatatttttcatcattaaaaatacgttttaaagagaacccctacacataaatgtacacattctgtccttgtttcgccaaatctgtagacattaggatttagcttgaccctacccaaggattgtctttttattaaatcagaacatttcagttcatgagtggtgttaacactgttcaacatattcagtaattagaacaggagaaattctacaaaattgttcagtggctctgcagtcagctgttagattttcacaaccatacatttagcaatttgataacatgtcagacttaaaatgccaaactgatcttaccaacagtgcacatgcctcaatcaattgcatttactcaaaaaccttttttagcttatttatgagacattggcccagagacaggagttaaaaacactcatataaaatatggtttgtttgttctaacattgctctagaggtataagacagtatttaatggctatactttgttcataaatggtgaagaatttagaccggttcattttcagtcttgacagtccacaagataaactaaaattggaaaatttcaccaaggcttacttcttatgcccatttttaaaaataattatatgtgtttgtgtcatattttaagacttatttcgttttgctagattacttctctgtctttcacaaccagaagccaatgtaataatgatgtgcatgcaagtagttttaacttagaaggcactacataaatgtgtgatgtgtgtagctgtggtgctggtggtgttggtatgcaatcatttcgtaaagttgcttgcaaaaatatgtttatctcctattggttgagtgtacaagtgactggataatacttttgataagaaaaagtctcaactaaaaaaacaaacaaaaaaacaacaaaagaaaaacagagtgcttgggtcttctccttcttagctctctgcctttataacagctatctttatcctctgcagcagcatcacagcttgctttctcctcatttttctcattttacctcatctcaaaatacttcttctatcctcacgctatgcatcttccagattctctttttctcttttttctacagtctttcttctcaatattccccctgcaatttcccaagtatgttccttggagaagttacatttccaagatttggtatttgcctcacatatagggctaaatctttcatttacattcagaagatggttttatgtgattgtctttttctaaggaaaggaatgctaaactttccctccttctaatcctttcaataaggatccttctttacatttgtatagtaaatttaactttccaaagggcttaaacaaacacacttgatctcatttgatatttactgacactgcctagtggtaggtagaattctttaatctccaggagtctctcttctctccagtaaaagcagatttattaaaataataataattggtcacaggacctcacatacacattttttaaaattttcgaataatatataaataataatgaactgctatattaacttactataaactatactaatatattataaatgtaaaatatataaaaataggaataaaaatgagtgagatacaaaatacacagggtttctaataatttcttcaagttctcagtgcataatctttggatcctctttgagaccacggcataatcttctagggctttagtaactgcacttggacaccttctaagagtgctggttacctggaggaggttgagggagagctaggataggacttctttgctgctacaccagcataacttccaggtttctaactctggctcccttttccttggcctgggtcctcaacctacgtgaggcttagaggggagaaagccaattagtgtgtatctatgccttgaggataaagaaggagaacctaatcctaagacctaaagtctaaggcagcatttcctttgggagatttagacttcagctaagtgcttttccttgagtgtttgttgatgaggtagaggtgcaggcagagatagagcatcacctgggaaaggatgcagctgattaacattctgggcatgtaaaacagtttgtgcacaattaacttttctaaaatatatcctaagctttcaaattatattttgcaaagtgtaattctatcctattacccttagccacatacaccttggtatcacagtactgtaaattattcctttgcctccttagtgtttacaactttctgatatagcactcgtagatagtgatcatgcatattccttcctagttatcacagtaaaactagggctattttattcttctaatctttcctcatgcaccctaaagttctttaatcatttttgttgttggtttcttctttcatttccagttatcagcatctttctgatcgtggggcattcaaacctagaagggggatgccagattgcagctcaccttaccttataaataggagctatagggtacaggtttcctgttccataatagcatgtgtctgttgggccagtgctcttatgcatttttattatcttggcatcacattgaattatcagcatgtcacctcgctatttagaaagctgtcatctgatgctctcttcttcatagcattcttccactttagctccatctttctcatatctttgaattccattttctttttcagttttgctttgttgaaagttatctgtattttaaacaattttctgattaaaaaacaattatttatctaggaaattagcacagtgtcctgcatcccatctttctgaagactaagttcttcaaaaaaattcttagccaactaaaagcagattcacaaaatgtggctgatcttggaaatctttccaaaatgctcttagatcattctctttttcacttgaatgtgtgttattctctatgtgacaggtgtgtatgtgtgtgtattattgatatgttatgcacatatatgttattataatataaaatatatacattatatattaatgcaatatattaataaattctgatatatataattacatatatatatctgcattcacatctttttctaaattaaagtaagagaccagttgagcaagggtttttatactttatgtggctgatctctatagcacaagaataatttatgtaataattaataaatcacttccctattgagcctaatggagccccttctttaccattttgttttcatttttccaacccaaatttggatcgaaatattcatattttctttgctattttaggacctttttacctaaatgcaatgactattgtattaaaaagaaaagacattccagcctctcctccattccctatgtgaatgaagttaattgttactacctgttgtgcctgttgctgttattaacttggtgatattgaatctggaatttcattttaaatatcaaggaattggaaattgtgaaacaatagatcctagactgtgatgtgagaacattttagtcttcttgggtggtaaggtttctaggtattatgggatatgtgacacaaatgctgataaatttcttctctgactccatattgaggtcttaaatcctcccataaatgcatctttttctgttgatattttgtccacttttgactgtataagatgcccaagccctgtctgggattctaggcttttgggctgtaggcatgtgactctattcactttggtgttctctgtaggtatcagatacgcagcaagcacttatgggtgtacgtgaaacagagcctctaaaactcagttagactattgtatcagggaagctatcattgcacagaaaagaatgcaataaatttcaggtcataaatcattcagcatatcttgatagaggagcaaggaaaaagttgaaggggatatcatgtgcttgaaaggacagacagaaggagggaaaggacatttacaagggaaatatgaaatcaacaaaatcaaagcaagccacataacttgcaattttctgcacttggaaagctcttcttggttcctcatgtggcaggtgaagggattgaggacttcagatacattcatagaaactgttttcctgagtgctcagtgagaagaaggttaaaaaatcttaatttttcggctcttaaagcaaagcttttatttctatgggttgagctctgtcactctacctactttccctggggaagcctgtctgctctctaatggtcaaagggaatataacactataaaagagaatgacaaaaaaatgttagcgtgggaccacttgtttaatttacgaataacaaacacaacaaagaatgtaatcaggacaaaaataggaaggtgatcataatgaactatgtctgctctcaaccgcaggaactgattaacctaccataaaaaaggatggggctgggtgcggtggctcatgcctgtaatcccagcactttgggaggccgaggtgggtggatcacctgaggttaggagttggagaccagcctggccaacatggtgaaaccccatttctactaaaaatacaaaaattagccgggcatggcggtgcatgcctgtaatcccagctactcgggaggctgaggcacgagaatggcttgaacttgcgaggcagaggttgcagccagccaagatcgcgccactgcactccagcctgagtgacagagtaagactttgtctcaaaaaaaaaaaaaaaagatgaatatttttatagtaacatatataagaaactgtatattgagtgatatggttaaatattttcagcttcactcctataaagcacatatcaaaattaaaccaacttttatattgcattttattaaattttatgtttttaagtactgatctagataaatgaccttgcatttgtaagataaggctgagtccaaacaattaatggttatatccactaatatcacttgtattaatcttcatagaaaaatgtattctctgtgttgcatcctttgacttctaagaatatatggtagcatagttttaaggccaagagttttgctaaaagtctcggggagtcatctatggcttctttacttagaggagaaaggtacactcgtaactgcttacaagactgagaactgagagtggagaaaagtacagaacatctcctagaggcttcgtctgaaagtgatattgtgctgcttccaaacaggatggcaataaaacaagtctgcctgcacttggttgttaccacaggcctggcatatttaagggttaagggaaatatcaccttttagtattatgttgtctagtaggtcagcagaatctaattaggtgtactagctcatcaaattaaagacagtatgttctggtatctccctggtctcttactcaatttctaggtgaaccctaaaaatgtactcttctgagataaagagataaaaaagctctccctctgttcttcttccagattacattcttaatctggactttattttgttccaagttggagggttatctggaattgcttgactgccaaacttaggcaaagaagtagccttatgatgtttcccatatgctagtaagaggcggcttccaagacattgagtcatggcttcagcacagcctcatcaattgctgcatttcaccttctgaggccagactctctgagaggctcatgggcgcttaaggggcattgtgtagtgtttctgctttactgtgactgtcaaaaaataagagagttaagggatagagagttagagaagagaagatggtggcagttttgtgggtttttgtttgtttgtttttgagacagggttttgctctgtcgcccaggctagagtgcagtggcataatcatggctctctgcagcctcaagctcctgggctcaagcaatcctcccaccttagccataccagtagctgggactaatggtgcatgctatcttgcccagctattttctaatttttactttttgcagagaagagatcttgctatgttgctcaggctggtctcaaaaaactgagtttaaacaatcctcccaccttggcctcccaagtgctgggggaaaaaaaaaagagttttcatagagttctgcctaatctctagcagcaccttccttccctgaggtctgtgggtggagctgaacattccaaccttagaatcatttggtttttcctgtgagcagcctcatcctgaggctctctagaggctccttcctaagtcacctcatcagcataaactcaagaatgatcaaaagggacgtgttatgaataacaaaatacattccaattacccagcgattttgaagggttttaggagctcagtgccaggaatggggacaaagacctaatatattcttcttatgtcacaacatgaaaaagcatatgctgaagaatatgaagctgtgggatctgctcttcctgagaaagggtcacttagagagaggctaaggttcatgctggaattgtttttaattgggagcttggcgcttgtttgaagtaggtatggtttgtgagagactggattactattaagctcaatgtgggactgcatttggtgtgttctatcatagcagatttacatctatctttttgacaatgtagtaacttttcaaatccacacattgacggttcatagcctgccatctgctctcgtatccgaagaaattcgatagcgtataccctgccagaacatgacttcagtttatatgtcctgctgctctggccataagaatctaaatactcgttccaggatgatgaagttgttgggaagggcaatttctttccccaacgccttgtctcacactaatggcgtaacagcagtcccaagaggtggtatatcatcctccccacctgtgaaaagaaatgattagattgaacagggttaatctaattgtggttaatctttgggactcaaatacaggcttcctgaaatgtttctttgttgaaatatcaagatcccattaggattctttagtcaacttagaatgatggcagttgtctttccctaatcctcttgacctggactagtccaataacatcagttgtgctctcatctcaaaacataaggcagagtaacaaaagacattctttggatcttattcattttcatttgtttttatctttagtttaaaaagttgtggggtttttttttccccttcaataactattagtgagaatgggggaggaaagatttgtctcttgacttttttttaacagaagggaagtactttattttctccccttgagaatttgctgactattttgtccccagggtcacaattacttaaaacttcatacttaagcattaacacccctttctgttgctagcccacctcttccctccctttcttccccacacaaggggaaactgcagagaaatactacttaattatcacaccacgtaactaattaaaagcaggatgcttgtgtatggtatgctaatgagctattagagatctagcatgctttagtgacaagacatgggttcctattctactcttcacatggctgtggatttctagttgacagttaatgatgatgagatgggaatttattatgctgcttgcaagccaagaactttgagagagggcagaaaggtcaagtaacagaatcactcagaggaaacaacacctgagctgaaaccaagagacaaaaggaatgtatttgatttacaggagaccacagagaatatggaatccatagcagagggtgttcaataaatagggaacttttattattatttctggtaggcccagtgatgggagatgagcatattggaggagaactattgatcagctacttgtacgtatgccttatgtccagatttgagtatattagtttagaagtcaccaaagacagcctgaaaagattggcatttcatgcagaaacagaggcaagggcaagcacacaagtgtatagagaggtaaaaaagatgacacaggaagagaggaaaaatgaaaaagattagttatataatatatatgattagtctgtgagaaaaaatattacaaagcgtaaacaggaatgttagcaagaggcaaaaacacagcaacactaatactaacaataataatagtaaacactaacaatattaataaccaacacttactggagtgttccttttctgtgtggcaggcacctgccaactgctttgcactttacatgtgtcaactcattgactctttatgacatctcatcctacagggcaatgtgataagatcaatgcaggtatttctaactactatcccaaagcagggattcaaaactaagatctcgtgaaacagagcaggaaaagtagactcccactgtatacactgagctggaatgcaaggcagatgttacatttttttttgaagttggcgccacttgcatccagaatataagagatgctcatttaagaggaaataaaaatgaacaatggaatgttagaaatgtaagtgaactttgaacagatccatctctttctgtgaaaaaagaagctgatgacatgcattttggatctattacttaacttgaagtatggaatgaattttgcagcaacagaatcagcatagcaaggaattttatgttgctgtttccccagtgcatttgtacaatgtttcctgttgtacttctgctggtgctgcctttacatcaggaagaactatactcccttttccctggagtcttagtatcaatgaactgacaggaggaaagcagcagtcaggatgtatagagaagtttcttacttgccaaggggagaagacagtatgcaggccctatctctgtccctctgagaatcctagatttaagctggcaaaaaaaaaaaaaaaactgtcactggagcagccacaacctcagtgaactgctcattagtttaagaccctctgttctgacgccatcctctgttcgtctgttttttagacatatgaaaggtactctccgcctgcagcagagactgacagtattctccccaatatttcttctacctatctatcttcctctgtgggaaggaatgtattaatgggtgagcgatgagccaagctaaaatcctccagtttatagtctcccttgctgatggaatgaccaatgagatgtaagtaaaagtcaatggagagagtctcaagggaggaatggagtgtaatgactggagcaccaaactcttccttgcaccaggaggatgaaagcaacacattcaagatggcaaagttaaatgatatgccagggcaattctgatataatttctgctctggacatctcttctgggctattttacattaaagaaaaataaaaaccctaacttgttaaagccactttatttgacctttctgtaatatgcaactaaatctaatcctaacacatcctttttccagtttctttgtactattcctaaactattaggagtggccattaaaaaaaaaatgtgtgtgtgtagtaggcaagatgcaaccattccttcttactttgtttataaagggaagtctttttgataagtagagtggtcatgtacaccacaaatgctcctctgcctggccaacccaaatgccttttatttgctataatggaaatataaggcataaatccataccctatccttcatgtaaggcacaatttaaattttttgcatcttctttctttctcagctgtatctgaggcatggacgggggatgggggaagacaaccagctctttatatgctgctgtttccagatgtgaatctgtaggctcatgccatttctttaacatccttagagcactgtaactggtggggatatgagaaagaactatcactttttggtgaacttggcaaacatagagtctctccccctttggttagacctcaataatttctgtgtgttttaagatttccaaagtgtttttgattaaacaatttttttctatttttctttctttctttaaaaattttactcttataattttaaagtatataatttgttgctcatttgttgcttataatttgttgctcatttaaaaaaatattattattctcttgtaggatgaaggacagcttggtaagagggcagggattttcatggagaatagaaatggaactaacttttttggggatttgaacagtcggtgaaatagcagtccaaccagattaaagaatctaggtaacatcatgtcactcagtgggcccaggtgccacactgaccctgttagtgatcaagtaattatttctctggcaggggctagagaagcccttctgttgggtggtcctgacaactcagaaagctgctgtatagaatagtagtccacccattcctttttcatcatcacctctgttcatcccctcccacacaccaagcacaaaacgctttaattactctctcaattatggcttcaagggaacatgatgaagagataagtgaaagaatttaatagcaagtgagtttgaatttcagcatttttatgtataagccttgtgataataagcaagatttgaaatgtctgcaagcctgtttcctcatttatataatgctaatggcaatctctcttattaaatgttaaataaaatatgcaacacacatattatataccctgttcacatttacaatctgtcctgcttatgaaagcatttaagagagtactcacagttggatctctggcatcctacacattgcttggtacacagtgctcaacaaatatttgctcaagtttgaatactacataatgatctgttgaatgaatgatgctaaacctaatggcactgctgtgagtgctggctgaattttctttacgtaattctgttctatattcaagctaacattgggcttatttcattgtacagcagccatataaataagtgaccatataatttatcatccaaaccaggacgcttctgagagtgaagaggggcactactaataattactgtaggacaactagtataaatttggactgtcctgagcaaatggggacatatatgtgatcaccttactgaaaggcacatggttctttgtttgatcaattgatcaagatcacaaatgaatttgtgcttatgtacacacaggttcaattctctcacagtttaaaccaaagaaactgcccaaacattgtataagcataccttatattgtacaatgaatttgtacctaaacaactgtgtttactggacttctaataaatgaatgtgtgtctacacgcccatgggggcattctatttaaagattcttcaagctaaaccatttttaacatgacaaatttttctaaaattctaatcatcaaccctacctcccacctgcaatcctgttacccaatttacttgccttattcataaaataaaatgttattttctttggttttattttgtgttttccaaagcaatatacattttaggtcagatttttatatgaaacatgtcctaataagtatgtcattggtcaattagtcaccgcagacccttttagtcacaggaaattttcactgtgatgataaacggaaatgataaaagactgctgctgtacaacaggaaaagtcaattccccttccagttaacactccatttatctggatgaccacagagttaacatccttctgcccagtacaactcaagcagggttgtctggaattcaggttgcagtgtcaaatggaccctgaagcttctttacttcatttgacaacaattgtgattgttttagcagttgagtttgcagaatgacttcagtaataccaaagatgggtctgaggccatcagcagtagcctcggaccttcagccaccaataaggactaataataaaatgaaacattggttatgttgatctcaattaggtccaagataatgtattcctagaaacaccagggcactacaattgctggagcctggacaactgtgaactgcccagggggccttaatgtttaatgttggagggttcaggaaatctttcagctgtaacttttctaagggctccctgtttatcctgtacaagctgcaaacacagaatgtcactttatagaaaaagttcaaagtaaacccaggttctgcgaacaaaaccaaatatcccacttgaataattatatacaataagcagtaaaaaaatactgtaacttaagtcagaaaatgcagttcaggctgtgttagtcactagctctgagatctcaacaaagcttgcttacttctccagatttcaattacttcgtatgtaaaattaagggattggaacagatagagtacagattcttttcataagtaacatgctagaagtgagtccttagacctttaaaaaggtagaaatatagggttaggtaaatacacattagataatgatgttgccatggttccactctaaagagttgatggccaagaaggaaattaattcaagacttaagacaataaaaaacagaattcagctatttcatatgcaacagcttatttttagtataaaaatacaaggtatcatgctaccattactgtaatacttttttcaatttaaaaataactgtctggtaaataagttaattatactcattggattactctacccacagaacagtaatgaaagtccagcttctcttgtagactaactacaacttggcacactatccctcagcaaattgtattttatgctttgtccacaaagtagattatatttctgtggtgtaagatgggatgagagaaataacactccaaggagttaaatatcttccttaagattgctagaacttgatataatactcccaggttctatcactcccagttagtttgtttcaaattttagatttctttggtggaagaatcaaaataacaaaactggattttgttaataaacagttggggccacatgctttaggaatattgagcaaaaacattctactctactaacagtagaaaacaaatggaaactttttcctttaaacttcccatcttataccacagaaatataatcgactttgtggacaaggcataaaatgcaacgtgctgacggatagtgtgccaatttgtagttagtctaaaagagaagctgcactttcattactgttccgtgggtacagtaatccaataatatgcaaacttattcttgggctcctttctgctatagagaaggatagatagaaactaagaatagaaggaagtaaaatgaagtatttcctatttattctatttgaagtgaataaaaaaataatatgggttagtattcacttgtgaagggaaaaataaatttaaaacccaggatgaaatagagattggattttaggaaagcaagtagaatgataaaagagatggatgtaaagatggaaggaattctcaaagccctttttatctctttgtctttggaagcattgatccacctatacagcatatgtctcactaaattacagttccataaacaaataaatatatatatatataataaaaacaacacagaaactatgtatgtgcgaataacacttctgcccagtgatgcatttgtgtatgaacacggacttatcctgagtcctgttttatcatgggactgagacaactaattcagtatttggagaaaggcaaaaataacaatggacaacaaaacaactataacaccaaggctctgagttggtgttctgtcactgggcaagataagtttcattcattgtttgatagaaaggccatcttattgcacttatcgaagcactgatccctagtcaatcctttgataatggcttgagaagtagcagtttaatacaactactcaaattggtcatatcatgcccactggctaatagggagatgcaatttctcaatgaagaattaatctaattcgtcttgactatttttgaagcaaaggccttgaactacattgatgatttatgttgctgttatccatggtgttttcttgcctttgctttgtttttatttaaagacagtaggaataactattcatctcctggatagtccgttattttctgcatgatattgaaccccacaggttcaggatacacaaataatgtcctcctgtatgtgtaagaatctgtcctaagtaagtggcagaaaagactattctattaacatgattttaaaaaataaaaatgaaactttggtttgctatttgatttaaatgtcttggcaatagtaaactaatttttttgttttgttttctattcttttatgaaacgagcattttgggcataaataacctttcagagtcaggtaaattatttctggggtttatgacatgctaatatgtttccttggatttcctgagtccttctggtgttattaagtgttgtcattcattctttgaacactacttagaattgctcactgttcgctcaaaggtcatcacagcacttaataatttcagaaagagataagcaggacagaagaccttatctgtatatcaaatgtgagttcatgtgtgacctactacaccagccaaactgctgtccctatcaatcctatctccacctcatcttatccttgactgacacagcactggataagaacccccacggtttcccattctcatcctggcttccaagttgattccctgtgtaacgtctgaccagccacactctacctagttctttattttcttccctcaagtgggaaacctgcctccatcttaatagaaaactgagagaagtagaatattcatgtaagaagcatttaaagagagatcataattacacatcaatcaattcaaaaattcaaccccagaaatacttctgggtttgtagtcttagtccaagaaagaaaaaggaaattaaacaacgaaacaactttaacaccaagactttgagttggcattactgctctcttggagtaatctactttagaatatggaattatgatctatttattttgaattcacgtaacccacggtaggaagatgtttgaccatgggttagaggaataccccagaggaccaccaagagaaagagaaagaggcatatatatatatatatatatatatacacacacacacacacgtatatatgtatacatatgtatatatatataaaatttttattttgaattatgtaattacagatatatatatctttctctttttctttctttctctctctctctctctctttcgctttctcttaatggtcgtctgggcttattcttctaatccacggtcaaacaccttcctagcatgcattggtaaaaggtgtttgaccataggttagaagaataaccccagaggaccactaaggttcctccaagtttaagattctccactgcttcctatctgttattttccatttacagcacttctcctctgtgttctcattaaatgttacctcttcattataaattatttcagaggagttttctggactgttctctctcacatttaggatactattttcaaagttaacatttccccctaccccaccttctaactgcctttgaacttctctctgagtttctatgcttggttcatgtgctagaatttggcaaacatatagtttctattttaacatgattacaaataattgttattccattgtgtagtttgtacttttgttttttcattattatcttcctgcttttgtcactgggatttaggtaatggaagaataagtaaatgacgggagctctccagagttgggaatacaaaagaaacaatgctcataaaactgttcattttctatgtttcaaatgttatctgactgaaacgaataccactgtattatttatttttcattcatttttttcttatatctttttctaatgcctaaaatatgggttcacatgaaataaacatcctcaaaccatgtgctataatttcagtaaatcatttaaaacacacatattgaaggtctacaaggtgctgaactaagatttttctcatccctccacctacttaaaactatggtttaggtgaagttaaaataatgaaacagtgagacagaaatttgtcactggatttggtaaataaggtgttttacttccttggcttttttttttcttttctctttttggttaaaccattttccaatcaagggcaatctaggcaaaaggttttgtgcctaaatgcagtaaaaataatttgaaagaatgatataatttataggcacgctgtagtctttttccctcctcaccattaacaaatgggcaaaattcatctagttcatcaggtactggtgtagttatacataaaaagtatatttttataattcagaggaataacatcgagtaaaaatagccaaaaaaaaaaaaaaactgctgcccagagcaacttttatttttgtgcagcttaaaacttttgttgtctttcttataaacacggccacaaaggatttaaaaataaataaataaataaataaacaggctcttgctctgtcactaaggctgtaatgcagtggcatcatcatagcttactgcaaccttgaattcacacacacaagtgattctcctgcctcagcctcctgcatagcggagactacaggtatgcaccatcatgcctggctaattaaaaaaaaaattgatagagacaggtctcactatgttgtccaggctggtctggaactcctaggctcaagcaatcctccctccttggcctcccaaagtactgggattacaagcttgagccaccacaccctgccccaccgcccacatttttgttttctctattcttctctttaaaataatgtctaaaaaaattatgtttaagcaaccttggtcatttttataggaaaaatccaattttgtgagtgtgtgtgggcattggggggagtctataatttaaaagaaacgttatttacctaattaattattaagcatgacaacaatagaaaaaaatcacagaatttcattgcattttccgtttttttttaaacctcactctttaggtttcatagactgctgcagaaaaattgtgaaagccaaataatattcttcccagacgtttgcaggcgggactgtgtgtagaaattcaaaatctgcttctcaagaagactaaatcattgctagcaataatgaggttgtctacactccccttctctcctctcctatatttccatctctaattcctacttctcttctcccaatttgagacctattcatcaattaattttatttccataaaggacaaacaggtagaagatgtagtaagtgatagaatcattctatacgtaactgaataaaaccaaatcaggggaagatagaatgggtgaaattatgtaaacttttcatttcattatgtaaattacgtaaagtttttgaactatgtataatcacatgcatgaggagacagaaaacaaccttgaaaaacatgtttcaagggtgactagactgacaccaggctatgttttaacattagcactaattgatttgatggattcaacaggctttttcttgttggatgtttctttatattctaattggtttatactttaatacataaaaaaatcttgtgaaaaggtgcaaagagagaatgacctttaagtagtaaatatctggattggaaataaaacaaatgaacccacctgcttcattatgttataggtgagtgtgcctctgaaatcctcaaaaactacatttggaattcaaaaagatcagtctttgcacaattagtcaacattcagaacgtatagattgttttaagaattagtttaagctggaaataaatatagttcaaaaatttagaaatttcataaatagcaaacatacaaagcattattaagaaaacattgtatgttctcactgatatgtgggagttaaactttgaggacacgaaggcataagaatgatacaatggactttggggacttgcagggaagggtgggagggaggcgagggataaaaggctgcaaacagggtgcagcatatactgctggggtgatggatgcaccaaaatctcacacatcaccaattaagtacttacataaccaaataccacctgtaccccaataacctatggaaaaataaaaaaaaagaaaaaaaaaaaaagaaaacagggtccttgcaggagatattgaagctaaaagattgaagtctgcaaagaaaacccataaaaaataaagtgtgagcccaaccacatggggctggcccagtaggacaattcttattgagagcatcctagacaacctgctgagaaaggcagacaggcagtgaccgttactgaatggaccaattaacaagggtccctaaggaggggctttggaatgaacagtattgcagtgcactcacgtttctcaggtttgttgacagtcatgattgtggcagatcctgtctgattataagcgagtacacatggagcagaagacagagctctagatgaatcaagaacagaggcagtagtggcagtaggacactcagtccatgcatcaatggatacctgagggatcatcaaacaccataaaatagaacatggcctctgataagagatgtcaaataatattagctctgtaaaaataaattaattataaggctccagtagggagtttcatgtggtcagcatgggctgatattacctaattattatcagctaaacttcttgattcagataattagctgaaatttccaagtatgtagcaccactctaggcataagaatttccagggctgtttggtcctaataattgttcaacattctttgaatataagaattcatttgctcatcttgtgttttttttttttgagacagagtctcgctctgtcgcccaggctggagtgcagtggcgtgatctcggctcactgcagcctccgtctcccaggtgcacgcaatttctcctgcctcagcctcccgagtggctgggaccacaggcgcccaccaccacgcctggctaatttttttgtattttttagtagagacggggtttcaccatgttagccagaatggtctggatctcctgacctcctgatctgccggcctcagcctcccaaagtgctgggattacaggcgtgagccactgcgcccggcctgctcttcttatttttatacatctgtttaaagagtgtaaccacaatctgcctacctatttaaatactgcatttcagagctgtttaacggttacctgttgtaaaggttgtggctgtccctggacaaatatatcgattatttagagaaccatgagagactcagcctgctcttattttcatcatataaaagatgaaaattatgtttgctgcttaataaaagaaattgtcctatcttttagacacttgcatattagtactgtaatatacaagatgtcactgcaatgtctaataattactgtaacactatttaacattatctgtacaagatattgtgctgatgaaactgcacatttaggagagaaactgaaagcaataatcctataataaaagtgaagtgtattaaagagggaaagcactattactacaggtaaaatcctttgagagtgctcttatttataatttagtcctagcaggacaacccttctgtgtgctgattatcagagcaattctagctttggggagcaaaaaatgtcacaaacacacccggaagctgaaataagcttttcctttcatgtgatttaagagctattgtcactttgtggaactctaaacattattccattcaataattcggctcctagattatatattgtctaggtttcctcttcctgctatttactactaaggacatttaaatgaaactattagctgatttttttactgcttgttctccacctgaagttattatcctcaattcataatatcatactcatctgcaaaacaaccaagcaggaacataaattcagttgggagaaataaacaagagaaatggaaagcagaaaaagccaggaggagcagggtctctgatgggcacaattatgactgttttcatctttaaattgcagagtttactttagctttgaagtaactgaaagttacttccattgtgacataactgtggccttagataatgacaggaaccccttttgtgtcatgaaaatatctagtaaagttagctcttttgatgataatattatccacgcttaatgtgaataaagttaaaactcaacacctagcacattgctgttgctcagtagatttttgttgaatagatatttgataaatacaattttattaaatagattataatggatatctgccaaattaagtgttttgttgatacttttatatttactcatctgtctcaaagaagatggatagctatgttagcctaaagtcacctgctccaagggcagccaaggaaactcctattctgctagtgccctgggagaatacatatgtagcttcattctataaaactatcggcaagtttatgtacctagtttttgctttttctgtaggagaattttcattaacattctttttgctagtacttgccatttaaataaaatttggacatgaatcacaggaatgcattcaccaatttttcaatcctacattttaaaagtatgttaattctatgtgtccctgggaaagagagggacagagggagccctgagagagtgagagagccttctgtcttgccctcaaacaatacatatcacttcttaataaattaccagtcacaaggagttcctctttagaggagaaagtacaatcacacaagagcactgcctaaagcaaaatggcctccttctcactgcaaggcctgatttccaactaggctttccaaaatgatggcatgccctggctactagctttcttggctgtccagaaagtatacttctctccttgtataaacatcacatcttcaatataactctagtctttgactaaagccaggtgtagaagagtagggagcctattctatctactctcatgtgaaagattctctacactgatttttgcttgtgctagtctcaaatattgaaaagtggtacaaatttttcatatttggaaaatatgtgcttgcctaaagaaacaatattcttggttattatattttattgcttgtaattattgtagacataaaattatgttcagtaataatactgtcacatgtagattgctgactgctgagtatatattatctgtattgaattttgaaaatctgttttcatatacaacataaaaatgtcattgaaaatgataagcattttcccaaaattccaaaagttaatgattattgaactctgctataaatgattttcatatgtcatatgatagattagctgcacttgcccattttttcaatgtcaactgttctagtaaatgttaataatacattgaaaacatttactattatttaagttcaataccagttaagaaacaatcattaaaaaatccgagttgggccaaatattatgtctgtaatacaggcatttacatgggattattcacacataaaaaaataaatactggtggctttaattactgatgatgcttgtaaacttttcactctggtgtaacgtaagagaaaacagaatctgatcagaaacatttacaccatgaagacaaaaaaatagaaagtacagtagtattaaatcaatacataacaactttttaatcttcacatatttcaccgaaatcacattagttcccaccatgataactgagtgaagaaagcatggcatatattttcactacagagatgaagacatggaggttctgagcaatgaagcgtctcaggatcacatgacccctgagcagacctgaagagacctgaactcaacttcctgagccttagtcctctgctttctttcttgtattaaactgagaaagagggacattttcaaggacttggcgactgagattttcaattgatatgcaccacattgctctccttccctaaagcagcttggctgcgggtcaggattcaatcaactgaaaacagacccagtattggcatctatttctatggtgctggccagggagtttttaaaatgctgtgctattcgatgatacttagggcctggggtttctgaacaaactttcatagacttggaaataaacatcttctgagaatgtgatttacttacaggagagggcaactgacagcatttgctaggtgactggctaatatccaggggcttctccttctttccaacagtcgtggttcactctatcatgattctcagtttgttcttctctagccagtgaaagtggccattcggcacaaacttaagcagtggattgcaagtaacatgctgcctcttacagaaagcccagaatagtgtgatagtttttttctgacataacacccatctaatgagtaaaagaaatgattctatcctcaataaactggaagacattgaacacacaaatgaaaaaggaggagaaagagaaagaaaagggaaggaaagaaaaagaatgggaagagacaggaaggaaagagtgaaaggaaaatagatgcaaatgatagaataaaggtgaaagaaaaaccagcagttgcaaacttggaaaaaatacaggcatgagagctaagggattcctgaaacaaaggaagacatgaagtacagaaaattagaacagaagatatttgtgaaggagaattttgagggtgtttgaagaggggaaaagaaggacattaaagatgtatggatgccgaggaatagaggcaggggaggataagttatatctcctttgaaacttttgccttctatttttcaagtttcacctgggctgacatcttgctgttttcaaagagaagtgcttattagaaaaattggtgagacaatccttagtataccttcctttgcattcatgacaattactcattttataattagaaagaatgacagctatcataactgataaatgcaaacagaggagccatatttcatctttacaactgccagattcagacgtggtagttagaaggtgcattaaaccaccaactgtgaaaataaacatgatgacaccaccttacagaacttagttgtgggaactaagcatgactatgaaagcatgttgtaatatagaagatacacaaataataaaatgctattactattattactttcagcacaaatacaaatctaagagcccatctcttcatgttaaatagatactcttaaatcaaaagccattagttatcttttgagaggaatatgatttcatttagagtgtcacagcattctgaagcatattaccctcctccccacatttaaagtttctgtggctgttgggtatttccccacgttgtctatgacatattttagtactaaccaacaaatgttagttacactgacatcttgagaggtaccaatctgaaatgaaaacatccatcttcacattaacaactttttaattaaccttctgacactgtcaataagaagtttcactgttgttgtggaaagggatgctatttaagtgattacacatgtgctgctgctttgtttattttctataagaaaatcaagatgctctttaaaaacatcttcacctgttactaaaagtgagggtaattttggtaaacttccatgctcggaaaacagactgcgctcatgctgggcaggacttcattgaaatagtgagagtttggtttgatgttacaaggacagagggaaaaatgcagaggaaaggggatagcagtgactgtcagagttgtttgcctttgatttccctcaaccccagttttgtaagagcaagaataccatgtaaatatccaaaatatatcttggggaggcagccccctggaaacagcttatagttttaggatttgaaaaaaaaaatctgttcttttaactagtggcacataaattcttcattaaaagtaatttaactgacatcagtctgtcattgtaacattctttttttcttaatatgttcttttctttgaagcatctccttgtgaaacacgtagttgtgatatacctttcttaaatggcttcagtgtagcagtaataggaaacacatcttccatgtcccttacgtagtctctatacatggatgcctccagtctctcaatcccacattttctgacatgtggattttaactataagcagacaacaacggagcaaccacagcaaaaaatgctctggaatgtaactaagctaaggatgttgtgatacatctttttatcaaatagaaggtttcccattaacttaggaatcccagtgatactccccccaccccccaaaaaaatgagaggctcataacccattttacagttgacattgagacctaaacagaagctgatgtctttctgctaggcaagacaaacctgaggcaaattcatgaaactgctgtgctccttgtcagtgtccttctcagggccttactctctcccctgtctgtctcccagcaaggtgcttcttaccctcatcctgctcttgcccacccatgaccctatcaagattccataacaagttgcccttccttggcagctggccaccttctataagcatctccctgctctcccacctatgacaggagggtagtactagcagctgtaacagtaagtaaggtaaaacgtttccagttcttcttactcttcctccctccccaaagtcccaatcccagaaaaatgatttagaaaagtaaagaaagagaggaaaaaaaaagtacctagaatttcagaaaaaaaagaagaaagaaagaaaggaggaaaagtacctataactccagaattttgaagtacctagttacgtgttcatcggtgctatttgaagaaatatatgatacaattatgaagataaaataaaccatgacaagtatacagttgttgagtgggaagaatgggagagggaaataaggaaaaggcatcccttttccctgactgaattacactttagcatgagatagaggaaaaaactattgactaatatggcttgacagtttacttttcaataaagtctaagttttgtgcttaaagttaccttagggctgactttttcttatctaacctcatctggctacgttactttagggctagctttgtattatctaagacagaccagaaaattcctggtcaagggcataagagaataatcccagtgaataaattttaaagagattctgggaatcaaaaaataaagatggcttataatgaaccctatgaatcttgtgttttgtaagagccagatggaggttgtgacggtatgtgcctaatgaaaatggcactttcctcctcagtcctccttagtttttatttttcttccaattaagatagtctcaccagcctgggaaacatggcaaaaccccatttctactaaaaatacaaaaattagctgggcatggtgacatacacctgtaatcccagctacttgggaggctgaggtagaagaattgcttgaacccaggaggcggaggttgcagtgagccgaggttgcgccactgcactcaaacctgggtgatagagtgagactctgtctcccaaaaaaataaataaataaaattaaaaaatagtctcaacttatttctttgatataagtttgtgattgttttaatatgtggtcaggaggagaagaccaggatgcatgtaaaaaatattttcatagtttatgacttctaaaattgaagatggtaaaggtgattaggaggctgatgattttagagcccctccactaagagatctattgtttcatgcctgaagttgcttacctgtaagtcatgttccctcttgtagggcaatttactaccttggtgtttaaattcaaagttctatgccaaaaaataatgtttttaaaaatatattaatctcacacatctatcattatgaaaccagtatagttttgtgattcttttttaaaaataatttttgtctaggagataatgtatacattctttaggcttcaaaaggaccttggaaggcatgcaatttgctagtaatgcatttgcatgattctggtttaacaattaacaataaatttcatcatctccaaggctactatatcatagaagctgtggaccatttctcagaaatgcagcctatcttctttcttcccaccaggtgaaatctctatgtttcacccttaactccaaaccaaggcatttacactttttggtattgatggaaggataaaccctgcatttaattccttgatggctgtcatcctgctgtatataagacagcccaccaggaaatcacttctatctcatgggctctcaatccaaagaacacaaaggatggtttccaaacttcagaatccttctaaaatgaccaattccatctgaaattcaactacgtgatttctaaaaatgatcaagtccacaagttcatccagaataccaaagcatctagttgtctcttcatcagtgctatttgaagaaatataaaatatgacacaattatgaaaagaaaatatacaatggcaagtatatgttctaagacatctttgcattgtggtgaagtacctttgagtagtaaatgactgaatgatgttgctactttcaaagacaaataacagaaacaacaaagaaagcaaaggtctaaatctcaaagtcaagactgaaatcgttgatcactacgactggtttgaagcttgagtgttagggctggctcagctccaaattggctgagtggttctgaactcccttcaacttccccatccccatttgcaccaggtgatcttttaaaatgtaaataatcccatatcactgttctgcaatggcctcccgtcactcatggaataaaatcacaacttctgattggcctatgtctctacaggaggtgatcgagacctatcttcaggaaccccatctcccaccagactctgtctccctttttctcttatagatatatgggtgagtctgccaatcctcaggcagcccaagcctatccatgccaggtaaccttcgtaaatgtcatttcttctccctggaatgttttacctccaaacttttgcatggctcattccctcttctttcaggactctgctctaatgtaactgctcctgagaaatgtgtatttttttttttaaaggatagtttctaaaacatctcccattccttgtgctttcattttcatcccagaatttatatagaaacaagtgatggtatttgctgtcttttctcattagaatgtaaaagtcatgaaaatagttactttgcttccaaactgtggcattccctagtgtctagaatcaggctaggtgcatagcaagtgctcattaaatgtcaatggaaaataaaaagaaatgccttcttttttttccttccactcctcaccccactacacaaaacagttagttgtaaaacccttaaaagggaaaaggcctgtgcatttggtgtgtcttaggaatttgggagacagcgaaactatgtgccactccagggtagtttcattggggaagaggcctagaaaggatagagttgtttaaaagagaaaacaggcttcatctctagagcttacaaaaaagaggacaaagactgtgggggagccagtctaggtctgagacaaaacccagaggacttaactgcagaaagcttcctgtggttcacagtagtcctggactaactaactttgaaattccaggaggagaagaggggcatttgaggcaatgtccttcctatgtcctagggaacagggaagctttgcaatgcatatggaatatactctgcagctctggcagacatcctgccttgggaatgactttcttgcttaagccaaagaccttgaaatggagacctcatgtgtaaatatgtgcaaatgttgaactaaatttatcccataaaatttttaggaaacaaccttgccatggatacaagctgttgaatacattatctgctggggttaacagggtttccttcagcagaaataaataaattaagaggaagcactgaagggttgactactccagatttgtctttaataacattccattaaaaatgatggaaaggcacagctctcatagcaattcaggctcagagtgatgctgttctctttcaggctcatgtcctcagatgaggcttctatggttttaatcacttctcttcctctaactcaccctcctccagctttttatccctttcattttttggtctgtctttccatctatctgactacggctcatttaccttgattagcagaggaactggtatcacatttttccacaagaactagtgattttaaactatttagatcaaaagttacacaaatcatctgtaccatgcaaaagcagaggtttgttataaaaaattatgtttggcatctagcaaatttttatcagtagaagagcctactattaaatattaatgtcattaactttttctagttctgcattgcctacctcccataccatgtgtattatctctcaagttaaaaaaaaaaaaaaaaggtaactagggcctaaaaggtctatggaaaggacactgccatcaccagctgtgactccctcatccctttctatctataaccatctagagataaaatggaatattcctctccagtctctcattgcttcccttgtaatagccacttatggatatagcaagaattggatgaagttggtagcgctttcttggaaggtttatatgtaatttttttaaagttaactgtttaagacttggtgatgtgtgtgtgtgtatctctgtatgtgtgtgtgtacatgtatatggaggatagtgtgtcacatgcagagagagtcataaatgcatgtttgcagctaacatgttggcatggttttgcattatggagatcaggtcaaaactgcttagcactcctctgtgattttcccacctatagctctcacaatgtgaccctataatatgagaagacgcactcccaagcatgaagacttaatttgcaatccacacaaatccctctgtccaagtgggttgagggcataataatcaggctctcatacagtaatgatgagcgtttgtgcattcggaagagcagctgcctgtaaaatgtttattcctttttgtgtgtgttaaatctggctctatcacttactacagcttggtggatttaacatttcctaagacaaaaaggtaaagagtaaaatattaagaattctgaaagcaaactccactagaagaataaacctgaaaaagataaatgtagaaaaggaatgaaatgttaaaatattctctccttacctaatggaaaaaatagaaaccaaaataaatggccatttatctaactttaccaacctcatcaccagcatatcccaaagtcccacctccagtttgatcatttcatgctccaatcattaacctcacaatgcagatttctctgcctgctcttatagagctgttagtttgccctcaacaagaagtgttaatgggcagcctccctggctaagaacactgcacaagcctcagactttatgcaattccaaaccagcttgcttagactcaggaagcatgatatttcctctccatttctaataaatttgaccttgaaagaggacagagagtgctgcctctatagaagggaggcaaaaagatttaaaaaaaagtaagatactatgaccatatcaaagaaggcaggtatgtttcttttctttgttttagagtgaaggaggtagagcctatgatcctggtgtcttcagtgttttgtttatattagatggaacgaatagggaaaagagtaagaaaaaaatgcaaactaaggcacatggaggtggcactcatgctctctttggagcagaggtaaactacccttgagcaccatccctgtctttctgcccattcacatctgctgctgcttctgttttcctctctgaatggattctcaaagaaaagacagatgagagaaggtatcgttaattgtgggtaacacagaacagttgttagagaaatggcagaactgccatttagccagtgcctgctcccccatcatgaccattacaagcaatggattaaaatgtgtgttcattgcttcacatatggttacttttacattgttgattcttcactggggacccatagagtgaagatcggtgaaacttctaatcttcaaactttaaaaagctgatttaaaacttcattccatttatgctgttctctccctcacaaagtcagaaggtttcctgtgatgacgtcccgaaaatactgagagtttcaatttgctaacttccccaaacatgcggtatctacattttttcccagccactttgatctcttgagtttacagcacagcactattcattttcctggcatagacagtgagaatttcttttgctaccaaaccagctggtagaatgtttttcataaggggacctcaaacaatagctgtactcttccaaaactgtcttagtatttattaagttatttcaataccaaagagagacaaacagtatgccagttcatttgagaataaatgaagttcaattttttataaatgtttaaaccatttcacacatagtaaaaccagatctgtgctttcccagttttaaattccatgagtttattagattggcttgtaaggatttatgttacaatacagtgcacacttagagatggaaactgaattcatagaaccatgagttttgtttatttatcatgttttataaaatttcatgagagaaacaatcagtagcatctatagcaatcagagaaagcctaacacaaaagaaaacacaccaatttataaaagaaaggagtaaatcaagactggtatgtctctgagatataaataagcagttctcaaaaactgaaggtagggactttcattgtcaaacatttgaaaactgctacacattttattttattttttagatattcacaatgtaccataacatatgaaaggctctgaaaagccgttttcctaaaacctgtttaatttgcttaatttgtttaaacagcaatttctacctgtatttaacttagaacaaatttttttttcaagaaaacagaatatccactaacatttacagcatgccttagtttgtcataacaaacttagaaaatgtttgattaggtcaatggccaaatggtgctgcaaaggctgctgaggacccactgactttgcaatcaatttcccctacctttctactctgttccttttatatatgccactgcctaactagaggcccagaaaacccttctatctgaccttttgtaaagtcagagtgcctcggtggtaagatcctataagtgaaatacatcattcaatagtcactttgtggcacatttaaatggaaattttagttcactgtcccagcacaaacctgcttattaagtttttaattatcaaattggccatattaaaaattaactcgatatgcttatcagtttgctacaaagaagagagtcactcacgctatcttaggaaaagaggatttattgtaaagacatgtatagcctgaagctaaacctggattaaaaagctatcacagtacaaagcagctgtatgaactagttacttgcctcatctctttttctctttggatttcctctattttctcttttcattagttgctggcttatcctcttatatttcctagcataaataccagaaatggctactctgattgattagtaaatcattaattaccctattgtgtagagctttttgtatcaatcaatctgatgaattctagaatggcacctttgagtgggtatacaactccctcatttagtcaaaaagatctctaattcaagtagcctatggtgactttcaagaaaaggaattggagtagtagcattttagtttataggagacactgtatgtggtagtttctttcaatgtcatgtccctgcacactgccccttcttacattgacacagggaaaatattaaatttcactccttatgttgtaacacattcaaaaacaagtggatattaaaaattgaaatctgtaagttgaagaattcccccccatcttccccactacatatgtaaaattatctagacataaaagtacttttggctgggcgcagtggctcacgtctgtaatcccagcactttgggaggccgaggcaggcagatcatggggtcaggagtttgagaccagcctgaccaacatggtaaaaccctatctctactaaaaatacaaaaattagcctggtgtggtggcgtgtgcctgtaatcccagctactcaggaggctgaggcaggagaatcccttgaacctgcgaggcggaggttgcagtgagccaagattgcaccatttcactccagcctgggtgacagagcgagactctgtctcacaaaaataataataataataataataataataataataataataaaataaactttcctagttgatctttatgcctctaacttatccttgatataatcaatcagccctattgtctgctattaaattaatcaaattaataatggttaagacaagccaatgttctcttaaaaaatctcctgtatctcttcttgcacacatggtcccatccaaactctaaaatttcactgaagatgcttcatattctgactctgaactacatctctaagtttatgcaccccttatgtccaacaagaaactgttaatcttcgcaatggttgcaaaagacaccagtcaaattatcatgtttatgtcttttctcaagtcattatctgtactgggcttgttcctctttgtctccttaccccaatctaacctacttactcctttgaatatatatgctccaacttataaatctgtgcctttctaattagagttcacatatatggataggtgaattggaaacaaaattgaagagaagataacagtcagcttagattttctgggagtatagctaggtctttgaggactctgccatatggtttggccatatgggcagacgatgttgaatttgaccaaaagcactggcttagaagtcatgagatctgggctctaatcccagatatgctactaacaaaccatttaaccttgggcaagacgcttaacctccgtgggtttcggtatcttcacctgcaaaataagtgctttggcctagatgatacttggaatgttttcaatttctcatattctatgagaccaggatagatgttttgttctaattattagttggcttcaactggtttgctacagataacattagattgggaaatgacctgagttagaatagggggtagggatctatctaaactttcacttcagatctataagtgagctttgatggtttctttctttcctcccatatggcccaggtgtttctgatgccccattgtaacttcccacactcatcatggctttagattgactctaaggtacttgaaacattggcagtgacccccatttgtaaaacagacacatccattttcaggccacactttagaagttgcataaacctgaagtttttctggaaaaataatccttaattcacacaaagaagtgcccagcagagctcctgtttttatagagaaatctgccaggcaacaactgtttggacttttggtctttatctcttttcttattctcttcttcattactacaaatttcccaagctttaagatcaccactcagcaatcatcaacataaaatggtaccactcgcaaaagatgtacaagaaacagtattttttcacctgactttcagagcagtgagttaatttaaaatttatctttggtaatctcccctacttcttttatttatttcatttctgcagtttagatggaatgtacattttataattaaatacaagtaggaaataatatcacactgacaaggctcctaatctcctcaatatattaacagtccgtgcatcaagtcaactcatctttaatcctgggtctcactacgcaaaagcagcacataagaatgaaaagaagatgattccagccataacttctcaaatggtgatttcaggacaaaaactgtgtggaaatgatgtaaataaatcattaataaataaggataaatgacattgtataaatgtgtgctgcctatatcagagggttagaaaaaataccactaggaaacagaaaatcaggtctctaatctgaacccagccattatttaactataaaatcttgagcaaatgcacccagtgaattttccagggttgtcctgagaaatcaatagggcaagggggaccattggagtttataatttgtggcgggctttacaaatgtacgattttgtttatagatcttttgttcaactcagtgtacttgatctggcctcctgactggtgatccacagtatcaaaattaacactaaaaaatgacttcacaaatgattttggttcccagcctcatttgccatggaagataactgaagctcgcaaggttaaatggtttgctcacatagtttctttgttgtcctgaaagtgttcattcagaacacagtgaacctaagggcatgtaagggtaaaactcaaaataatatgaatgtgcaataaaccaaagactatcccattaaccttttttagtccatatcctgtgggagggttacctcttgaaacctgctatgtcagccttaacaaaaggaagcagaaactatttctttctctatttatttcctttccatgtcatgaatgaacaccagcccaaagaggttcattttaacaccttcaccctatcatatgtaccataattttcttcagaatgctcatgtttggcttttttccctgtgagataagaacatctcttttggatgtccaatgttactggttctgctaccaaggtgatttctatttcaaaggtcttgatcctcagtactagatccatattgtattcacaccagggaactttaccaaggatgtatctgatatccatataaggatatcccttcattttaaattctaatggtgggcatcagttgtcctgaagattgccctgaaacctaaaaactttgcaaattatgaagggctatacaaaggtagaataataatgttttattttctattttcattaaatacttttttttaaaggtgagaaacaaagtagagagacaggcagaaatcccaactgttcttaacttacaagatgggggttaagaaatactgtatatggttcatagaacaaaaaaatggaggattgaatttagtcgcagacagttcatacagaggtgactagtgaaataattgagatgagatttattatcatattgagttaggaaaatgagggcatagtttgaataagcaaagttgttatctattataacatgaaatcaatagatattatctaaagttaataaatatataggcatcagcataagcactatagtgagatatatggagttattcagcataataattaaaccagaactgaaactgttaaaagtgggaagtaagattccgagttgggggtaaggcaggaattgttctatactttgacggttttagttatatgcatgtattattttgaatgcacaaataaacactaaaaaatgtactcttttctctctcaggtgacatgcaacataatgatacactatacatatatactatatgtatatactatatactacatgtatgaggacagctatgtgtcctcagtatgtattagtcatttacttcattggttgtttgattctctagctgaaaggatgaataaatgaataattgaatacatgatagaatgtgtaataatgatgatgatcatcatcactttcaatctgcacctcccacacacacgcccctactaccaccagggtgtaaaaaagccagacccataggtagctggggtacaactacttgacattgaacactggcaccaatcagtccactcagtggattattcacatgaagattgtcaactattaatggttgaatttcataaaataggctggaaggacaatgtttggaaaataatatttctatgcaatttggggtcttgattttactacaattattccaaatgttgactgctgagtcttactacagtttactaaaggatttgaatgttctaggattcagaaataagaacaataatcacctctatttcagaaaagtcattttataaaaaatgaataaaagcatatgaaaatcaatctgaaataaaaagaaatcctttaacagactcttataataaagaacaaagattttttttggttaccatagcagcagtgatttttaaatactattcatacaaatttcagcattatagtaatcagtgtttcctattgtgcctcaaaatattaaaagtaacacacaacgttacaagcttagatcgccatttaaatttaaatattaagaaatgttatgaagctaaaattaatttatatattctgtggataatatttgatgtgggatatttattatagaagcagccatttcaccattaacatgaaataacataggtaacctgcacttaactttcaaacctgctgtgattaggcatggggaatagtgaaggagggtgacagagtgtgtaaaattcaatttgtcaccaactgaacttacagcatttatactgactgcaagccagaccagaggagttatagcaactgcatagttcttacaatcttttcccaaagttcaattaaaactcatcgtcaagagagcaggaaataaaaaactaatagaactgactttatcttttggctttagggggtataagaatgcccctgtatggaacacaaaagattgatgaaatactaaaagaaagaaaatgataaaataggacatgaaaatcatatctttatagttgagagaaaaagaaaaagtagccagaattggcattgtgtatttaccctactcgagggggaatcatacatctggccaaggctaaaggaatttttaaattctgaataaaagtaaggatgaggggagcctctttttgctgatttctattttctatctgcaagaacttccagtacaatgataccttggccttatgactctccaagattgagttatttcaatatcgggtgacattcgtggatccacatttcctgactggctggaactaatctatttaaaatttgctagctataggaatttattttttcctcatcttgaacagcataaagctataattctaggtaagtgtacacattctatagatttaaactttctattatgtggtcagtcccaaggtctagtcaccaggaacagagggaattggagggagatagaagggacagaaagtgttagcatgtccttctagtcacagttctatagctccattctttagttggcattattgctaatactaaaatcaccatctcatatcagaagagacagaggagatatctgtctttgtgtcttgtgtcttaattgaattagaatttagaaggggaacaaaaaggtattatgtattgaccctccaagtcccaaaaaggaagcttctatgactattttgttatgtaaatagatgcataaatgagataccctgtgagaaaacatacataataaactcccacagttcagacttcagattaagaaggggactagagtgttatttgtgcctttagaatagtacattaggaaatttatgtacttgcttgtataaatttggatgagacattaaaatctaggttataataaaacactcattcccgctaagtttaaaagtccatgtctgtgtgtgctggaagagctgaaacactgtgaatatgaatacggtcaccataaccaattcatagatggaaaaatcaaatcaattgctagagcctgaaatgaacagctattgtcgtagctctctactctcttagctaattccgtcccagtctttgaaactttgagtgtaaagaagactttcttcttagctgtattgaacaggacaaagctgctacattttctggattatttaaaccccaaaggctttattttactgtaaaaatattctgcaaacaacccccactgaaagggatttggttaagagcagcccagaactatactgtttgaccacagcaatatttgctttgttcaagcaagggagtgtccaacagggttcttcaggtgtcaggcttacacagaacaatgatttatctttaagaaacccatattgggaggccgaggcaggcggatcaccaggtcaggagacagagaccaccctggctaacacggtgaaaccccgtctctactaaaaaaatacaaaaaattagccgggcatggtggtgggtgccgtggcgggcgcccgtagtcccagctactcgggaggctgaggccagagaatggcgttaacccgggaggcagagcttgcagtgagcccagattgcgccactgcacgccagcctgggcgacagagcgtgactctgtctcaaaaaaaaaaaaaaaaaaaaaaaaaaaaagaaacccataaaggtctactgaggctctactcctatgggtaatacattatacccagaattgtgggaaattcaaagttgaaggcataacccttacgccatggaggaccttggaatctgcaaccatgaaagaacatggaaaaatagtccaaatttgttattacataaacaagaaggcagtcctgtggaacttaaatgacaagccccagatcatagttttaggggctgatctaaattaaaaacaacatgttctgaatgtcctcataggattcttttcctcgtatctcttgcctatctttgaagaagtaaaaagtatggaaagaaatatgtcaggattctgagcatcaaggactgtgcttcttaattttctatggagtctacaaacaaaacaaaatgttgtgactaggtttcttgtggatcccagtgaagggaatgaatcctgtatttaaattgaaaacaggtgaaagagagattggctatatagatagaagatgtagaggtgaagaaaactaagaaaataaatccatgggaattattaataatcttcaaaaggggtcactgaaatcttggagagaccattgaacttttccaggattggatattattggggtggtcaaagaaattcaccctagataacaaaggatagtgagatccctagctgacatcagaggtatgacatcaccttgtcttctaaagaaaatactgtatgattatttaaaaacataaactttctttgatacatgaaacctttatgttatccctttggaaacaaaatgacattttttcttgtacaggtgataatatatgataccatattttctattgacttgacatactgtacctaaaatttaaatgccaagtttggggttgaatatataccatcctacatttcaatccatttaccttatttttgtcagtcttatcctggaaatgtctttctggatagactgagaaaaacaaaacaaaacatggggtgatttgaagacactaaaaaattgataaaagtcaactaacttttctgtacattggtttatttgtatgtaataaaaataaaataggtgaaaattattttttaggaaataaatattcatcctttgcacttataggatgagtgaaaaaacacagtattttagttttgctcatgttttctaattttatcttcattatatttcttcagtgataccctgttgaccaacaccctttctcctcttccagaatccactaattctgtagtcataccagctttcctgcttcttggctctatctcctttatcttccttatgcatggcatctctggcagccaaataatcttccaaaaggcatgcttcttcaacaattcctcaacgtatgttctgtttctctttatcattcatctaggtgtctgtctatctatctataaatccatctagctatccattgtgcttttgttgcagacacagatacctaaaatataatacaacaattgacttactctctcttggaagctaaagaaaccttctgtctaattcttctcttctggttccaacagaaatccctgcagagccacggacagaagggagagaccctccttctgtttccctctctagttttctgcccaaaatcatgcccagttttagcaagtaaatcatggacttaaaaccagcagctttatatttgctggctccacatgtctgaatgcatttgagagatgtatgtgttcagaagggggaaaaaaaaaactgggagttaggaggcttttctctgatttctggagtttgctggagaaggggaggaggaggagaaagcacagagataccaaggatcttggacaatattgttcagtagaaaatgtatttctgtggtctcttatcaatctataaagatgtagtcattaatctgtgacatagggagaaaaatagctccatagaattgtttccttatctatcaaagtatgttatatatgttttgagaactaatttcaaggcacagtttcactttattttctattctttttcttgttggagacagaaataattttcaagttgggcttaattaagcacttacaatttttgaattcacacgagcctatctagagatactggtttatttcccgttatatttagagtttctgcttctgtgccaggtccttatagcaagcagaaggaacagacacaatctatctttgtagaggttttcaaaattgagcaatgtatacccttacatgtgggtatttgccaaacacttaaggacttatgaagaaaggggtgtggggagtgggaaagagaatggaaccaaaattttaaaaaagatatatttttggccagcagaaatgatagagtaacatagccttatgcaaatgtctcagagcacagagtctttttaagcaatgagctgaaagttgttttttgtcttcaccatttaagtattctgccctttcaatgtccctagacaatgaccacccacaagaccttgaactggggaattgggagaagtagaaacgacatgactgaattcttccaaaacagctgtgggtaggagaaggattactattgacatgctaaaaggtcactgatgtataatctgagacaggtagagcctaaaggagacagagtctcacgtactggaaacaggattgatggagagtaaattcttagcaaatattacgaaaacactgtcaaaagattctgcagaaccacacgaacatggtcactctttcaatatccactgactgactgagaaagtacacaatgacaaaaagtcactatgccttcagaaatacttttaattaatctgaattgtgctcattgtaaaatgtacttacactgagaataatagcaatacaaatataaattaggcttgctctttattctacgtacagaagtttctgggtatatagatggtttcgagactctgaaatatttatctggctctccaggtttcagaatcactggaccattagaccacatcagcactggacccagctaaagggcagagattcagagatccccaactgtgactagttgtgcaagaagcatgcagaatgatgagaaacctacagctcagaaaagaaacaaatcgtctatatggaagtccagtcttgctgtggaaaggctcagaaaaacaagacccttagcatatctcagggaactgaaaggctgtggggaaaccaacagcttgctgcaaccacagccacaagtcaggtaagcattgagcctgacagctcaggaaaatgacccacttcttgccaactcagacaaaaaggcttcacttaggcctagggaaactgtctctaataaggccatctgttaaccgtgtcgcctgagtccctctcagcaattcctcattccctccctttccaccttccaccctgaagccagacattaaggcagcagagactgagtaaaatcaagctgttgggctcagtaaacattactgagctccatgagggaacacggtcccattttttaggttcccatgtccaaggcacattttgatcacattcatttagcagagaggtgaaggaagaaagcatgctggctgtgcagcagcatcgtgctgcatccccttgcttaggcaaagtcataacagacagcaaaaaataagaacttggctacagttcccaagggtttgaacctgaatacacagaacacgagaaaccacacaactcaggaagaaagcactgggcaagtgttcagaggccttattgacaatgggcccgctctcctattgacttgatttgtaacacataaagtcacttaaatcaggggtccccagccccatactggtctgtgccctgttaggaacccagctgcacagcaggaggtaaggggcaggcctgagctccacctcctgtcagatcagcagcagcattagatcctcataggagcgtgaacccttttgtgaactgcgcatatgaaggatctaggttgcatgcttcttatgagaatctaactaatacctgatgatctgagactctaactaatacttgatgatctgaagtttcatcccaaaaccactccccctaccccagtttgtggaaaaatcgccttctatgaaaccagcccctggtgccaaaaagtttggggatggctgacttaaacttctagcaatgatctgtcaagtctcttcatctcatcacataagtcggcatgtaatattcacaaaagaccaatccaacctctgaaaacgaaatgctcattttggggaagtgacttaactcttccagctcatctctgtccctcttaataaaaaaggaaaaataaaaataaatataataaatattatttttaatacgtggttattcagtctcagaatattattgtaccttaaaatgaaaaaagctaatatattgagtatctttttcacatactttgggaattaaaataacatctttaatatttggaaatgaaagggaagaaagaaaatttgatatcaactataaccaggatcattttagtgtaaatatgtcaatggaaatgaaaatccaaaaatagaaatatgcaataaaaagctacacccgtatgtctcacctaaagtattttaccaaggctgaagagtagatcattaaattacttgtaggctacagctgaaaatatgaccctctgacaaccaaacttattgttaatacaactgacactgaatttaggagaaagattaattcaaccctctgtacctgacatccaaaaagcaaacaaacaaaaataaataaaacaaaatcaataatgaagacttagaacacttataatcaaggaagatgatagaagattgtagcaataacatgttttaatgttctttatctgaaaaacaggtagactgtttgctgatttccaagactatacatctttcccaaaacggtttcttgagaaagctgtccaccctgaagggagtaggagatattttcaataatggcctaaaatttatgcatttcattggattgagtcactggagatataactgggccccatttctcatgcatatattcatggtaaaatgtactcctgccaaaccatgggaaattaaggcttcagaaggtgaataaagaaacttagaatacaagtataaaattatgagtttaaaacttataaagataatagtttttttctatagatagagcaagcaagatattttcttgacacaaatctatcatgacagaactggcaatctaatcttaatcgctcctcccagtgaaagagtaaacaaaaatggttgattgcagctgtgtggacgtggtaaaaattcacccacatttccatcacccagagcagctctgctaggcaagaataggtacacactctagctcaggtccttttttgtaacagacactgctcaatggctccaaatattaaatcaatactcatttactgtagagaccatggcaatctgtcaagaaggaagaagctgttctgaaatgaaggcactgataattgtgacccaataatgcaatagaaaagatccacttgttatggtaatcaccagtggcattctaaataatgtgttcagtttatttattgcagtacattttcagagaatgttgctttccaagtaagcatgcctggggtggctctaggcaaaattgtatataagtaactaacttttttcccccatgactcactgtcgctctgtaaatatgctcattttacctgtttctcttttcattccctagttctcagccttcatctttctaagcccataaattgttgtttttccaacagttacttagaacggtaatcacctctaaaaactccaccccctatgacacaatttatagaaagacctccattctgctaactttctaaaacaggaagaacagcacatcaatgattaatgcattgtctgacacataggaggtagttcataactttttgtagactgttgttgaataaatacctttcactagaaatatgagtcgtatttgatttagtccagatggctatggtgttttatcacgtgtttgctttagtaaaacataacagtcattcaaagttacagatctgttttctttgaaaaccattctcctataatggcatttgtgcatggaacacagtagaagacaaataacatgatgtgatttcaaaaaaatattgggatggatgatggttggatggacagctgatatcactcagggtgaaagctgacattttagtagcactgatctcccaatgattccattaggatatacaaaataggaaggactagcctgtaagttagtcatatacatttttgtcagcctataaaataaatatatcccttttcaaaaacagagaatctataattttaaactactttgacatttgccatcagtgattctaagttctaaattacacatatcctgagtatttttattttaattaatttttttttgaactatgaaattaatgtgcacccatgaatgccaaaaaaatgaaatagcaagagagggcttctcaatctcaggcaaaggcctggcttcatcagcaaagagggtaaatagtaaccgaaatgtcaagttgtctctggcttaaattaagcaaacaacagaagtctttcttacttcctatagaagatatttgggagaaataaagattttttttagaaaattgccatacaccattagagtttagaagtgaaattaaagatgaacatcattttgcttacttcggattgtaaacattgaagaagtagactttaaaaggactggctaacttggtgccaaataattgaatgtgtggctatgaatacagaaatgttggcatataggcattacataagtaatctcaaataatttttttctattctttttttggattgaaattcagtgtctagtatctctgagatgaaaacaaataaagctagagaaaaatgctattttgactctccttgaatttgaagagcactgagttattccacactggtaaaaactatgtcaacagatattcaccaacatctcagtgatttagggcatcttcatgatctgaacatggcccagagtaagtgcttgtgaagtgtacagagaggttaatcaaaaatgttacagtcactaaccctgcgagcgaataatcagtacgtgcggattggcacgggcatactcggagcacaacagatttaacaactggatgcgcagaacaatcatcttttacatggtgtgtgatatttgggttgttatcccttatatcattgtgaaaagcaagtgtgaactgatggaactgttaaagcagccaaaagaacttcaggaacagaatcacttaaataacgtggctggtgtaatgcctatggaggagtgtgataaggggtcagagtagatataaaacctcccaagaatcatcctgaaggggtaataaatgatttttacgttactgaacgtgacatggttaatggtatgtatattctctcatgtgctaactcaacttggtctgcttacttggtaagacgttctctgcagttcaacaaagatacttagctatcgctatgtgccacatgttgaggaccaataagtaaaattgtgtgccctcaaggagttaagagttaattagagggaaagcaggcatgaaaaagatttaatccaatatgcttataatcataaaaaaatgaataagatacaggaatattatatagagaggcggaaatatgtaaagatattgggcttgggtttgaaggggaagttcatgatcaggaggtttcccttagtaggtgaaagccagaaagacattcagacatgacgaagaagctgtttcggacaaaggaaactacagggaaaaccttttgaaacaacatggtggctacgaggaaacatgtgagccagatctgctgaagttcaaagtatgaaggatgagtgaggataagggtgcagagacatgggaaaggaaacaactgagctgggaagcgtgggtcaggatgacacatgtattcatcccaaatgaagacaaaataaaggatttcaagcaggtgcatggaaagtcagatgtatatttgactttccaggaagaaagatttctctagcagcagttagggaaaattaattttggggtatggagaacatcaagaatactatcataatagccccagtgcctgctgatgtgcacttaaactaaggccatggtgctgacggtatcacagtgaatacacatgtgatgctgaagtagattgaacagaaatttatgccaggatcctattggtggggaagatggaggatggaaaggtggaaaggaaggagaagagttacttttgtgtttctgagtgatttcctcatggaagaaaaggacgaaagtcagaagctgagtgacagaatccagaatgaaaagggagataagtcaaaatacactactaaaggtgtttttaagacttccagatggtaccagatatccagtgctacttatagcaagtttgtcttttaaagaaagatcaagaacaggcagccttcttgtttgagtgcatagctccaatatccttccctattcccagagaaatacaaatggggatgcaccttgcacataattctactatagttccctcataatatgtcctacttacagtttattgtatttattggaacagctggtagatttcattttaagatcagctaatttacacaactgggtcaagaaaagagaatagaaatgagcaagaggacagccataaacctggtacagttctaaaatctaggactaaaatactgtatggtttattctatcccaacttagttcatcttgaataaagaggcccaggaaaacccagattctgaggcaagatgcccttgaaccaaatagaatctgactcaaacaaaaatgacaacctctagtctcattttccatttctactgtaatccttcatctccttcaaatactttaaaataaagtatgcgccagcttgcacgaaaaaaaaatacagaaagtatgtgccagcttgcatgaaaaaaatacagaaagaaaataaataacattgatatgaaagtgcaaatatcaaaacacaaaaaaatttcttaattctaccaaaattatattatttgtattaatcacaattctatatccatttccaaattgcactcataatattttgtaatagtatgttgaaaaacaaacagaattatttacactagagaagataatagaaaaaaaaggactttccaagagaaacctatattacaatagattgaagtgtgacacaaataagaaacttctctcattccccagtctgagataatctgaacttcttcagaataatattttatctctgcctcttgtaatgaaattatttcagtgctttttttttttttttactatataatcactttatcttcagttgcttttttgaatttgtactgtgtgcccagtacatttctaagcttcaatgtgaagctaatatctcctatagcatagttaatgtttattcaacaaatattcatgaaaggctatcacgtaccaggaattgtgctagaccctaaagaaagaatggtatataaaagtaggtacaatctttgtcctcaaataggttgaagtttggggtgggatgagagagtgaaggaattattcttaaatagaaggtagcacattctccttcttcccattgtaataggaagtggaggatgaaagggtgaataaaagtgtagtcagattagaatgtttagagtcaggcagtggagaatattcctgtatgcaaaattctacaaaggatagtcatttactgagagagctggagagagcagatcagaatattttattcatgtctgtattcttggcaacatgtaacacaattcttagtgcatacctagtgtttctgaaattttgatcatatagatggcttgtaatgggaatgacggagtgaagaattgaatgaaggattcttacacttgtacttagagggcctgatgctggtaaaaagttaatgaagggttcagaaaatgttagttctttaacctgagtgccatctcatccctgggcttagtggaataaacgtccacaagattttgctgtccagattccacagctgcagggaaaagagatgagttggaaaagagaactataaaacaaaagtcataatacacaataatagaatcactgttttctgcatgtctcttgttctattttctgaaagcaggaacattttgagtgaaaacaggttttatgtcccagcaataaaggggtataactataaaaatatatgtcatatcagcaggcatgtctctaaatagaatgttttaccaagtttcccaagagtcgtctgaggccctttaaattatagggtatatgagcttccctgcagggcagcctttgaactacaactcattgtcaatctaaagtaagagtgggaaatgaacctttggaaatgaagggtatgtgttctttgctcagcatttccaggtttgttccttaaaatggatgccatcactaagcaagaaaagagatatataatcggtatgggtgaagtgaagcttaatactttaaattgcatttagttagaaaaaagtttcacattttaacctaaacctttgcattctctttgccaaatttgactcagggcaaagcaatcaaaagctgccagcagtcacttaaatggacagaacactataataagtaatttagaagagcagataatccaaagttcacctctatttgggtttgtaataacattttcagctgatttactttttaaattatttttaggttaatattaaaactaatttgcaatactttaaaataacatactaactgggtaccagaggcctagaaatattcaagactctaaatggagccaacttgggttgttcaacatgctgggtacaattctcaaagcatataatccaaaatagagtgcatttagtatgtgcttttgctttctctgactgctcttattcttggtgatagaaccaagaaaatctcctggtgctttctcctttagattgggcctgttgaggaagtcctgatacacaaaaatagtcatgcactattattcaaaatagtaaaagattggagacaacttaatgtccaacaataaaggactagttaaacaaattataatgcatcaataagatgggtttctgtaccattaaaatagcatttagagagaattttaatgacttgagaaacagcttatgatataccataaaaagaaaaaaattttcacattataaaattgactatacagcattataaccactatgtgattaagagcaaaattgctgaaatctggctgtgtacctttgaattctgcttgtgtcagttattagatatttgatctagaataaacttcttaacctctctgagcctcaatttccctatttataaaatgcacatgataataatctctatctcatagtgttgttatgagaataaagagatgtttaatgcattcgtaaaatgcctggaaccaaataagcacaataaatggtactatttttatttgttttaaatcaacagaaacttgctcacgctgtttcttctacctaaaaacctttccccctaccatcttttaaaattgcctattagatcctgcttttcctctaagatccatcttacatgtcatctatacaaagtatgaagcttttgctcaggacaagctccctctagacaaaattaatcaccccttccttttttgttgtcagagcattttacaataaaccctttctcagcatctatgccataagatatgaatcaacatgtatctctttccccggaggaatgtggagtcctcaaaattagagggcatgtcttgatcttctctgtatcatcacagcctaacaagtgtgacagacaataattgctcagtctacactggattaatgaatgaatgaatgcaaggtaaattctgtgaatgaagcaggcagagaggaaagatgagacagcagtttctttccctgtgacttccaaaggttcaggtctactttttggcctggaggaacaatatttccagtctatatttcatgactccaaattctcaagatttctattttctattttctttctattgtcacctgtcctaaaacataatacatgtcctaacaactgaagcagagtggaataacagaataaaacatgaacttaggggttgaaagcccaggttctattgctgacattaccactacgaccttgaataaatcacttttgaacatgtaaaatgggcatgataatatactatttcaaagggttaagtatcaaagaatgcatgtgagagcatttcagaaaagcagcacacaaacgtaagatatcatcattagttcttttgctggtaaagctttgcttatttgaaagtcacatttagtaacatacattttacaaatttacagtagcctataattcttcgacaacattaaggacaacttttcaatatttccctttgcctcattctacagcaaggcagttggaaagatggagaggtttaaaattgttaaataaaattgttaaatagagttcctacggaacacaataaaatgggaatgtgattcacattaatatttaaatatacaaactattctttgttctatttataaagcatcaattagcaattacattaaaatgcccacataattcctatttagttgacagcatccttcttcccatttcatagacatgctgaggcacagctaggtctaagtatatcattgcagattaccaagtataatctggtaaaggaattaagaattactttctaacctagagctgcacaacagaactttctgtgacaataaaaatgtgtgatagtctgcactgttccatatagtaaccgtgagctatgtatgactttttagcccttgaattgtgattagtgagattgaagagcttaatttttaatttagtttaatttaaatcaatttaaatttaaatagctacatttggctagtggctacttactatatgaggaagtgactttctaaccagtccctgtactcaagaggaccactccccagctttcacatgcaatctaaatataaactttgtatttgtttcttagccaaattaatgctttaaaaagaacaagagtctattacttcatgatgtgaaagacaactccacacaaaccgctggccatggccaatgtcttttctccatgggaagaacattataattagaggttgatttagggggcctagaatcagaacaaggaaggtgattggatgatgaaaatgcttaatgacatctggttacaatagctggccaaagacatggactagtgctattgctagaacacttagtctgccagccaagactttcctttgatattgtttttgcaagtattgctgcccttgtttttgtgactcttctttccatggtcaaccttttttgattggcacatccttccttctctatttctccaaactcacacttgatctgcactggcagagagaaaggtttgtctcatctctttggatttgattcctcataactctcagtccaacacacatttccccttttatctactgcagaaatgctaggaagccacaaaagagaaagaatatttattttaacccttctgataaggaaggaactcaatctatctgggaacagacgttccttcttttccttcagacataccatcaagagcatcttaaggtcagactgtaaaatatctttatcttttcaaggcagtttttgctcatattataatcaaggacaagagaagtcacacaactctggcaatgcaagtccttgcagcagcaggtgagagtgaaacttttagctactaaaactgctcttgcaaaactaagtcaggttctggaaggtgccgattctcagtcaagatgagatccttggcttctcaatttggtgtatgagtgattttgatattcattaaattgactgacagagtgaggcacaggcaacctttacctactcaccagctgtccagtcctgaaatgttctggactattttgatcctttaggctttctgtatatacagctattcagatgcagaccttaaatctgcccagaaagattcttaattattccagagctggcctttgaagttgtgattctatatttactaaatgatgagtaagtctcccaacgaaagaaaaatttctcaaggcaattgggttcctaataaatgatgcctaaagatcttaatgtcataactttacacaaaattgaggtcactaagttcaatttcctctttacatacttggaaaaatttgggtccagaaaagttaactgacttgaccaagaacataaaaatgtatctaaacaaaatattgatagttataacttaaaatggtgatgatgatggtgaggaggaagatgatgataagttgttttttttttttttttaaatcatggatatgaatagttcacggataactagattaccagactaggttacctgaaagatcatactacgtagttttatagagaagtttgtcaatttaacggcacattgaaataacaagatctattcaaattagcaagggttgaggatcatcacttacagaattagtaggtactagtctaaagctaccgatgatcatttgtagaaatcattatgtaatttctaagacctggataaccctgaaaaccataaagataacctcaaacagccattctcaattcccattccttctcgttggaactacttcatcttttcttatatttactttcaatattaaagtcagtagtttcaatattaaaaacagtagttctcaaaattggctggacattgaaattagtagagaatttcactttttttttctttttaatttacaaattccttagtctcatccaagagttcttggttgcagtctaggaatccatgtttttaataaattctcccaagcgattctgatgcagcatttgagaatatcatttatacagaactggagttatttatacttctggcttttcaaccactacattttaaaagcaggaacaagttttaattttattcctttatgtatctgtgtttgagctccatccttattctttacaaggtgacctgtagaaaggtttagaaccggacaaccagacacatctcagcttggagtccagccctgccactacgagctggaggaaattataaaacttttgagacctagttcctcatataattgtacataacttaagggtttgttgtacaatttaaataaggtgatgcaccttgaaggcagcctaaaacactatgagaccagtcattgcagtagtagagacagtagtattaacagtaccagcagtagcagtggtagtattagcagtacttgctcaataaataccttttgatttaactaagaaagaaactacatctgttaagtaagccattggaataatttgaagaaataaagccctgagcaagatgaatgcctatatgaggagaaaatagtgacaagtcaatttaattttcatctctggtggagtggaaaaccatacagaaaagggaaaagcaatagatacaatccattgatcaatgatatttttgactcagttctatttggcattcttatcaaaaagctagaaaaaggtggtattgatctgtgtagctaaaaatcttttgcttcaccctaaattcgcatgtactcccacattttcctctctttattcccctcccccaacaaataaactaacaaataatccatcagggttgatcacaaaaggtgtttatatggaggctggctgcagatggcaggtgaatcggacaaaaagggctccttagaaatgttggctcagcaaccctgcccatctttggacttctctttcacctctctagaggctatggcataaaatatgggcattaatattctaagattcattctgagcacctttaacagagtcagacactgtgcagctattaagataatagccagtagcatgctcccctccttctcttccccctttccattctgagttatttactctccccatcttctttgcatttttaaaataatccatttaattttttcttttgtattttttttctatcatctatgcctttaacctattcacaattctcacaggcatttgttagatatgccagagcatgcagggcttagcagctacctacattcccctcaagaaggggtgcaggtcactagcctcatacccacgctatgggatgtctctcaggaaactaaggtcaactagagagcgaaagaagccaccataatacagcaatgatgtatgcaatgaaaacaagagaataatgttttcattcaaatgttccaaaaaatccaatatttgtctttgcaagtgtgtgtgtatgtgtgtttctgtgtgtgtgtgtcttcatctgtagacacatatcttactcacaaaatgcatgcattccactcatgacattgctctccaacaaaatttttatctaaaatgtcattcctcaccttatttttcagtgatggtcttagtcaatgttaaggacgcagttgcacaaatatagatcctaagttctttggaacaaaaacattctgatgaagaccccatagcacaaaaacacctttatgaatatttttatttctaaaaatctcagaagcactcttaaacctcttgctttgcttaacccatgaaggcctggttatggagacaacatactattccatgactttctaatttgtccttcaattaatcaccacagctctgcaacactcggcagtactctgttggagtcacaggaaacaaaatgtgcccttctgctgatgaaactttgctgtctgtggaggtattttagcctgctgcctggataattacatgtgtaactcacattagcaatacagagtgactggaggcggatgcacccagcaaggccacatgggaccccgtatggatgtgatggccccttgccatcatgggtcactgaagggcagctgcaataaccctcatccagttctgccctctcaataatctctggcactgcctgtgttttctcttattcaagtgagggcaagcaccttctagtccacaggggttgggcacagactgagacacgaagtcatgtgccttagaaaggtcaaggttggttcataggcctcttagagcaaagaagggcaggagagaaagaaaaactagcatttattgaaaacttagaatgtggtcaggcacagtggcccacacctatcatcccagtactttgggaggccaaggtgggtggatcacctgaggtcaggtgtttgagaccagcctggccagcatggtgaaaccctgtctgtactaaaaatacaaaaattagccaggtgtggtggtgtgcacctgtaatcccagctacctgggaggctgaggcaggagaattgcttgaacctggaaggcagagattgcagtgagccgagatcacaccattgcactccagcctgggctacagagtgaaactcagtctcaaaaacaaaaaacaaaattggactgtacgaagtcttgtgtgaagcactttcccacagctgtataacataattctcacaataatacagtaaaagaatgcagttactattttacacataaagaaatgtggtacagagaagttaagataattgcttaagattgctcagctagtttgtagccaacctagaactagagattcagtgtcctagttcctaacccaatgtatttaagaactcaggctccagaaatagattgagtccaacatctaataattatataacctggataattttcttaccctctctatacatcagatcgctaatttgcgaaactgaattcataatagtgccaacttcatagaattgttatgaaggtgaatccatgtaaaatccttaggacaatgcttagaaacatggcaaaagatttcaagaaactcctggtagaactcataggctggtgggaaagacagatgcataaacagattaattaaaggacaaacctgccaaacacttttcagtaacgttaaaaagaaaatggcgtgagatctcacaggagaatttacttagcatcccccatcctgtaaaatgtgaaataagcccatctgaatgaaaggaaaataaaattcacaatggtgtttgtggaaactggctatgtcagaatatagttatgggtttaactgataaagacagataaggtagttccaggaatcatgttttacttagagctcccctgcctgcgtctggaagccctttgaggttgctgtactgcgtgcttagctggaccattagtgctgctatttttagagctgtcaacatctatataaaactgaactcatccaaaaagaccatatataggttctaagaatgaaacatttttctcttacaaaaagaataaagacccccactattcccaggaatgagaatgcaatatcaattcttgggggtttttttgtttaataaacaatgataatgtttaagcactgtatattgaataaaaacatcattggccctgaaatagaatgaccctcaatttcaaaacagaatgtcccttcagtttggcaaatcacctcaattttcaggtttttgcttcaatactgtgctctgatactacaggatcattacctaccagctaaactgaatgactttcaatttccctaaacacacttccaggctttgtagcctccaggcttttgcttattctatcccctccacctgtattgttcttacccatatcccagtttctatctatcagattctacctaccaagtctccaagatgcactcagaggcctacttcttcctatagcctctttaaggcatcaaaaatttcctcagatgcaataggggtccagtcttatgtacactgtcttcttccaaatcccctttgtcctgtattagttctagataccctcttaaattgagacccacagcatgtggcacaattattttaaatggtggggagggaaatttacatatctatgttagaaatggggacagagttaaatggaaaaaaaaagctgttaaactcttcaatcagtcaatttagtatcccctatctgacaaagacctagagaattctccattgattacagaaagacagtagcctgcctttaaataatttacgctttaagaaatgacacagctacccagagaatagttatttacaaatgtaaatataaaatagcatctactatttttctaagtgtctgctatgttttaaggactgttctaagcgataaagtgatatctttatctaccatctagctatctacctatctcctcattttattctttcaataactccaggaggtgtgtactattattatctcagttttactgaagataaaatagaagcatggcaccatcactcaattggtaagtgatggaacactaactccagaatttgtgtcctggatgtactgtctttggtatatgatgaatagttaaattttggaatttcaactacatgttcagaaacgaatggcattcagagggaaaaaaagttattgaattcaaatgagaatccaagtgttcaaaaagagggggattaaaacaaaaagtacagcttgaatagttagagaaggtcaagtgtgatattttggatagagaaagaaatgttaacaaagtcacagaagtgagacatccacaattcctgtagtgggacctagagagaaacaggtgaaaaaagtgtatttgattcagggccttgacgataagttgaaatgctgagatgtaacaactcaaataattgggaaacatcacaggttctagtgaagcagtaagatactgaattgaaactactaatcattagtagttattggcaagtaggatttcatacaaccctatactctctacaaggctctgtttgggtatgccttttaggttgttttaggagttatcattcatcaaagtaccctccatgtctagcaaaatatctgacaaatggtaggtgattataagtgattgttgaataaacgaacatatatgaaaagaaagttgggagaaaagttaggatagagcagtatataaaggcaaggaaaaggccgggcgccgtggctcacgcctgtaatcccagaactttgggagaccgaggcgggtagatcacgaggtcaggagttcgagaccagcctggccaacattatgaaaccccgtctctactaaaaatacagaaattagctgggcaggatggcgggtgcctgtaatcccagctactcaggaggctgaagcaggagaatcgtttgaacccgggaggcagaggttgcagtgagctaagaccatgccattgcactccagcctgggtgagagggcaagactccatctcaaaaaaagaaaaaaaaaaaaaaaaagagaaagaaagaaaggtaaggaaagtaagagtgctttaaaaatgaggtgtcaagcataaaagttattgccaaaatgaaataaaagaggattaaacctgaaaagaggtcactcaatttggccagagagatgttttggatgattttcaacagtactgttccagtgatactgagaggtgaagccagctggatttcccggcttgagtggggctttgaagaacatttctgcagctagctagaggtttgcaaaatggacccatcagcactctgtaaaatggaccaatcagcaggacaagggcagggacaaataaaggaataaagttggccatccccagccaccagaggtaacccactcgagtccccttccacgctgtggaagctttgttgtttggctcttcacaataaatcttgctgctgctcactgtctaggttcgtgccatctttaagagctgtaacactcactgtgaaggtctgctgctcaattcttgaagtcagccagaccagaacccactggaaggaacaaactccggacacaatacaaagagagcccaatctctttctttctttttttttttttttttgagacggagtctcgctctgtctcccaggctggagcgcagtggcgcgatctcggctcactgcaagctccacctcctgggttcacgccattctcctgcctcagcctcccgagtagctgggactacaggcgcccgccaccacgtctggctaattttttgtattttcagtagagacggagtttcaccgtgttagctaggatagtcttgatctcctgaccttgtgatccaccctccttggcctcccaaagcgctgggattacaggcgtgagcccccgcgcccggccccaaagacagcccaatctcatctgcatgatgttaagggggaaactgggggcagtagttatagttcatgatttttgtttttaattagtagcaagaaaagaggtttctaagtgagcgattggatcaaaaatccatttaaaaggccagaagtctcttcatttaaccaattaattcaaatgtcttatataaaatcagtaataaggccgggcgcggtggctcacggctgtaatcccaacactttgggaggctgaggtaggcggatcacttgaggtcaggagttcgagaccagcctggccaacatggtgaaaccctatctctactaaaagtagaaaaattagccaggcgtggtggtgggtgcctgtaatcccagctactcaggaggctgaggcaggaaaattgcttgaaccctggaggcggaggttgcagtgagccaagatcgtgccactgcactccagcctgagtgatggagtgagactccatctcaaaaaaaaaaaaaaaaaaaattttagtaatacaacgtgcactcttatctctgatcatggcaaagtgtgtcatgtcttttaagttccttagacaatctacatcacattagtcgaaagttggagtttagtaatagattgtatgagccagacattaagaaattaaatcattcatttaaagatttcacagtaagtcacagagagatgtagcagctagtgtgctccagttagtctccacaccaggaggagaaaagggttgggcacaaccatctctgatgtccttccagtctgacattctctaagtctacacagagtatatctccttactgccattcactactcagtaagcctctcacttgtcccaagccaactgtcagcctgacctttacaaatgatctttagtcatctaattagctccaagagaggtttctattatcccatggttacaattttaactaacttaaaattacaagaaaagttaaataacagaggtaattaaacataacgcagctagcattcaatgtaaacatctaattaacaccaatacccacatgaaggcaaaattcataaaaacaaaaatcaatacaatatattatatttggatactgtaaccaaggcctctttaagtattttctctgaaagtagaagtttttggatgataaagctaattaaatgctgtaagagtagtgatccatttgacagagagaattaaaactatgagagatttctaacagaaacatgaactcccaacctctattctatcaggctgacactctttccacaagaagcaggagtagagaatgaaaaaaataaaagaagtgaaaggcccacttcaagagcctcaacattttacattctaagctagttatcgatggcttcctttagtgaggcaaaatagtgttgtatagaattgggggggtggggattactgggagaagtaggggaataatgcaaacagtaattagtaaactgaattcatggatcatcaaccatttctctttaaacagtggtatttatttaatgccacagaaatatacttgttttaccaaaaagtcaaatgcaaattaaactaaatttactatgcttcctttcctctataaaaaagttaacagattaaaaaatgagattttcctgcaatttgggtatacatattcccagttgaaagcagtgttttgtcagctgtgttggagtgattagtttcactacgtcaggcatcaccccagattccccattcagtagtatcttgtatacagatagttacatgatttctctttctattccgtaccttaaatcagcaccatcagcattcatattatatacggaaatctaatcatactagcctatgtaacacttagaggggctttagtcacctagctaatacatcaaacacaaacatgaatgaataataaattttttaaatatcaccaattttcccagttaaataaatatatgaaaaagaacactagctggagagtgtgtacatgagaaagaaaagggatgtgtgttaaattctgcatatccctctggatcggcacctctctaaaggtcagctcactagcctcaggtttaattccctttcttgctgctactgttcagaggtaaatgctcgctttttattaaaaatcaaaagcacaggcgcttgtaatcctctagactcaaagtttttttttttgtttttttttttaataaaaatggaaagtttagctcaaagcaatagcagctaaaattagagtgaaatcagcagctgctccccagggaagatggaaaaccaaacaatggtctgtttttcccttgactacaatttatgttgtatttttttcctcctttaaatgtggaagactttccaaacatttgcatatgttggcaaagcaatatatgtgtaagcccccaactcctactcccatcaaaatgatgtcagacattagtgtttcaggtaaatgtacaagaaaactgctattgcattttcaatgttgcagcctttggaaataataacactaatgaggcaggacgtggtggctcacgcctgtaatctcagcactttgggaggccaaggcgggtggatcacgaggtcaggagttcgagaccagcctggccaacatgatgaaacctcgtctctcctaaaaatacaaaaattagccaagcatggtggcgcacacctgtagtcctagctactcaggagcctgaggcaggagaactgcttgaatcaaggaggcgtaggttgcagcgagctgagatcatgccactgcactgcagcctgggtgacagagcgaggctctgtctcagaaaataataatagtaataataataataataataccagttaaacttccctccatttctctctttgtacaattatgtcattacatgtaacaaccgctgtgagacagaagtattggattctcctagggtgttgtaccatatagctgattgtgttgctcagaaatcctggtcagaatgagttaggaaccaaatactaagacaaagcttagatttagtaatttattctcacttttacctgcttttctctaccctgtcttctgcttcattcattcactgtcctctcgacatatttaaggatgacttaatttttctctccctctcaccatttatagcccaaaccccaccttcattataatggcagcactagcacagtgaccggcacatcataagcaagcagtgaatgcagtttcatacttgggtaaatttactcgcaacattttattctttacttgccttcagagtattttcttcctccctttaggatcattctgaaatcatctgggctgtgcatttttattccaacctgctttgatgcaaaagcttcctccccaaacatgtcccttacccctttcagtggcctcttggtgagggtatcttcgcatagaaaatattaaaagaaaatatccttcattctatttatatgagccagtttaatcactgtgagtatataaagaatagttgccaggcatgggagctcatacctctaatcccaacaatttaggaggggtggtaggatcacttgagcctaggagttcaagatcagcctgggcaacgtggtaaaaccctgtctctaccaaaaatttgtcttaaaaaatagctgggtttgtggtgcatgcctgtggtcccagctacttgggaggctaatgtgggaggattgctttagcccaggaagttgaggcttcagtaagtcatgatcttaccactgcactccagcatggccaacagagtgaaggtctgcctcaaaaaaacaaaaacaaaaacaaaaaggaaaaacagaatagtcatgagaatagttataatcattaccggatattcacctctgcttagtgcttaccatgtgccaagtagcatattaggggcttttcaggctctttctcactgaatccacacaacatctagaaagaagttactattattcatgttttttttacggctggggaaactgaattgagatggattaattgtccaagatcatatagctagcaagtgatgaaacctgggttcaaatttaggtactttacctttcactctttctatcagtgctaatgttttagagtgcctctctgacacacaaactcacacactcattcttagaaccatgagataagagagaaaatagcttctagaactgtccttctccttcaaactcaatcaatttagtacagtctgaggctggtggtgagaaattgtttggacttttcagtttggtcccaattattttcaacatgcttccctgctcttaaggctagttcctttctaatagttattcccccaaatacattcattttatatatggtttagtgatgcttatttcatatgtgaaataataacactagaaaataatttgaggaagacacatgatgaatacagtaattgttcaaggaaaacatggtatttataggacaataaaagaaatctctagttacattgttcactgaagcaaaactatgttataagggtcattaacccatatgtcttataacataagctgatcaacagaaagggtcaggagaatacttcccttgtgtgtacagcttgggatacttagacacatctgagagatttcacatctttctcactcagtaacatcctacactagctgctctaagaactgataaactgttggacacttttggtatagtaattttatgatggaatataaaagtacattttgttatattattgaagtggctataaccattccattgagtcattacatgaaaataggcctgcttattcaaccagaaacatgcagagactcaaccaggaacatccaaacattttttaaaaatagattttttggttctgtaagcatggttattcttttaaaaaaggaaatgttagtgatagatagattatcggtacacaagtcacatgcaaacaccacccatatcttaacattgagaatgtttattttatgttatatgtggaagcattttgtttacccagaagattcaggtctcacatatttgggcaggcaattttttttctctgaaattgactaacatttctttttgacagatggtaactttaaaagacttgctgtaggtaaacaaatcttaaactccaaactcaggggaatttgctaaacattggatcatattcttcctatccaaatctttccatcttttaatctttatttctttgtcttcttttttctctccttttcttccgccatcttttccttcctctttctctgcttctctactttctttcctccttccttctcttatcctcgcccttctttgtaaattgtatcaagctagctaaaagcatggggtttgcattttcaaaaccacaaatagaactgaacttactgtgaactgtatgtgaacaatgtgacaaaatatctaaaattgagaaagtgccaatgaaaactggcttagttactgtacaggttaaaatctggtacttggtcataaagtaggttgatcacaaagactagagctccattataaggatatactttctaatgaattttttactctaaattcagaatgagcaggaattataacagagcaaggttgcagaaagagcaggaatgtgttaatatctttctatcacaaagatgacttagctactttccacaaatatccatccctgaatatccattattcttcctagttccaccttaactgtgattatttccccttacttttgcataccttttttttcccccaaactatatctggtcaatcatagcatctgttttctcacaaatccagcttcttatgagtatcaagtcatgggttctttgcatgattcagcttcaatattcttttctaactaaaccattttgtggtaaaacatccattcaaagtccagagcaaatctctttgacccaattaatcatttttaattggctgtaccctagtccagttcatattttttcaacctctctatccctcagatggtttgataaggatatttctgtacatagatgaattatcttccatcttggtaactttacttatttctctcatcagtaaaggtcagagctgtttgtctcagattcataggttcttggaaaagcagaatctttttccacctaagatctaattctaccatcttctgctggctcttccaactagcatgtaggctcaatttcaacctctaatcatggccctcaaaaacttttagaacacattgtcctactttctgagcacagacaccactaaaatgccttgtttatagcattctttcagcttcattgcccttctttatgtattgctcatgaagatgtaagaactgaagatccaaaacaatcttcaacccttccttccaagcttaaattgcaattattcaaaaaatgattcaatgccttttgggttgagacattgtttcttttcacagaacattaacatagttcaaccaaaagaaactatttttattcattgaggtgacttggccttgttaagaccaggagaacctgactatgacaattgacatttgggtaagtgctttggtattgtttatttgactaatttttgtgtatgtcttgttggaaattactattggaaagtaaattgtaattgataatgcttctttctgaagttcttaatgaataaaaggaataagtttctttatagggacaatgcaagagtattcatctcagaagcaataacagatttgaggatgttgtgatgtctaatgcagtcctcacattctttagttctctgtatattagctgaatgtaaaacacaatgttatgatactatttcttacctccctaaacatcttacatcatcaagcataatagtcattcgtttactcacttaggaagaactaattgaggatctacttctgaaagccgggaattgtggatataatgattagcaaggacacagaaagacacagtttctactcctgatctatatagacatttacagagtgtgtagtgataaaacgtttcattaatactagagtcataatctattcattccgagttcttacacacctgaatcacaacataaggctttagtctcccctggatgctcttgtcttgctttccttgaattcatccttttgcaacaagtcatgctgggtacccatagcctctgtgtgaatagcactttctcatgagctaagaggaattatttttctcttcttcagcttgtcttttctaagctgggtgacaacaaccagtgtatcttgtcattgtctacaacatttaagattttatagccaattacattccctcataactacctctttcttttcataggctgtaaggattgtgatattatttttagcccttctagggttagattgagcctctcggcctctcatatgacttctattgccgtccttcatagtctttcacactagcaaagtgttgatacacatatctactggcattattcaagatgatatctttaaaaaatttttgtttatgcttcttggccatatctagaagatctgaatccagatgactctgtttccacataatattaaatgctatttcatatatataataatatatataacataatatatattatttcacatatatactagagatgaggtctcactatgttgcccaggctggagtgcagtggctatttacaggcatgatcatagtgcactgcagcttcaaactcctggcctcaagcaatcctcctgcctcagtctccttagtagctggaactacaggtgtataccaccacacctggcctaaatattatttcttaaacaaggaatcgctacctctttcttagagttactttttgctatattgcagtcttatcttagtcatatactcttatccctgtcttaacagtgtctctatgattgtaaagtaaatgacaaggtaaggagagacagtcacatatttgtcttaaaagtcaacatccctgatttcgatgagggcatacaggtccctcaaagtttgagatgaattaagatttcatttccactggaggtagaacttccaaagctgaaatgacatatataacaggaacaaacagaagatctcaccatcctatttctactttcttatcctcaaatatttttcttccccctcagttttttctgccctgaatttatagcagatattttctctttatgtacacttcagatgcagagttttagggtttaagtaacatcatttgcctctgagctgaaggtgtgaaaaaactgagtgtagagctactttgaaccctcagtgatcaaattattattgaccactacagcagaacagcatctctattttgatgatgaagagtctctgctttctctccactagccaaagagaagtttaggatctgaaaccttcaaaagaaattgagtgaagaaagcacaagcgtatccaaagacattcataatttttttccccatggttctcttttgcccattttcaattgatgatcaaaagctgaataattgaggagtgggggattttattctacccatatttgaacactcagttgtttctcagtataatctttttttctaacttaattatttttgtaataactcatctcaatttaatcaatcaaactatctatatagacattttaattcaatcattaagatgaattctcaaccttaccctgaccatgttccagtggagtggtttttaccctaaaaacatgctattttgtatccttgagcagtaaaaaggaaaaaaaaggcaactttcatcaggatttaatccctattctcaattagaattaatataaaaataacataattgtttttcctggctatttttatttagggcaaaagaaccaaacttccctaagattcaccagatctgattcctttgaacaggctgaacacaaccatcctctagcagaactctcctgagtctctctcaactccagtgcccttggatcctctgtcccacaatgacactagagtgcaatgcagcaatgggaaacaggtgggtcagggatagggaggcacaccagcttggagagcaacctgaagaagcagcagcagcacttagcctgatattagaaaagccagggttcagtccctattttgcgtcttcctcagccatgtgactttccacagttgataccatttttctcaatttcttcatctgtaaaatgaggaaattggtcatggtctcacaggctgatgtgagaaaaatgtatgtgaaaacactgacaccatcatgcactgaaagaatattaattcttcatatgaacttcaaggtttttcacaatgcctttgccaccttccttttacccttacacaccgaaggcattccatactcaggcttttaatggtatggggatgtggtcgtgggtgtcatgaaaatcaagcagcacaaagcaggaattcaaggtccaagttgaaactgaagctactgtagggggttaatcttggtgagaaaggaaaagagaagggtggagaccatagctgagaggagcttgtagtccccaaacttccagttaggtttttcttagatgtgtccacatctactacaccagtgcttttgcacattaacatgcaaatgaatcacctaaggatcttgttaaaatccagattttgatatagtgcttctggcctgagatgttacatttccaataaactcaagcagtggccaatgccaagggctgtggataacactgagtaacagggagccacatgtccctccatgacctgttgcctacagttcttaccacctgtcatgcccatgttcctgcattttaccttctagtaaggtcaagttgttcagagttgccaggaacactctagcgtcttgttctgttttgtttatgctataccttagttcatcttattctctatgtacggaatattcttcttactttttttttaaacttcaccaaaacattaccttcttcaggattttatcctctaaatctctgttatatgacactttcatatcaaggtttaagattatatggccatttctcctctaccagatcctgaagctatcaagaacaataatccgtttggttcttcactatataaccttattttctagtactctctgggatatgctaaagtattttgcagatatttgttcaactaagtagtgtataaagaacacactgaattttagatccattcctgactgaaaagttgagtatcgggtagaatgtcagtccctaataacatcttattatgtgttttactaagaaataacattcatttggcaacaggatgtgattgtgaggtaaaataaaagaaaacaaaatgaatcttgaaaaaattttaacaagcagcatagattaggctgaagtctatatgatatgccttgacatcagtgaatctctcttgtgcctgtcctatttgtgctgagatattacaaacggtcaggactcctgatggatgattgtgtgatcaagttctgacatttcctcaattctgttccttatttctgaggcactgtttcactcacctcccttctctttgcatttttctttctactgcattgtctatagtctttttggtgctcattagttgagccccgaagtgtttaggcctgcttctctacccttgtccttctttcccaaagctggatagaaggaaaactagtaatccatcatgcaaggaaagtgatcttctcccatagtcagttgggcaataaagcaacgcaacgtcaagaatatatttccctttgccaccttgcatccctttccattatgaattacagctatgctgttcttctctaaaccacaaagagctctcttgcaagcctgacactgatgatgggaaattagaatcgaaattctttattgatttaaattaataggcaaaagactgagaaggagatttgtagaaatgcaagtgtgtttacacatatatattcattttcttctaaatagcatattctattcccaacatacaaaagaaactcaaattagagattaacattacaggtaatatattttggcattacatgcctaatatgcttccataatcattaattattagaattgtcatataaaatgagaaccatttgttaacatttaatatgcggaactagggggaatcagtcataataaatgaaagtggttagacgctaatgagaagagctgaaaagtgataggggcatcatcattactgccttgtcaacaaagaaggcccatctgtacactgacataccaaagtaaaatgagagagagaggatgctgttatacattaccaatgctctagaggaaaagctaattatcattcatcaaaatggataatttttatttaaggtttttaagaaaaattaatgtatagtttctatatacttataaaaattaacagtattcttatttaaaattaaatctttatgacaactatataggaccatagcttgatgtatgtggaaataaaagcaaatgagtttgcatttacagatctttttggtatagaatttcattgtcattaagatgggtttataattataaataatgtaaaactttacacaactcagaataatgcagggtaagagacttttggtttagcaaaatttataaattattgggtaggtttcaataagaataggctattgcctgtaggtagaatttaatagataaataataaaataattggaagcaggtattgagctttaataagctctgtgctaagcactgaatgcacatattctaatccttacaacagcccagtgaattttatctaccttttattgcaattttagggttagacaaactaaagcagagagtcacccaaggcagctcatgtgtaagtagagaagttcacatgcagtgtcttttaaaattcaagtataatttttttctgtgaaaattggtaaatgaaagaaatctcagttgttcgtttccgacttgataaaaagcactgaaattaaagtagttctcctttttaagagtatgactgaaaattgttggcagagaaaaatacattttaataaacatgaactttggacttttgtttgtttgctaaaaaagtgaatgtttctgctaaatctaaaatttgatgatgttatatatgcaaattcttagctatcaaaaattacaaatgaagtatggtccaaattttcaatattcaaaagtaattattccagtaccaagtatttacatattattcaaaaatttcggagggggactttatgatataatgataaaaactggagtagaacaaatataccatctacctacacttcaaatgttacagagcagaatatctaattttggatttccagtaacttccatcccatttttagtggatgtctgagagagaaaaaccaagtcgtatcacagaataaataaaacagaaaaaaaagctagttaactaatatgaaagggtttaaaaaaaatactgataacttacattaaattaaattaacgtttaatgtgtcattcaatatagtgcttggcatatatcagttaccaaataattactacttactatgtctcttttctacatcactcctccaataactttaatcaaaagggtaattaactcacataatctttgcatagtgttcagttattaaaacacgtcatacaagagaggattctgggaagatggcacagtaggaagcaacaggaatatgtttcctcattgagacaacaattgctctggcagaatttgtctgatgtaatattttggaacactggagtctactgaaggcttgtgacttccaggggaaggcttggacagtaaagtgcagttaattttgatcattttcaggctttagtgcagcaacagctacccatcccacattccgagctctgtggcaggcagctgtgcaggtgttcctgtaacagcttgtggggataagggtgagcaaaaaagaccttgtcctgcaaatataaggaatctttggtctgatctccgattaattcttctgatcacagaagcacagataaagaagcaggtaaccgttattgttacatctgcctccattgttgtaagccccacctcctgtgactgaagagatttccagaggacttaaaggaccagcatgctcccccccccacaacctttttatttttctttttttctcccttttggaagccaagcattaataactagcacattcaaaaataattgtatatcttggaaaattagaaagtgacagcacatgcccaggcaaaaacacaggctcagaaaagacctgaggagggcctaagtttaactctcaggctgatccatggcacagaaacagcctaaacaatttttaaaaaccaataaacaaaaacatcaaactaagtatgggaaagatttccaaagttaccacattattagatacaaatgtccaattttcaacaacaaaaaatcataaagcatataaagaaagaaggtagtatggcacattcagatatataaaaatgagtcaacagaaactgtccctaaaaagaactaatggcagatttacctgacaaagactttaaaaccatggtcttaaagatactcatctttaggaagatgtggagaaagttaaaaaaatatgtatgaacaaagtataaatatcaataaatagcaaacctaaaaataaacaaattacggagctgaaaatttcaataactgaaaaaaaattacaagagaaattcaaagacataggtgaccagttataaaaggagaatctctgaagttgaagatgggaaaatagaaactatcaagcctgaggaataaagcaaataagatgaagaaaacagaacagaacccaaatgattggtgggacaccatcaagtgaaccatctacacattatggaagttccagatagggaagagaaagggaaagaaccagagagaacatttgaaaaaataatggccaaaaacttctcaattattattaaacacagaaatataaatatacaagaagctcaacaaactccaagtaactcaaagagcctcaagataagacacattataatcaaacttaggaaagacaaagataatttgaaagcaacaagagaaaatgacacatcatatatgagagctactcaataagattaaaagcagattcacatcagaaacttggataccagaaggcagtggcctggaagaaattgaaacatgtccaaataaatgaaatctaaggaatttccttacccgtagaactgccctgaaagaagtacttcatggagttctgcaaggtaaaatgaaaggacaccagatagtaacctgaagccatatgaagaaataaaggtccaaatgaagataaatatctgggaaattatataagataatattattataacaatggattgtaacttcactctttgttttgtttctttttattttctttctttcttttcttttcttttctttttttagaggcagggcctcattctgttgccaagctagagtgtagtggtgcagttgtatctcactcaccttgaagatctgggctcaaaaagtcctctcacctcagcctcccaagtagctgggactacaagaacatgccatcacaatgagctattttttgcttattttttggtacagatggtgtctcggtaagttgtccaggctggctggaactcctggactcaagcaatcttccaggcttggcctctcaaagtgctgggattacaggcatgagccaccacacccggccttcactctattgttctgcatgatttaaaagtcatgatttctgcatgatagaaattattaatataaatgatagtattattgaaactttggtttataactgtacattttatttacacataattttaataactaatgcatttaaaataattattaggttatattttggggcacaaaatgtgtaaagataaaattgtttgacatcaacaactgaaagaggtggtggtgaagctgtaaaggagcagggttttgtatgtcgctgaagttaaactgatataaatccaaattagagtgctacaattttagaatgttaaatatagttcccatgctaaccacaaaatattctatagaatatgcacaaaagaaaatgagaaaggaatttaacatttctttagagaaaaatgaactaaatgcaaaaggagaataatgcagaaaatgagggacaaaaacagttatgaggcatataggaagtaagtagcaaaaagatagaagtaaatctgttcctatctgtaattactttaaatgtaaattgattaaactctatagtaaaaatatatggattagtagaatgcataaaaatacatgatccaattatatgctgcctacaagaaacttactttagattcaaagacacaaataggttgaaagtgaaagaatagaaaaatatattccatgaaaatagtaatcaaaagagagccaggatggctctactagtatcagacaaaatgaacttaaaataaaatagtttataagaaataacaaagggaattatatattaatagactgttcaatacagtaggaagatataaaaattataaacatataactaatattaaatcttcaaaatacataaaataaaaattacagaattaaagggagaaatagacagtatacaataatagttgtagacttaaatacctaactttcaacaataggacaatcagattgaagataagtaagaaaatataggacctaacacaataaaccaactagatctaccagacatattcagaatactctgtccacttaacaacgcatatattcttctcaagtaccctgggatatttttaatgattgacctacattaggccacaaaggaagtctcaatcaatttaagaaaataggccgggtgtggtggctcacacctgtaatcccagcactttgggagactgaggcaggtggatcatgaggtcaggagttcaagaccagctgggccaaaatggtgaaaccccttctctactaaaaatgcaaaaattagcaaggtgtggtggtgggcatgtgtaatcccagctactcaggatgctgaggcagagaattgaacccaggaggcggaggttgcagtgagcaaggatcgtgccactgcactctagcctgggtgacagaacaaggttccatctcaaaaaaaaaaaaaaaaaagatatcatacaagtatcttttctcaacgaaatagattgaagtcagaaatcaataaaataactaaaactagaaaattcacaaatttgtggaaattaaataacacactcttaaataatcaatagattgaggaagaaatcacaagtgaaattaaaaaatacttagcgacatgaaaatataaatacaatacatcaaaacatatgggacatattgaaagtgctgagaaaatttatgctacgaacacttaaatttaaaaaattaaaaaacaaactcattttacaaattttgaaattaaaaaaagacaaattaaatccaaagctagaagaaagaaggaaataaataataaagattagagataaacaaattagagatagaagaaacaatataaaaaataataaagcaaaaaatgtgttctttgagaaggtgaatgaaaatgacaaatctttacctatataaggactaagaaaaaagagaaaagatccaaattactaaaatctgaaatgaaagtggggacattactattgattctacagaaataaaaaaaattagaagtcaatactattaacaatcagatgccaacaaattagaaaacctagctgaaatgaacaaatttctagaaacacaacacctgccaagaccaaatcatgagaaagtagaaaatttgaatagatctataactagcaaggatattaagttagtaatcaaaaatcttctaagaaataaaaaccctgaaacttatgtctttattcatgaattctacttaaaaatttaaagaactaacacccgtccttctcaaacatttccaaaacatcaaagaggacagaacaccccaactcattctacgaagccagcattacactgatagctaagccagacaaaaacattgcaaggaaatgaaacaaaagaccaacatcccttatgaacattgatgcaaatatcctgaataaaagtctagaaaactgaatttagcagcatattgaaaggattttacaccatgacaaagcaaaatttatttcaggaatgcaagaatgattcaacacacacaaaaagtcaatcaatgtaatatatcacattaacagaatgaaggaaaataaaaaacacctgattatctcagttgatgtaaagatgatagtttacaaaattgaacacccttttatggaaaaaaagaaacactcaacaactagaaactatatccacataagtaaagccatatatgaaaaacacacagcaaacattatcaatggtgaaagactgaaagcttttcctgtgtaggaatcaaagcaaggacttgcactttcactatttctattcaacatagtactggaagttatagccagatcaattaggcaagataaagaaataaaatgaatccatattggaaaggaagaaataaaattatgtctatttgcatatgattttatatatagaaaatcttaatagttccacaaaaaacctgtgagaataaacacatttagcaaagtagcaggatataaagttaacacacagaaatctagcatttctatgtaataataataatgaataatctacacaggaaattacaaaaccaatgttatttacaatagcataaaataaaatgcttagcaattaacagagtcagtcaaagaatatatgatgaaaacaaactttgctgaaagaaattaaagaagacataaacaaatgaaaacacatgtcatgttcatggattgaaagatttaatatcgttaagatgtcaatactaactaaagcaatgtacagaatgaatgccatccctatcaaaatcctgatgtcatttttgcagatatagaagaaacacatcctaaaatttatatggaatatcaaaaggatcccaaatagtcaaaacaatatttaaaaacaaaaacaaaactggaggactcgcccttccgggtttcaaatattactacacaactacagtaatcaagagtgtggcactggcatatagacagacatataaaccaatggaatagaatagagagcccagaaagaaacttttgcatatgcagatgtcctttaacttatggtgggcacctgctaaacctatcatctgttcatcaggattatgtcctgataaatctatcatacgtgaaaattatcataaggcaaacatgcgtttgtcacacctgaactaccaaacatcaaagcttagcctaacctaccttaagcatgctcagaacacttacattagcttaaagttgggcaaaattatttaatacaaatcctgttttataataaagtgttggatatatcatgtaatttattgaattctgtactgaaagcgaaaaacacaatggtagtatgggtatcgaacttacagtttctactcaagatgttttcctttcacactgacataaagtaaaaaaattataagttgaactattgttaagctgtaaacagtgtatatggtcaaataatttttgacaaggctgtcaagaccatgcaatgggaaaagaacagcctcttcaacaaatggtgctaagaaatctggatattcacatgcaaaagaatgaaattggacccttgcctaatatcatataaaaattaactcaaaatgaataaaggacccaaatatcagacataaaattgtaaaggtcttagcaaaaaacataggacaaaaacttcacaacattggatttggcaatgatatcttggctatgacaccaaaggcacaggcaacaaaagaatagacaaaaaagacaaggtggacttttggaaattaaaaataattttgtgcattgaaagacactatcagcaaaagacagcctacagaatggtagaaaatacttgcaattctgtctgataaataattaacatccagaatatggagaaagtacctaacatttaaaaacagaaaaacaaaaatcttgattcaaaaatgggcaacgaacctgaatagacacttctccaaagcagtggctaataagcacgtgaaaagatgctcaacatcagtaatcattagtggaaagcaaataaaaactacaatgagataccctctcacacccattgttgacaaagtactcacttcttcatagctactctcaaaagaacagaaggctactgtcaaaataagagaaaaataaatgttggtgaggatggggagaaattggaacccttgggtactgttggtgagaatgcaaaatggtatagttgctatggaaaacagtatggcaatgcctcgaaatattaaaaatagaattaccatatgaaaatgcaattccacttctaggtataaactcaacataattgaaagcagagtctcaaagagatatttatatacccatgttcacagtaatgttattcacaacagctgaaatgtagaagcaatgcaagtgttcattaaaaaatggatggataagtctaatatatacactatatttggcacacacacacacatatatatatgtgtgtgtgtaatggatattaagtcttgaaaaaaagcataaattctgacatgttacaacatggatgaaccttaaagaaattatgctaaatgaaataaatcagtcacaaaacgacacatactatcagattgaacttatgaggtacttagaatagtcaaaatcatagacagatggtagaatggtggttgcagggcctggaagtaagggaatatggaaagttattgtttattgagtattgagtttcagttttacaatataaaaaaatgttacagagattgatgttggtaactgttgcacaacattatgatgtatttggtacactaaactacacatttgaaatgggaaattttatgttacatatattttgacacaataaaaaacctagggataaaaataatacataatttgatatctgttcgaaccctacattgattagaatgttacacagcctccattgctccatctagtgctaggaaaattataacagccatttggacaagcaattttactgggttgagatatagcacataatctctaacttttagtcaaaaaccaaagagtatttttactgtatgttgcactctagctagctttgtcctttggaatgcttgctgacccaatgattaattaatatcaaagaagactcttactacctataaaagtcaaccacttaacaacatcaaacttcaaaagaccctcttagtgcccctgggtctccttgacagtcaaggacagagaaaaggtaggtgcatgttaacaaaaacatttaggaacactctttccagatccaagcaatagcaggggctaggtcagtccttcttcaattcaagtatgcaatggagtcagtgagcaactcattacaaattctgattctaggatcccactcccagagttgctgattcagtagatgtaaggtgggttccagacatcttcatttttcccataaaggattatgatataggttgtctaagaattacactttaaagaaatagataggtaggtccagtctgaaaacacccaagaggatagaaaggaagagaaaatgttacctgtttgcttcttttcctccacaaccttattccagtcctacaaataattaaatttggctttcactgatttttgcttgttttacctaccttttccaaagacactaaaccttgtgtgaaagatttgtggaaaggattctctttcatcgtcaccttttatcctcctctagacatagctatgaagaagtgattggaatttaggatgactgtggtctagtgagcttaggaagctgagtttgcctttcctatcctgtggataaatactgtagggtttatatggtaccctctatattgaactgcaggacaatttccttagtgacctgctccttatcaagataattaccaaatgccctttcagcctcaaatctacagaaatatctttatcctccccagctgttcctttatagtctcttctctcccattccacgtatggatagtagtagacatctccacatacgatcttgatgtggagatgaatctgtttgtaaaattcataatctgaaaaccagataggcaggtaagctagaagcatctttattcttttattttcaattcaggtaggtagtgctaaaatccttactcatttattttcaattcaagtagtgataaaatttccactgaggggactggttgctgctgcagctaaaagatggatgtgtaaggggagaaggagttaatagattttatcagggttctttctgaggtgtggactgtcattctcctctaattctaaacctgaaaagaatgctgaaggaagctgacaaggctctttgaagatgttttgaagatgttttcactggactggagctgctgcagtggcaccccaaggtggcacttctgtgaatacatcaactcataaatattcaaatcgaatcactgggtgctaccagcccaaccattcacagtagagtgattatcaaccaacagctttaagctggtacacctcctgctgtgatagtttcagcgaagactttgttagagtgttgtcatccattccggatgagatgaagaaggaagctctcaggattctacttgcaaatgtaaaggtgatatttataaaggttcaggtgcctttcctaggcagagggaaaatatgagaatgacagggtgcattaaaagcagaggccagggaatttaccaggcaggcttttgataacaaccctatctgtagagagtggtgtaagtaaaacttggtgcgtaggtcaggccagctgcctaagaatcaccaggaacttggtgaaactacatattcctgtactccccttatatagattttttttttttttgagaaaatttgaagtggattccaggactgatagatttatcgtgctttccagagatgacttgtagccatggttaagagccatagtaaataaaccaaagccataagaaagagggttcttcaaaaatttcaaacaatcagcagcactgaatgaccgtcacagccactaatgaagtttttttttttattattatgatactgaattgtaaaggttttcaacatgtcttaaaattgacactttcccatggggaagtagggtctgcattctctcccctggaacctggactaaacttagggaatgattgactggtagagcacagaggaggtgatactcggtgatttccaaggctagatcataaaaggcaatagagtttctgcctgattttctcaaaatacttttccttcagagctttgagccaccagatgagaagtctgagttttgtcatgcttcacatgaagacgtcactgtaagcattttggctgacttccccagctgagatcccagccaagagctagcattaactgccacatatctaagtgaagatgcagccagatattaccagttaccaaccactgagccattcaaagccacagagtaactcccaggcttgagtgatgaacttccagatatcatgaagcagaaacaagctgtctccactgtctgcccaaattcctgacccagagtctagagtataacaacatggttactttacagttaaaagctgacgggtagaacatacagcatgactagaaagtttgcaaggcattgggaacagagcaaggattagagaatttgccagttctagctctgtcactcaattatccctatcattctgttaaaacgtgtgtgactttgggtaatttagtctgcaggctctcagaagacaagttttctaaaatgtaaaatagagggaaaagcatatcttaagattgtaataaagattaaaagtggcactgtggatgaatgtgcctgacatgttgcctgttacatatgagaataaattctcacagtgaaaatttaatatgtattgctgttttctttttttgtgttgttgcagacaccattctaactaaataacaaagatctctacataccccagtgtagatcaaagttattaccccttataattgaggaaaatcaatggaatgcatctaaattgtgtcaaacaaatctcaagatggaaaaaagtactatctgtccttcccaacatattccttaaacagatgagatattttattgaaatgcttattgcggatcagtgaacccaacatttgcccatatgaggagtcatttttaaatattaaaataatctccagacatgcatataatagtagtatttatgttagaaaaaaactacatattttgttactaaccatggcttctatctacatataaaaatatcagtatagatctgtcacacagcctacaaacaatactgtgtgtaaactcagatccaaggctctattagaaaaagtgcctttactgctcagtaaacctcagaacctaggaattattataacacataaatgtctctttctacttctccgtgtctagactctctgaaagtgatactacataaccacatccagttgggcaattctttgtaattttctctggctctttcaacataggagaagaaaacatttctgatgacctctatatgtatcatcctcagtccccctataaaagaagttgatacaattacttatgtggcatatggagataagagaagctaaatgatccttttatggatccagatggcttccatatagctaaggtaatgacatttaaacactttaaaaatggatttttgttttaacaactccaagtaatgcatagataaaatggagtctctatgaaaatatagaaatatcagcaaactctcaaaacctttattaagaatgtaatccaaattaacttaggtaatttaaactacaaagaagtagaaaaaaactaatattatatataaaaatagtgttaaaaagtgttttttgttgttgttggtggtggtggtgtagtgttagctcaggttctattgaatctcttttaaaattacctggaagaaggattattttcattattttaatgatctcctagataaggaaacagtagaaatagcttattaatgaactttgcaggtgataagtgaagatgtatggcaggcacctttgaggctcctcagatgtcatataaattgaccagagaggatagtaatatgacttgaaaaatcacaaaatgagattcagcctagaaaaatgaaaaccaatacatcttgagcaaagtaattcaatggacaggagaaacctggtgagtggtaatgctgaaaaaagacctggagctgataatggaggacaaattagatatcagtttgcaatatgatatggctgccaaaggggctgatgctatttcgaattgaatacaatgatccattatgttggggcagagcaaaaatatagagaaatgactcccgccttccttgactctggttcggctaaggtaccatcaggctcctcgacacttgaaatgtgttgagaaattggactcagtacggagaatagcactgaaatgatgaaagaaatggaatgatgtatttatggaaaaaggttaaaggagctgaacatgtattggctggataagcaatgactaacagggctggggtagcactaagtcaacatttgaaaggtgtaatttccctcagagaaaagggctatataaatgtaaaataacagtaatagtattaaaatgccatgggaaagcacctaagaggggatagggcagacttagtgtgaggttagtgatttaggtaacatcctgacctcagccatactaacaatagtcctttatttgccatgatgtcattggaaagtactggagagaccctcttcccacttgcaaggtagagaaacttgagcagttgggagttgttactgggaacaattgcattttgtgtactgtggtttcagtgcctttttaaatactgatctccattaccccactctttagactaaattgaatgtcctcatccttatttccagaatgcacatcaaatctttcttttgattatcaatctctaggaactttcctcttctaagtaaaacaataaaggaaagaaaataggggatctgaaccaatttatagtaagatgctagtatattagataacagtttaatacatttctcaaatgtatgaacaaaggataaaacattgtttttctccacaaagaaatctctgttcaacggatgaggaatatgttttgatatggatcatccctgtgaccttcaaatgacattccctaagctttcagttggaaaaagcttatattttgaaatgccttctagactattcagagctgtgaaaatagctgcagcatagtcttagagattgaatgggctcaatttaatagatatttggggttttccattaaaacctcaaacatcaagagcatgtgacatgctttatgacataggaagctgcatgggggaaattttcatgcagttacaacggtccaagatatgctctattggaagcatagatgcaagagaaatacaacttagcttcttttcagctctaactttctatgactctataattcagtgactgtaggatcattttcatgattcaagagtaaatattgatggattctttccaaagtgaaaatgtaagaaataaagtgaaagagagatgaatagttgttccattatgtgttaagtatttacaatactaaggagatacagtttaggaacaaagtaagtaatgaagtataatgggttagcacacaaaagtggaaaaatagaaaacaaaaacaaaacaacaataacaacaaaaaactgccttgaccatccatctctgatccctggagtggaaagaaaatgtgaaatttctgcacctacttgtgatggatttggaaagacaggttatcttgctcaggggaaactttaaaaagtcagacatctgctgtagagcaaacacagtgaaacatgggtcactaaagagcccctaagttacagaaaggacaggtttgtgaccctgaaagtaggcaatgcaaacagagtaaaaacccaccctagatctgccactgactggcctgaagggattggtggggaatgtggaagcaatataataatcaccagggtccacttgttatttatattctaatggtaaagaaaatagcttcttaggtttcaggtaatttcctaatacaagtgctttaatggaaacaagatagtcacctgaggcagccagtttagccaaacatggtcagtaaaatgcatcatgccatgtataagatggtctgtactgctggccacaggcaatctttatgatagattcaggtcattcctggttcactgatagcgtgggtctctgtgttgattattaatggctaaacataagaactattttggccatatctcataaatttcttcatcttcaaaaagcatggcctaggtcaacacaacataagcaaaagatggaatgcaggtcacccaccctgaactgcatagacacacagaaacctgaacagtctagcttcatttcaactatgtccagatagggtaaccatatgatttttttcaaagaaaactggtagtttgtagttttcagattacagaatcactctacaaacactataagactgtaaatgtattattcctgagtaaaagggaaactggataatatatgaaaatctccttgtcacaatatttaggtaatattcatggaaaaagaaaattttcatgaaatacaaggaattaaactatagagtaataagctcatcatgtgggtaccaaaagcaagcaaataaaaacttacctggctcctatggaagcacgtgaataatggcaccaccttttcccaaatgccgagtagctctgctgtatggattggctacaagttttaggtcacaaatgtgctgaactttctccttaaaagcccaactctgctgtgattacactggtacagataagaggcatatatgaagattagattgaaagaaagaaattgtagaagaaaatgcaaataacccagaaatccgttaatcacttaaggccttggggtaagaaaaatctaagtacaaagcagaataaatgattaacagccaaagatggaagaagggggtgatgagggggagaacattattttaatttaattgcatgcaaacttgcaaggagattccagaaatcattcaacagaaaagattttattatactcataaccctaccttcaccataccctattcactaaagaaatctcctgcctctaggctcttccactctacctcctttaattgtcacatctgaaagcacctggtgccaacacgtaaaaatcacaccccaaatgatctcaactctaattctcatgcaagctctacaaccattaatctagacacaaaatgtgttaggagctttctatgcatatttaatcaatacaacaacccaaagaggttaagtattattaccctaatgttaaagaagaggaaactgggaggataaatatttacttagtcagtctagcactgaggttcaaagccaagtttgactaactccaaagtttccagcaagaatcaatgaaaaagagataggtttctgtaaatccatttagatcccactctttgatttctatattattcacggtaggcattccttaaaacttgttttgatctcctttaggatataagcaaatagattgtaatccctgtgtgtatgtatgtgtgtgtacctgttacatatttgatttgtttagcacatatttattgaacacataattctgcactatgtactgtgtgaaggactgtggataaaataataaggatgccctctgctctcatggagattactatttgtctgctttgcttgatgaggcaagattccttaaaaccaaatagtagccaatgtacaaaaaaaaggaagaggtttgattcttagtaatttattaaagaaagaaaatgtgtggctacataacagagcaactgagtatgagatatcaacctcccattactactgttgtcattatcattatactatagttataaagtaacttaatattgtaaaaatgcagaaattagaattctgcagggctgtcaacccctcagagcaggggtcatctggagaaatgagaggaactagatatcggccctgtagttcaggacttggggtgtatcaatcttctcttttctgtaaaggaacagataaatgactacctaatgtacatggcaatcattggaatggtatttctccagtaaatttcagaaactacaactgggtggatacttagttacattcagtaataaaactgttcataatttcattgatttttaaaattttattttttagatatttatttttctccagtttcataataatgttattttttagaacttctgagatttgtttgggttttatttgtttgtttatactgacctaaagaagaaaaaaatatattttgttaatatctagcccaggaagtttccctaaaattagatatagcagtgtcggttgctagttcagctactgggcctagagaagctcaggctcttatgtgataaaacaaaacaagacaaaaccaaaacaaataaacaaaaacccagagaagcagaaaagagaattagagataatcataataattacagactgcttccgactagtgttttccattactgtgaatgccatacttggtaaagaaataaatacggtgtgccatgcacataatctaaaggcagaatctgttctgaaatgagatgaaggaagaaaccagggtatattctaccaattaaagtgtctgggtgcaaattattaaaattactatatatcctaaaaggattagactctagaacctcagtcagaacttatgaaaatataaactaattttttcattgcaaataaccatatctccatttcaagaagatggattccgctttgcattgttatatgtttctgctaataagattttaaaattttatgtgagcatacatgcccaataagatttttttctcttgaattcaggaaacatgatttttttttctaagggttagttttatctttttttttttttctttttgtgacagagtctcattctgttggccaagatggaatgcagtggtaccatctcagttcactgcaacctctgcttcccaggctcaagcgatcctcccgcctcagtgtccacagtagctgagaccacagacgtgcaccaccacacctggctaatttttgtatttttggtagagactgggtttcaccatgttgtccaggctggtctcaaactcctgagctcaagcaatctgcccgtcttggcctcccaaagtgctggaattacaggtgtgagccaccaccacattacagaattttagaagtaaaacagttgctagaaatccttgtctaacaccttcatttttcagaatatgatactgagtaccagaggggctgtatgtgtcgacacatgtcacatagatatttcaggcaggcctgaaaatttattcattcaacaaacattcattaagtacttcctatgtgtcagttttgtttctacacatatcctagagcagtggtcttctaacatatcaagagtcttctctcactcaacacctttgaatccatatgtttatttatccgccagagtaagattaaatagcacaactcatccctctacccctaaaatcagtttctggacttaataaataaaatgataaaatgatttatttatgtaattttgaaaaatatacaaatgatactcggtctatgataaaacactaatacagaaaaccaactatatacaaatgtagggcaaacccagagtgttgctggaacaatatacagcaagtacattttctaatcttgcttatggctatactttgagcattaaagtgctgatacttttatacttaaataaaaccaaagtcataataataacaatccttccttctattcactctttatgacaggagctttgatggtgagggccaaccttttgcttgtgcatacagaacttgcttcttcttccctatcctaacccttaacttgaagaagtattttcacggttagtaggtcagtcaaataactgcttcagaaaacaaatattggctctcaccagacttacaggcaaattaattttggtctcatttaacatggtcaggcagcaacttaatgtgtgtatagagaattgatagtaactgtggttgaaggatttgataacttatatctgatataaacttccttgtgctctctttcttgtactagctagttcagtcactgtctctctctcccccaacccaccccattttcttttaaaatatttagatatatttgttttcatggaattcaagaatttctattttagaataactatgaggcagaaattgtaggtaacgtgacagtaaaataaaagggtaagcacaggaaaaaccaagaggacgggaccatggctcatggtgtatccacactagaactcacgaagcccacagccaacttcagctcatcttttgcttttatttatattcttatcaatcagaaatagaaatattatattttaaaatgaaagaatatggcatggtagaaaaatatcgaatgagaaaagggaagagggacaaggaaagacagatataaaaagagaatgagatgaaaaatactactgcccatcacttagccagtatttttttacaagcaaattttgaagcatcaatgtgggaaaaataaaaaatcaaaatctggggtatgtagagtgactatacatctctgctttccaggaaaggtctcggtgtatatctggtactccagcataattatcggtagcaatccttccactctcgaaatttcacagtttgaaccatcaactatacagtcaccctaaggatagaaattattcacgataggttggcaattttacaattgaataaatttggtctcatttctcattcacgacctgttgtttgtaatatagacccctttgctaagggatcatactctcttcatgcctcggtacaatgaatttgatccaggtcagaataaactcagctgtaattgcattcttgaaaacctctcatatggcagagtaagtgaataaggaacccataccaaaacaacagcccaagtgtatttggcattctgatttcactgtcatgcatttaccttcctttttctttaacaaagcacctgacattcaaggtttgtttcatcctgtcctatgagaaggaaggggaagcggtggttacaaacagcctcattgctaggaataggcattttttaaatccctgtaaccttaatagtaatttagaggccatgactgtgtaatcaccagaaattagccttcatttccatttcaccgaaagcatttgtgacagacattttttacctgtaaagcaatatatacaaactcgtattaattcccaaccacagaattaatcctcactagaagctgcattcaaaacatcttttcttttaacctattacttctgcaaaaatttaacacatcataaaatgagatgataatatcaaaaatctcctgaagaggataaagggcaacaaatacttttatttattattggtgacactcttatttatagttggtgacaaaattaatattcggaaattacctggccaaagctattacttttaaaatatgtattatctttgacaagccaatcctacttttgtaatctgtataatttttaggaaagcagtatcttggttcagactgatggaatttcaatcttggcttagcttctcggcagacctgtgacactgggcaagttacttacgcttccctcagttgtattccactgaatgtggataatatctatatctaatgaataggactattgggaaaattaaatgagttagtggatttaaagtgtttagaaaagttctgcactaaaagcaatcaataacagctattattattatgctttagaaataaaagcaccagcacacaaggataatactgaaagtgtattatattgtttctcaatttaaaaaatgaaaacaactggctatccatcaatattagaataattaagtatgatgtgaagtccatactgtggaatattgtgtatctcaaaatttaaaaaatatattagatatgtgtctattcttcttgctggatttttttaatatgagaagcaaactgtacagttatttacttagtatcatcatactttaaattaaaaaagaaaacagaataatgaccccccccaaaaaaactacacacacacacacacactctctctctctctctcacacacacacacacacactcacatattccttcataattttttagcatttactgtcaggcactgttatagcattgggttgcagcagtaaacaaaacagacacaaatattgaccctcacaaaatatattctaaggtgtgaggactctctcacacacaaataaatgaataaataaaatatatattatatctggtgctaagtgttacaggaaaaaaataaagcaatgtagtcacacgcctgggatttccaatgaggcaacgatggttaagggaatactagcttcacacagggtggtgaagaaaagtctctctggggaaataaaaaaagaagacgtttgggcataatcctgaaagatatgaagaggtgaagtatatttacatgttttctgaacatgtgcatatgtttgtatattttgtgtgaatatggaaggaaaatatatgcgaatataccaagttgttgaatgtattacatttaattacttcagggaggctacatgttggggatgtaaagctggaagaggttttaagtgtcttctttatacatttttatttgtacatatgttactttggatattaaaataattgattaagaggattagagctaataaataaaagagtaagtggaggatggaaatgagcccacgaatcagaagaattaatttccagtcacagcacatagcaggtactaaataaatgtcagtctaagtaaaatttgactgtattctttcaccatttaagtattctgcagataagggcatctgagccctgcagaggtacaactattggttaaggacacacaaatactaattgctgaaactatgtaccccatatgactgtcctcctttatctgtggtttcactttccatgatttctgttactctcagctgcagttcgaaaatattaaatggaaaattctagaaataagcaattcataagtttcaaattgcactgcattctgagtatggtgataaaatctcagatcaatcttgttctgtcctgcctgggacataaattatccctttgtcctgctcatccctgcattagtcacttagtagccatctcggttatcagatcaactaacatggtatcacagtgcttatgtcaaggaacctttttttttttttacttaataatggccccaaggcacataagtagtgatgctagcaatttgaacatgccgaagagaagccataaagtgtttccttaacatgaaaaggtgaaagttctttacttaataagagaagaaaaattgtatgctgaggttgctaaggtctatggtaagaaaaaatcttctatccgtgaacttgtgaagaaggataaaagaaatccgtgctggttttgctgtcactttaaactgtaaaagttatgaagtgccacagtgcatgataagtgcttggttaagatggaaaaggcactaaatttgtggatttggtatcatccatggtttcaggcgtcactgagggtcttgaaacatttcttccacagagaaggagggatgactatacccatttttgccaggggatttgcctttataacatcctcggtactttttgtaaagaaacctctttttttttcagccctgaaagtttcaataaactgcctgagagtttattgaaagagtttgcataacggaggaaggattcaaaagttcggatttgggggagtagaattgaagaaagagctgcattgctgagagtgaaggcagtgcacctgctgtgtcctacatacactaccattgattagtttaaatttctctttgtttatttcccacaccctaccttccaatggagatgccattaaataggaaaatgatcaaaagctagacatgtgaagggagaagatacagaatgaggacacctcagcagcattagtctctgagtaacggagaagtagctttggaacctgacaggggaatggcaggagagttcaccatgggtatgttggaaagggattctgaagaattttccagagtcagcagcatattcacatatgtacccatacattctgagctctcacattacgtgtaattatattccttgtcaactcaatacagtaagagctcatcagcctggactaaacagactcttcccaataattataagaatactccactggaaactacagaatggatggcggtgatgaactaattaaatgaatagaagcatagccctagaaactgttgtctgtttatctggaatgcagctgaaatgtgaaagattcttttgctatccagtatcattcccttcaaactagctggctcacacgtaatgtgaataaatacatttggaagtctggaaatcttcaacgaagttcaaggaaatattcaactagaaaccaaacaaaagtatatctcattgcttctcagggacaaatatcaactaactccttatttcaatgtattaatatccccaacatgtggatatatatcatcctctttcagtgaacaaagtgtgtaaaatagcacttagaatgtcagaggaaagtttagttaacccttcaaatattgtgtcatgcttcttcatcagctccacagtttggttaaaaggttcaccgcttcaccgtatgtacaggcagtggaaggagacaccaactctaggtgtttaagcagaaagttccacttcttataaaatgattccatgacttctctgacgtttccaccactagggtagtcaacacaaagggaatctttaaaatccacacatcactccacgaatacctgatcatcattgatgtggaattagtttatcatggcagccagcggagagcaaagttctaaagtacatactatgaaagagttgggttgaggaaaaagacaatgagatagattcagagcatgggatcttgccattcaaccctaacttacatgagccctaagggacctcatatggtcagtagtgcaaagagaaactgaaggcagcaagagaagtcacaagtagagacagaagaactgaggaaaggcaagccaacctcatttactttatactgtcagctagggagaaaactgagtctaatgatgggtcgttaaataaatctcctttgaagttttgtgctctaatgtggaaatagtctctgttagatacacagtaatagttcttttacctagtctctccagagaatgtgatgtacctcaaagtaaaacattcaaataactgaaagttatctcgttaatcttaaaaaacatgcttttgtttaaagtttttcttgtaactaattataaaatatatcaatcactttctttaattcatatgtatttcacttcaacaagcacttgctgcattgtataataatgacttttttggggtgtcttgcatatttatatagggttatttgcctcaatgtgaaaaggctcaaacacttgtccaaagtttatagctgtatagtttgttccctgtgtcattggttgtctgaacaaagagatgtttgcttctttttctaaaatgtagaatttcatacctaacttcgttaagattctaaatacaggtcagcttcctctacaactcattcagctgggctctgtacccttagagttttctcatttgttcttgtgttcaaagacatgttctgggtggaagtgattagctaggatctgacctctggataatcagggtggtatgcttaaacaaagacattaggttcatgagacagagatacagctgcaggcaaaccaagaggaaatgagggttaataatactgcatgcctagaaatatgacgaagttataaaaagggttaggtgacctaactgggaaaatttagacaaagataaattttattcgtctactcttttagtgaattactcaaaatgatcaattaactctggctagttctgcacaagagttatagttggaaccatataattatagtacttgataatatttaatttagaactttattataaactgccttggtattgttatttaattacttcgtatgcaaaagttatgttttttaaaaggaccatgcacttcttgaagacagagatcctgtcttcccacctaatttgggttcctctacatcctcctacccagataatccagtacgtgcagagtacactccataattctgtaccgaattgaaatgttacatatgaatcttcaaaattaggatagtacaaacctctttccagaactatctaggccagtgacaatacaaaaaaatggagagaagaggcaaagagtatagggatattatataataaaatcaaacaattcattttccatcccatattttaatataatgaaatgcattgattttataatttccactgaaagtttacatatatgagcacgttgacacaaacactggactataaattattaacctacttcaggaaatagtcgtttgtatgtgttaacttaatgattcaattaaaataaagttcataaaaatcattgtaggagagcttctaagatttcccaattgcctttccattcaatggttttgtaaaaaattttattctgaacttgacagctatgagcattactaatagagtttgactgaagacagtattatcaggatctgctaaaacccttcccacattttccttttcacccttgaagctggagtcacttaatgccaacatggacttttaattctgatcaggggatatttaaaaagctgttagctaatagaatagttggtcttgcttaaccctcatacccagatctgactttaactgattgtcctgtcttttccagtgttccagccatataccctcggttctttccaagacatcgctgaatcaaaatccaaagcaggtattcccaaggtcagacacttctatgcaaactccacaccttattgatgctacctgcctcttcatgtgtactgctatttataaccaccttgttacaaacaccttacttagttcaggccttgtcatttcagccttcactgtctctactgctattggagacatggctctggcaattaccaaaacattgttgtgagttagtctttgttgaatttgcagaatcatagtcccagtggctttcccttggcaatgaagaagcttaaatatttcctcatagctagaatcacacaattataaaattttacagctcacagagatgaaggagatccttcaagtttaaagctgacttgggcattgcatgcaaatgcaatgttttatggtaggttgccttataatctgccagaggaaagactaaacatatatctactacctatgcatactcaaaaggaagtaataggaccaggatagacactggggtatcatcaatggttttgtacttccagagggaaatacagagaaagtaatcaaagactttaaaactacataaaaagctctctgtctctctctctgggtgtatatatgtgtgtgtgtgtgtgtgtgtgtgtgtgtgtgtgcatgtgtgttatattttcttgaggaagagggaatttagaagactgagatgaacacaacatgtatatcaaatggcatgactgattctccaacattccattatagatgctgtttgtttattacataataatacataactggcttcaacagtgattcaaataagtagctcattgtattagctattgattctataaaataaaatcgatgacataacattaacttgttctttaccatatatatatatttgtttttcacatttatatgtgcataaatattctgagttttaagatttgagtaatatctgcagtaaggaaaaaaacagcaagccaatttatacagtctgcttcacattttcaagataattcttttcttaaaaaaataagcatgcctgctgattgggaattactgtataaaaatgtcttatttatttgacaaaagtgcaaagaacatacattgggaaaaagacaatctcttcaataaatggtcctgagaaaactggatatccatatatagaagaatgagacttgacacctgtctctcaccatatacaaaaatcaaaatcagatgggttaaagatttaaatgtgagacctgaaactatgaaattactaaagaaaacattggataaactctccacaacattggcttgggcaaaaatttcttgagtaatactccaaaagcacaggcaactaaagcaaaaataggcaaatggatcacatcaagtgcaaaggcttctgcatagcaaaggaaacaatccacaaaatgaagagaaaacccacagaatggaagaaaatatttgcgaactatccatctgataagggattataaccagaatatacaaggagctcaaataactctacaggaaaaaatctaataataatgggcaaaagatctgaatggacatttcccaaagaaaacatacaaatggcagacaagtatataaaaaggtgttcaacatcattaatcataaggaaaaatgcaaatcaaaactacaatgagatatcatttcattccagttaaaatggcttttatccaaaacacaggcaatagcaaattctggcaaggatatggagaaaggggagccatgatagactgttggtgagaatgtaaattagtacagccactatggagaatagttcagaggttcctcaaaaaactaaaaatagaattaccatatgatcaagcaatcccactgctagctatatacccaaaacaaaggaaatcagtgtttcatagaagagataactgcatttcaatgtttattacagcgctattcacaatagtcaagatttgcaagcaatctaagtgtccatcaacagacaagtagataaagaagatgtacatattatatacaatggagtactatgcagccataaaaaagaaatcctgtctctgtaacaacatggatggaactgaaagacattgttaagtgaagtaagccaggcacagaaagaaaaacttcacatgttctcactcatttgtgggaattaaaaattaaaacaattgaactcacggagatagagaatagaatgatggttaccagaggtttggaagaatggaggtggtgggagtgggtggtgggaaatggggaaggctaataggtacaaaatatagttatatacaatgaataagacctagtatttgatagcacaacagggtaactagttagcagtaatctgttgtacattttagaataactgagagagtacaattggaatgtttgtgacacaaagaaatgatgaatgcttaaggtgatagaaaacacatttttctctgttgtgattagtaacatcatatgcctgtaaaaaatatctaatataccccattaatatatacacctactatgtatccataatcattttttaattaaaaagaaatctcacttaaaattatttttctataggaagtcagtttctttctttttttttgttttttgagacggagtctcgctctgtggcccaggctggagtgcagtggcgccatctcggctcactgcaagctccgcctcctgggttcacgccattctcctgcctcagcctcccgagtagctgggactacaggcgcccgccaccacgcctggctaattttttgtatttttagtagagacggggtttcaccgtgttagccaggatggtctcgatctcctgacctcgtgatccacccgcctcggcctcccaaagtgctgggattacaagcgtgagccatcgcgcccggctaggaagtcagttgcttatgatgatagacctaatcaacacttaggtccttattttaccttatagcaagatcattgaattgccaaacaagattaccaggtacgactaccccagtattactttttagagtcaatgtgaaaaaactataattttataatgagtgaaaaccagaattcactcatttaattaatatctatgtaattaaatgaaaacgctgttttattaaaaagtaattatttctaacatttgccctgaaaagtaaatgaccagaattttctttgagaaataggaatcttttgtgaaattgttgaagactcccaaagtctcctcaagtttaaaaaaggcaatgcagaatcttgctgaggttattccaaagcatgtacagatgacatctgtaggtttaaacgctaattaaataatataatttaaaacctcgcacatggtaactaaattattcccagaatactaggtatagaggattgcaaaatattatctacccagtacattttaagacaataaaaaaagttcaaatacagagtacactcctcaaagagatgatctaacatgcaaattgaaaagtttattttgagacacattttatatatatgctgcataggttttaggtaaggtttacaaccattgagcccaattatcttgttccaaagctaatataagtaaataataaataaaccctaaaaggaagagtctaaaaagaatttacatcagttcactcttcattgaaagcaacagaaaatcttccctggggcttacataaggaaaacaataaaactgacttgttttcgcaaacaaagtaaaacacagaattaaaaaaaaaaaaaaagaggttgaacacctaggtcttaggaaagtaaaacaccaggaaactttaggaaacttggaggcagaaactcatgaagaatctctttgggtttcctccttatgatacatgagttccaattactttctatccttgcatgagagtgctttgtattcaaactgctgggaaagtatgtttagtctaaccgccttaatctagatagagaatgcttcatggttgacaggcagaatgtcaccaggtagaacatagcagtgtctgttccccaaagaaaaagctaattgcttttactggaaggagggaaaagaattctagcaggccaaaaacaccagagccctcttagaaaggcaacacaagaatttattcttcattttttcctcaatggaggtgtttgctggacttcagtagtgagcaatatagtaatatacagtatatagtaatatagtttgaggatatatggatataggggagttgctggatgacaatagtctagatgccttgggaacactgcatctgaggttagtgacctcagatgcgaatgcatacaaaaaggaatgacctagaagcataaacccctccccacacttggacggaagaaaagctttgttatgcaaagttacatctgatagcaattttttaaaacaatgaaaatctgttaaatatactcattactagagtttaataataaaatccaccgatcgaaatgcttttttcactttaatatgactgatttactagatgaaagacattctatctctttatgcatacttgtttctacacagaaatgctgactgaatcatttgtaccataaagtacaaaaatgtgagtcactcaaatatcatatcttaatgaaagatactactggttttaataacatttttaaaatggtaatatgtacaaatagaaagctaaaaattgttaatagaacaaacatgtatttggtaattattctccatcaaaaagtgtttttgtaataatatagagtacaaagaaatagttatttgcagttataaactttggattgcatttaaatgtgggcctatttgcctttgacatcttcaccacgtataaaatctgtgggttatttttgtcatactaaactacactaaacctagtttctacgaaagaaaagttttcttgatttgacctttctatatgtggttactataaaatattatgtttaaaattatttattaaacttattgagaacagagtttatgatacatactactttttggttgagtcttttctaagataaaatacatttgtactatgtgtataatatatttttaattaatcagtccatcaatcaataaggaaatattttcccttgagttagcaggtagtgaaaaaatataagttttgtatgtgataccaactcaaaaagtgttcaaataagatcaagatgctgaaacttttcaaatgatgatgataaaaaaatgcataggcttggcctctctccaacaaagcagtatggaatcatatccagaccaaccatagacatcttggtaaaaccgactggatgtcagaagcgtagctggttccaatgtgtaaatgttgcatagcctatgcattaagtagctttttaggaaacttgactcatattaccctggacaacaacctgcagtttaattggagtaaactttttatttttattttatttttaagttcaggggtacatgtgcaggttgtacaggtttgttacataggtaagcatgtgccatggtggtaaacatatgtcatggtggtttgctacacagatctttgacaaacctgtcaaaactaagcaatggagaaaggagtctgtatttaataaatggtgctaatagaactgcaccattttctagccatatgcagaaaattgaaactgggccccttccttataccatattcaaaaataactcaagatggattaaagactaaaatgtgaaactcaaaactataaaaatcctataagaaaatctaggcaataccagtcaagacataggcacaggcaaatgtttcgtgatgaagatgccaaaagcaattgcaacaaaagcaaaaattgacaaatgggatctaattaaagaacttctggaggagccaagatggccgaataggaacagctccggtctacagctcccagcgtgagcgacgcagaagacggtgatttctgcatttccatctgaggtactgggttcatctcactagggagtgccagacagtgggcgcaggccagtgtgtgtgcgcaccgtgcgcgagccgaagcagggcgaggcattgcctcaactgggaagcgcaaggggtcagggagttccctttccgagtcaaagaaaggggtgacggacgcacctggaaaatcgggtcactcccacccgaatattgcgcttttcagaccggattaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcaagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactgaaagccgctcaactacctggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacatggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgaaaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccattgtctcagcccaaaatctccttaagctgataagcaacttcagcaaagtctcaggatacaaaatcagtgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcactgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacagaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggtgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatgtatgaaattggaaaccatcattctcagtaaactatcgcaagaacaaaaaaccaaacaccgcatattctcactcatacgtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaaaaaaaagaacttctgcacagcaaaagaaactatcatcagaatgaacaaataacctacagaatgagagaaaatttttgcagtctatccatctcacaaaagtctaatatccagagtctataaggaacttaaacaaacttacaagaaaaaaaaaatctcattcaaaagtgggcaaataacataaacagacacttctcaaaagaaaacatacatgtggccaacaaacataggaagtaactttttgtttccctaccaaactgagcaaggagagactggattgcctacagccaatatatgaatcaacatgtgacttctgtcaaaaagcacctcttttttaagactaatcaacttttcatgaaaatgaaggccaagattgataggcaatgagaatcagtgtattttttccaagcataggtatagtcttttgacactgattacttttaatggccatccattctcagtggttctttgtgccactcagggtcactcagtgtcctccccatagatatatttacatgaatgaataaaaggtctcagtgagcatggaggaaagcatctaaggattaaagtagtcctggcatgtggtccccaagaaggtatggaggaagtgcctcagaagtaatgcatttttattcatttatttagtagctggtttgtactaggagctgggaattcacaaatgattgttaaactctgtgctcttaagggtcgtcatcctctctgctttactacaataaaagtggtcaggattaaggaatgatgctatgtacaaaagagaagggctattgatttggacatttaataatattttctcagtcttccttatcaatgacacacattccctcccatcccacattatcttcctgagccaccgcattgcctagaccttcacaaaatatgggtggtagggaagggtggatttatgtgatttgccagactttaggagtaagacagctggtatatctaaaacctgtaacaattacttgtattatttctatgccttacccaaaaacttctaattggcatgttagacttgaccaaacagattaacaaaccattccataacgatcgatcagattaatgctaagataattggattgtttcattagaagggtcataggaatagagagagaccaataagatcctatgtttcttgaatatgaggcattacatgaaagaaattacacccagcagcatcttcaaattagtatcagtgttctattgctgaaactaagtcataaaatatgtatatgctaaatacctagtgaaaggtaaaaagagaaatcaggaagccatccactactaaggcagcagaatataaataaatcccacttgaatcacaagtttctgtatcccttttatttcttttataatttatcagatgtacctctctcaccacctgtgtttctctacctctaaacaggtagagaatgttgctttctcttctttacatttattttcttccttttttttttttttttgtccttttttgagacagagcttagctcttgttgcccaggctggagtgcagtggtgcaatctcagctcactgcaacatctgcctctcaggttcaagcgattctcctgcctcaggctcccgagtagctgggattacaggcatcgtctgccaccacacccaactagttttttgtatttttagtaggcccggggtttcaccatattggccaggctggtctcgaactcctgacctcaggtaatccacctgcctcagcctcccaaagtgctgggattacaggctagagccaccatgcctggccggtttttcttcctttttttaaaaaaacaaacaaacgaacaaaaaaaaaactttacaagaaatccactgcttactaacaggagcaatgacacaactgcttctcttatatttgcttctgcacacattcctttcaggtggaatgactgtggctctgtgccatctcgaaatctactggtctctaagcacaaacgaacattctcttaaactaatgaaatgagtggcaggcaggtaagtggaagcaaaattgcttgtggtaaatgtgggtgggcggaaaatattagctgcttgataggtttttaaaaatgctgtaataatatttttcatgtaattaatagcgtgtgcagagcaccagcaaaggctcagagggatgcccacagagttccaccgcaaccgtgcacagaggaggaggagaatgctccctacaggtgaaaactaggctaatacacaatgattgaagactaaaggtaaccttgcactcataactccaaaagacgcatttgccacaagtcaggcaggagttatgtttactctgctgtaagcccccaaaaccacttttgttaatatttatgtagctcacctgtatctctgaagatacattgtttttttttaagtacagaaagagtgagtgggaagttattaatatccattgctgacagtgattgtcaaaattcttaaaaaagtaaaggatcaattgaaaagaaaataatgttagatttatgtagtaaaatattcacaaagctgcatgaagagtctttggttggagaagccttgctctgaatctacttcgtaagcttcctcttaaaaatgactggtttcaacaagctgtttcagtcaaataggccagttaacccccaaattcaaaggaaaaaacaatatctacaatcatgctggtctgtttgatgggattcaccagctataagtgtaagataaaagaataattagtgaccaaatgttgtaataagatatgttataatagagatcatatgtcatataacaaaaaattcatctagggttgtttctaagtcttccctttttaaacttttagaaaacaagcagcattttaaaagatggaatataaaattcatggctaagaagttagaattttacttcactggaaaagaaagtttatttttggtaaatagaaatgagattaacaaacattctagaatgggtatgaggtaatttgtattatttgaagtacataggtagattttaaggacaattcgagaacaaagcttaagacctaatgtgtagaaattatagaagaaataattgtattatgtttattgaaggaaattcacagcttttccataaagaagaaagcaagaaaaaaaaaaagagaagattgatcctgtgatatgaaggcttcagctaggggttgtaaggaatacaacaataaataagacagagcttctgcctacaaagaccttacaacctactggttgaggcagacagatgcagcaaacagttttaatagaaggctgaatgtgatacacattgagcagtcaagagaaaaaatgttatttacaacacgggctgcagtttgagccacaacgatagaagtattccttccaaggagagcattgctcttaccttccagaaaatatttttatgtaactcttctggctgtgtctcttcttcccactctggcaggtctatcaaagagaagagagaccaagagatataaagtatagaaatatgggcttgccgtctagccactctagaatgaataagtttagaggagggcacagagatttaaagaaaaggaggaagaggagggtcaacggagaaacaggaagttactaaaattagaggtgttagtgaaaatagaatgttattgactggaattacgtctctcccaaaaaatccatacattaacatctcaactccctcccctcccaaacctcccccagctcagaatataaataaccatacatggagctaagttctttaatgaagtaattaagttaaatgaggcctttaatgtgggcccctaatccaacatgactgctgtctttataaggatgagaagagccaccagtggggcgcattcacagagaaacggtcacatgatgaggcagcaagaaggcaaaaattgcgagccaacaagagaggcctcagaagaatccaaccctggtgccgccttcattttaaacttccaacaaccccagaactgtggaaaaaaattctattttttgtctgtggtattttgttatggcaaccctagcaaactaatacactgagcaaactaatacattaaacagaatattaaaacgaacaaaacatactgttatttttagtatgtgctatagtctgtatctatttattatcattaagcttttaaaaattctatgcacacaacaattttgtagttatagtgttttggggaataaaagggaaaagatgtttgagggaacataaaacagaagacatcagctgtaaggaaggagtctataaatatgtaattaagaattcaacaagaacaagaatttagtaaagctaagagaagaatgggaggattctagaaagatgatggagaaggaagcaccagaaatctgtccctttaccagataacagttgtactggcagaatctgtctgcttaattattttggaactctagagtgtactgaaggcttagaaatttccgggaaaggcttgaagagtaaatggtgactaattttgtccaatctcatcaattagcagagtagtagctaccattcacccaacccccagtgtcttggcaggcagttgtacacatattacctaagcagcatgcacacattttgtggggagttgaggggagggtaaaaatgaccctgccatccaaaatatcaggggtctatgcactgatcactgactgctgcttgcagtcacagaagtgcagacaaagaggtgccatccgtggttgttgcatgtcccctcacgggtgcaagctgaaatagagaacagaaatataacagggaaaatcaacaaaaccagaagttggttcttcaataagatcaacaacattgacaaactttagctatagatggactaagaaaaaacagagaaaactaaaattaccgaaatctgaaatagaagtgaggacatcgctactgattcaacataaataaaaaagattataagagagtactgagaaaattgtataccagcaaattggatatttctagaaccacaaaacctaccaaaactatgccataaataaatagaaaatctgaatatatctacaagcagtaaagagattggatcataaatcaaaaatctcttgaaaacaacagcccagtaactgatggcttcactggtgaatgctaccaaacatttaaagaacactaatccttctcaaacttttccaaatatttgaagaggagggaacattccccttacttattcatgaagctagcattaccctgatatcaaagcagaaaaagacactgcaagaaaaaaactacagaccgatatcccttatgaacattgatgcaaatatccttaacaaaatactgtaaaactaaattcagcagcatatgaaaggattatacacaattaccaaatagaatttattcctggaataaaggatggtttgaaacaaaaattgatcaatgtaatatacacattaacaaaataaagaggaaaaaaaacacattatcatcccaatttttgcatttgtcagaattcaacatccttttacaacaaaaacaatcaacatactagtaacagaagaaaactaccccaacgtaagaaaagccatatatgaaaaacccatggtgaacatcataatcaatggtgaaagactgaaaacttttcctctcagatcaagaacaaggcaagggtgtgtgctttcatcacttctattcaacataatactaagctcatccacagcaattaggcaagagaaagaaattaagaggagtatccaaattgaaatggaaaaagtacatttatctctctttggagatatatgatcttctctatagactactacaaagatcacacacacacacctgttagaactaataaataatttcagcaaagtagtacacaaaatcaacgcacaaaatcagttacatttctatacactaaaaatgaacaatctgaaaagaaatgtttggaaataattcaatttatgaaagcatcaaaaacaacaaaatacttaggaataaacttaataataagaaagatgtacaataaaaactataaaacattgctgaaagaaattaaagaagttataagtaaatggaaagacatctcatgtttacagattgaaagacaacactattaagatatcaatactacccaaagtgaactactagctcgatacaatcccaatcaaaatcccaatgacattttttgcaggacttcaaaacttactacatagctatagtaatcaaaacagtgcagtaatagcataaagacatatataggccaatggaataaaatacagagccccaaaataaagctttgcctgtatgattaaataattttcgacaagggtaccaagactattcaatgggggaaaggacagtattaacaaatggtgctgggaaaactggatgttgaaattcaaatgagcgaagttggacccttacctaacaccatatacaaaaattaactgaaagtgaataagggacctaaatgtgagatgtgaaactgtaaaactcttagagaaagacagggcaaatcacaacatttgatggcaatgatttcttggatatgacaccaaaggcacagacaacaaaataatagacaaaaaaggcaagttgaactttataaaagtttttacaaatggctctgaaagacactatcaacagagtaaaaaggcaatacacagaatgttagaaaatatttgcaaatactatcataaaaagaatattcagaatattaattgaatattgcccttattaaaaaaaaatgggcaaaagacttgaatagacatttatctaaagaagacacagaaattactaataagcacaggaaaagatgctcaacatcactaatcattagggaaaagcaaatcaaaactacagtagatgccatctcacactccttatatagctgctattaaaaaaaaaaaaacagaatataacatgtgttggtgaagaagcaaataaattaaaacaattttgcaccggtggtaggaatgtaaaatggtacagatgttgtggaataccaacacctgtaccattttacattcttaccaccagtttggtaattcctcaaaaaattgaaaatacacttaccatatcatccagcaatttcacttctaagtatattcaaaaaaattgaaagcataatctaaaaatatatttgtatacccacgttaatagcattattcacaacagctaaaacatggaagcaacctaactgcccagtgacagataaatagataagcaaaacgtgttttttatatatatgtatatatatatatatgcacacacacacatacacaatgaaatatgattcaaacttaaaaacaatatttctgacatatggtacaacatggatgaaacttgaaggcattatgctaagtgaaataagccattattccacttatatgaggtatatagagtactcatactcataaggacggaaagtaggatggtggcttctaggaactggaaagaagaaggaatggggagttattttcgaatgggtatagggcttagttttagaagatgaaagaattatggagatgatagtagtgatggttgcacagcaatataaatgcactaaatgccagcaaactgtacatttaaatatgcctaagacagtaaattttgttatatgcatattatcataattttttaaaaattggaaaaaagttatgagaagtacctaatttccccaactctgcccagacctaccaaaatgatgcccttgatatgttttggaaattttgaagaagactctgaatgtctttgaatatatggaattggaactgaataattttatttgtatatttaagaaaaaagggattccagtagtgtgagcaaatggaaggatctggattcccacacaccccaaagcaatagtctataatcaatattgaggttcatggagctgttgactttagagttagtttctcacatatcaaggcaatggagaacatactagctgagtcagccaacatgatcaaagacagtatctgcaaacctcttaagaatcccagagtccattacataaagcaagtgagaacattcacattttattataatgacctcttcagggtcctccatgtaatgtacagttcaatgttccatcactaatatcttatataaaagaaaacgccatctatatggtgctcaaattatgtggtgaaaaaggtcagcagtcaagagattgaactgtggaattcattaacaatcactttttagaaaacatgattaataccttgcaagacactgaaaatttctttattctgctgaggatagcagtgattccataggcattttcaataaaatcacattcagttgtaatacaagaagaaggtgttcttatattgcattcaagagacttactttttgcatggagacatttgattttcatgaaacactttgagaaaattggtaggcatttcccattccataagaacgatgccatttgaaacttagtacctctctcctatgagttttaataagcttaataagtattatgacaacattaactgcattttactaataatgaattgagatactaaaagattgtggctgactccatgacaccaagaatgtcaatcatatagagatgaaatccaaaacctggttaatctgcactttacctactggatttctggttgtgttttattatctctgaattgtacagaatttcaattacgaaacaaaaaatacaatagtgaataatcagtaaatcttgtcagcactcacttcttatttttcaaagccactataactgtcactatttcatttattgatgtatttttggtgccatccaatctctacaatcatcctacacatttctctacaggctatgcaactgaccctagactcaagaactgaaagatcacaaactgagctctcctaggaccccagaacatgaattgctaccaacagagattctgagaatgaggaaatggtgataaatatattccctaggtaaataaacaatggttcagtcaagacttaagatgtctttcttccaggctgcatagctcctttaatctttctcctgccttgggcccaggcacaaaaaagagttgattccctttaataaataagtcatctacttcacagagttcatatcatgaggaacgaatcagaaaacatatgtgaaaattgctttgaagtcatgttatgattttcaaatgcatgctattttgtgttctttgtctatcatcactattataatcattattatatgctgactaagagaagaaaaggtggctatttcaaccactgttggaagaaaaggactgtaaacagggtttcacgctgaacatttttggctgctgtttgttgctgggaaagtattggaaaaagaaaacaaactgttaatattaaaaaacaggcaaactattttttaaattttttaagtatatgcatccatgaaatttagaaaatgtattactagtcatattcgattagagaaaaaggaatttaggaagttttttaaattagtaaaaaataaaaataataaaaaatgaaacccatagcctatcacctaatgctaaacaccactaacatttaatattttttcccacaggattttttttatatgcttgagtttggttttatgctacaaatgtcatagtatacataaaatattgcatccttcctttttactcattttttaacaaaagtatttttgttgtttatagtaactacagtgctcaatgatagattttatttgtaatatctataagatattgtattaacatttacagttgaggatcataaaaatcatcctgaaattaaatgttgaaaagaaactgaacataattgataaaacttactttgaataattctggatttttattttcatcattcgactctctttagtgtttttaagattaaaatccatacatactttccatgcattgaagtttcattttgtataaaaacacttcaaaatgtagacttttatgtaaactgtacatcatttatgacaattttctttgtaggattataactgttgtgcataattttactctgtatataattaacttctaataatttttatttgacttcatcaatgcactgcttgctaatattcagaggcctgctctgtagtacagcagcatgaacttttcagaacttcaagataattattcagaataatgtctgccaacaaatgtttggaacacaatctgtaagttggagaggtgctgcagttagatattttgagtcttatcaattccttataaggaatgctctttgaattctgataaatgcaataaggtgaaacagctactgggtccattaattttaaacaaggatgatgagataatcttgcatctatttatctatttctcaaatacaaaaactttgtgtctcttattttggataaaaaatgtgatggaaaagggattccttcttattacaataacaaaatattttactttcacaggccataccaatgcttgacttctttcaaaagcagacaaaaaccaacaacaaaacctcttatatcaggagattgcagtgggattcaggtttatccttgaaaccccacaaacacttcaagaaagccacagtttaattcttgctattgatggttctttgggttcatccaaaggaataatatttttgtactattaatctgtctgtaagcatttttttcttagtgcagtttttacatttaactaacaagagtagtattttttatttatgtaactggatctctccagattaggtattttttactgatgccagaagagaacttaaaagaagctgaagaaagaaaacacatttcaaagacaccccagtggggatcaattagcacctataaatgtttatataattcatcacttactgccaaactaatctttttaaaacagttttttgtcaaatcagaatcttgttcaataacttctccacagatattaaataaatcccaactcgtaactctgtattttaagacagccatcaacaaaatttgtcttatctatttgtactactactaagacaatttcaattagtttttattgaaataaaaataccctctcttttatttccctctttattccctcttttcttcagtctaccagttcaaataccattttatttaccacatacacctcactatttttttattctaatttttattttaagttctggggtacatgtgcaggatgtgcaggtttgttacaaaggtaaatgcgtgccatggtggtttgctgcacctatcaacccattacctaggtatcaagcccagcatgcatttgctctttttcctaatgctctcccttccccaaccccacccttcaacaggcccaagtgtatgttgttcccctccctgtgtccatgtgttctcattgttcagctcccacttataagtgagaacatgtggtgtttggttttctgttcttgcgttagtttgctgaggttaattggcttccagctccatacatgaccctgcaaaggacataatctcattcctttttatggcagcttagtattccataatgtatatgtaccacattttctttatccattccatcattgatgggcatttgggttgattccatgtctttgctattttgaatagtgctgcaataaacatacacatgcatgtgtctctgtaatagaacgatttatgttcctttggatagatacctagtaattggattgctgggttaaatggtatttgttgttctagatctttgcaaactcagtatttattggtcaatggcatacaatttcttctaagtcatggccgattcactgattttgttttcatgctcttcatgacttctaataatattgaaatcccatggagccctttatatatgtatatgtgtgtcaataatacacaaacacacacacaatactgggaattagataagaaaaacatcattgtttcttttaaccaattagaagacagaaatacatacagttggcctgaaaataaccagttaattgggagccagaattagagccaggatctcagtttagcatactcctctgataatactttgccccaggcatcagcatggctcttccacctcagtttctagaaagcagagccatagtctggcctcagtgcttcagggagcacctaaactttagagtgacttcctcaaattttctgtctccttctagggcttaaaccttgacagaactgtttctctccttcacatttttctccaaacctctactttgtgtggttttgaccacatgttcacaagagcaccaaggctcatgacaatggaaacaacctagggtcctgtggccatgctcagttccaggtgaatggtcaagctaatggattgttcctggaagctgttgtggtatttttttcaagggatcatctcagtctggtttaccagactcttgctggcacactaattttaggtgattttgcaacccatatggacaaagcctcctgcaaaaaataatttcccagagcctactcgcctgaggggcagtctttcttttgtaggtatgaagagcaatgagtaaaaacatctctctctcaaagagtttaggttccagtgtagagaatcatttaatattatacatttgtagtacattttagaagtcataaagagctacactgtatagcagtttatttgatctttacaagaaattaattatttcaacaagtattattgatggtcttctatgtcttggcactgaaaatgctgagcatttatagatttatgaaatagatactattcctgatgacataagacatacagtggtgaagatacaaagttaaactaattacataaatagttattgcttacaattttgaaaactgaagtaaggttgacataagaaacctcttactccaccttcctcccaattagtggacaacctcacctagtctataaggtagatatgtctataagatacataagatcaatttcattttacagctgatttaattgaacttcacaaagttaaattgaccttggtcaaggtcacacagtgagtaaagggcagaagtaatgcatgtcccaggatttatgcttgatctgttctttttcctattggtaattgctcagaacacacacacacacacacacacacacacacacacacacacacacacgagtcctaccatgacaaattgattcttgagaacagcatttgtgagtctacgggcattctgaatgctgttgtctttcaaggtaaatgttaaagaaataacagtcactattagtgaataatttaattgtattattgactatacattgtattgctatggtaattgtaaattaaaaagatgattatttttaattaacctaacaaagatatagtcgcatatgttttcagtgtcatgctgagaattaaaacagaccactgggataaaaagtgatggggtagccagagcagtttctctgagtaggtgagaaggacaagaagaatcacgactcttagagatccagacatggacatttcaacaagagtacagttagtttgagacatggagagtagagtatatattattggacataaggaaagagccagatcatgtgtggtttttgataggctggggcagaaatgtcaattttaacagcaatgggaagactttgaagagttctaagcagggaagtgacatgatctgacctatatttctggaagattgctcagatcaaaatctgtcgggatcaagtgggcagttggaatagaaataacagctgggccaactgtaaatagtatttaagaatcctttataggaagtcagagggtacagaagaaaaaaatatatatatttataggaccagaggtgaaaaccataagaatcagcataatcaaaaagatctgtggtaagcaagagagtggaaattagaagaaatatttgaacaagcaagagaaatagtcagacatggatgacctgataaaagacgcttacttacaggcaaatgtaggattgaaagatggaaacttagtcattgtcataaacccttcatttcactcagatcgcttctgtgtttggaatctctgatttggcaaactatctataatcatgggctttcctatgtttaaaattctataccctcagactctttctagaacactaccatatactgtgtaataacatgattttgctgagaacaaggactttagatgcaggcagaccatggtttaaaattccatgctacccattcaggccatatgaatgagctactgacaacctcactgattcatggttttcccattggtaaaaaaggattatcaatagcatgtacctcttgggttgctataggcggcaaaaattataatccatagaaagggctgaacatagtatttggagcgtatagagatactgtgagctgtttttaatattactattagttatatgtcaaaatagaattatagaaatctacttttaatgtttctcacattagctggcatataattgatttattgctcattaaaaggtagtatctatttaagatcagtgatatataattatgtcctatatttcctttatctgtgtgcctttctttatctttatttttgttgttaatttgataaatagaagttccataatctctacccattgttgcctgcccacttcacactccctaccccactcccctgccactggtactttcctgaggcaaccaatttaacagcctcagtatatgtttttcctcattatttctccattttgtacaaactacacaaatatactgtggagtttgtacttacaaagtggggctcacactatataaagagctctataacttaatgcattctggacattcttccatatgaatagattacaatctgattcttatcaatgactgcaaaatatttcataatatgaatatattacagtatcttcaagcattcttctattgatgggtatttctattgggtatagctttggtttttttgtttgtttgccttggtttggtttacactgttacaagtattgctatactaaacacagcatgaacttatatacttatgactgatagaattaattcatcaaaattagaagctaaatcaaaggctgctgcttcctatgttatattccttacaggtatataatatatgcacattaaaatgaattctgacaaaatgtatttaggttttcagtcttcattgtcactcatatggaaagaggtatttattttaaaagagatatttaccccctctttttgtttgttactccattttggttttatcagatccaaatgagagaaaaatttaatctagatctaataaattgatgcttgttttatagaaaatatttccctttgtctcttctgactaaaaattctttattgcaaatatacaagttcaatggatcattagactgtccaatgaaaaagttattaactacttgaaatctggaactatgtatttgtgcatatacacgtatgtatttgtgtgtattataatgtacatgaaagatcatgtggactggttatttcttgacaaactttcctcattgagggttgtatatggaatgatgggaatacaaattatttgccaaaaatgagtaaaacaccagtattataaagagcattctctattacgtcccacagtaaaatatttttttccaggggagttatcagtaatgctatcttaaaatgacaagagaaaaatgattcactcaacaaaccttcaattttagaattacttttcagaaacctatcagttttataagctggatacaacctagacaacaacatatatcttgagccctgatgaacttttgatagaatttagaaatctgctacttagggttatgttgcttattagagagtgcattccttccacaaaatgaatcttactttcataaagttgactaccgcagagaccaccttttagatgtggactttacttatctggatatgttaacatcccctcttaggagcatcggcatgtgaacatcagtgttccagttggcctaagtgtcttaggatcatacaatatggacttgattctaagggagaggttggaaaactatgttttggaggccaaatttgaccatggcttgtttttgtacagcgtttgagacaaaaaaatagtttttatatttgaaaagggttgcaaaacataaaaagaacatatagctaagagaggatgtggagaaacaggaatacttttacacttttggttcaatagttcaaccattgtggaagtcagtgtggcaaattcctcaaggatctagaactagaaataccatttgacccagccatcccattactgggtatatacccaaaggattataaatcatgctgctataaagacacatgcacacgtatgtttttgtggaactattcacaatagcaaatacttggagccaacccaaatgtccatcaatggtagactggattaagaaaatgtggcacatatacaccatggaatactatgcagccataaaaaaggatgagttcatgtcctttgtaaggacatggatgaagctggaaaccatcattctcagcaaactatcgcaaggacaaaaaaccaaacacctcatattctcactcataggtgggaattgaacaatgagaacacttggacacaggaaggggaacatcacacaccggggcctgtcatggggtcgggggaggggggagggatagcattaggagatatacctaatgtaaatgacaagttaatgggtgcagcacaccaacatggcacatgcatacatatgtaacaaacctgcacttgtgcacatgtaccctagaacttaaagtataataaaaaaataaaataaaatatttactatctggtctttaataggagaagtttgctgacctctgatctaaggtcatgtttacatatttttaaaaaatcttttaaagtccccgagtttgttacatgttacagcttttgtctattatgggagtaaaagttgcctcctttccttatttgacttcaaggtgaaaaagggcaaagtgccttacgatgttgggttgcatttactgaaaatatcttctgtaaacacacacagaagaacagccttaagataaagaatgctttcaaaaaggaaatgtgtaaggcaaaattgttctgtccataaatgttaatttccctttgcctactttagctattatctgcccagctatccagctatctcactaggatgttgtaaactgagataaaaagggatctgagcccttcactacgtgctatattgatccaaagcattgctatggtaatttattattgaagagattataaatgagaaactcttctgcaagaaaaactactctaggagaaagtttggaggcaacagtgttaccttgctatgtataatactttgaagtattttttcgtatctgaaacctctattttctactccctcttctaaatctctatagcaggtgagctccattttctgtgtcatggactaacagtagccaccttgcttgctatatgccccatagctcaaaagtaaatttccatggtgatgaataaacttgaaggaaaaaaaaatggtactatggacaaaaacattgagtggacataaaagggaaatgtagaattctattattttaaagcaataagtacattatgccttatctagttctttgttactataaggataaaatgccttgctctgacagtagtggaccaggaccaggtcctagggctcttaagtgcctgtccagtatcctcgtcattactttttgcaataaaaataaatggaaataggatgaaaagacaaaacatggagcttgaaaaacaagaaaacgaacgaaaaatgaagtatgtaagtacatgtttaaaagtttatagaaaatgacacacaggatctccatgtgaggagaaatagaaaagtagatataaagtatgtgacacactggcaatgtatgttcttattcaccaatgccaggattatccctagtgaacttgggccaaattaccatgacaataattagctctagcactttgacagatcattatgagaacattagcagggcattagtgagcattacccatttttcacacattgattagatgccatagttggctcattagtgtattggtgtctaacagctgcaatctaactagtactttcctccttcagctgagatctaaacctactaacctcagaccaagccatgtaaagggactttgttaaacaagtacatgctcatttcacttgtttaagaaaaaaactcattaatcaagccagagaattatttggcctatctctgcttggcaatgaacagtaatctaccatctttctctgattaaaatgacatgttaagcaatttagaaaaaaataccacaccagtatcctccacaatttatctgattacttcctagcctgctgctacctcacgtctcaatttgggatgaggttacctctttattctgaagaatattctcatattttgaccatctcattcatcaattgctttggcttctgaaatcagtagcttagttgttctcaacagtctgtacattaggatcacctaaaaatatttcatagacaccctatgatgcatggcctacatctcagcccaattgaatcagaatttttggaagtgggacctgggtatccatattgatttattttcttatgctcacagagtgagtctgcagcacactgggggttgagaattactgtattctgaaacatataattagacccattagcctaggatacagagtgaggtgggatatatacagtgataaagttaacaaatcagctggattactcccaatattgatgacagatggtgcattgttctcagtacatgcaaacgttctaaaaattagaagcagagaaaaggtagctttgaggaggtgtttcgtgatttttttccttttcttgcatatcaccacctgtccacccacacagaaaacacatttaattttgagtcacatattttaataggtacaattttctcacactattttataagtaattatgtttttctaattcaaagcagtccagcatggataaccagggcaaagctctatgctccctttcttacctttcactttcaaaagctgtatgtcaaaacaacaccgactagaatacgtgaaatgaattattgaggtgctgggcactaagcagtcactgagtctagctggattataggacaagcaggggtgcatgtaagttactgagcttcactcagtcacagggtcagaatctagctccttttatttccataggaaactcaagaaggaatgaaaaaaaaaaacacaaaaccaaagagaaagaaggcgaaaaggaaacgctatgtttatatgactctttccctaagagtctaaaaagagattgaaattagggagaattgaaatcagccacatcaccttggccaagatatttcccatattctggattcagtttctatatacatcactcgagaaagttggttaaaatcctttaattctcagcaagctttaaagtgttatgattctatgagacaacttcttagaacacaaatagtaaggtgtacataagctgacttcagccatgtaaggatgccatgcaaggatttattttttattattcccactatttgagagcactcttaaagatgcaaggaaaacagtaaattgtaacttcacaagggccaagttgaatctcaaatccaaagaggctgctgtgtagggaatttgaagcctatccagtctctacttcagtgtgatgtccctattctctatgcatctttgcaaatttaaggattcacaaaagtctcagtctattattattaagagactcatgattattaagagactcttgtaagtcaccctgtattttattggaatgtctttccttaataggtctgcttatttttaaatatctatctgtctagttaccatttgggaaattgaacacaacaggcaatttaaaagataatgaatgctttgagtactgtttggggtagtgttttatataagccaaagaagattagcctttgtggtgttagtaggtatgtgtatattaaaatttttgagttgtgtataaaagaaataaagcaaggaatagttattattattgacattactactactactactactactactattacaaataaccaccatttacagagtaaccatgggccagaaactgtgctaattacttatgtattatcttatttaatcctcaaaaaactttgggaaattcttactattataacttcattatatagatgatgaaactaattttgagagatcacatgaatagtaaagcagtagaggcaggtttgcaacccagatctgcttaaaaaccctaaagctcctagtacatagtaactgccaataacacaatggttaagatcacgggattggagtcaaaggggtatctgagaacctcttctctctccaatagatcctatattcaggtacagagctaatttttctgaatccagttctgaccagaattttctgattaaaagaaaatgctcatgcctttatatctcctacctccaaaattcaaccatctcaggcagacattcaaggtaccccaccatctggtcatagtctacattgccagtcttactgctcactaatcctctacagcatcctaacacagtcatatagtacatattcttctctctctttctctaagagagatggggttttgctctgttgcccagattggagaacagaggtgctatcctagctcaccgaagcctcagcctcctaggctcaagcagtcctcatacctcagtctcccaagtaggtaggaatgcagacgcacatcaccacacttggataactttcatattttttatagagatggtatcttgctatgctgcctaggctggtctcaaagtcctgggcttaagtgaccctcctgccttggcttcccacaatgctggggttacaggtgtgagccactgaacctggccagtacattcttttcatttaggtaagatgccattttccatctggagcctgcagggaagccttaatggaagaagcaacatttaaactggatcttgaaggatgactagaattttgatagatggaggctgaaacaatgaaggaggagaagtaaacatctgagaagatatgtctggtcaaataaactcatgggctaagatacagaagaacagaatatattaggacacaacgtttatcttatatagagagtcaaggacaacagtggcaattacatttagaaataaaatttgggatcacatgagggagaacatggatatcagcctaagaagtattgactttatactgtaagcatatgtaactaaaaaaggtttctaataatgtagcattgacaggagtagcatttagataggaaaattaatcagggtctggcactcaggataaatggagaggtaaaaatctagaaccagagtgactgtttaagaaactcaggagaggctccaggaataaaggtatatggacagaaaatgcccaagcctgactatttataatgtccagcattataaataaggaatcactacaattagaacaatttagatattcaatgtcagatacagaagagtcagagaacatctaatatatacagaggtgttcagtaaatgttagttgacagggtaaatgagtttaagcattccagaaccatagtccaaatatcacatgtaccctaaaaatatgtgcaactatgtatcaataaaaaactaacaaacaaaaactaacaaaaaaacttagtccaaaggttccgtacacaaaagactgaattgaagcatgaaagcagtgttttagggttctctttcccccatggaaaagatggtaagttggggtaaagatgtgagtatctaaatgagaaggcaaacaacatcgggatttcctagtgaaaataaaaaaataatatagaaactgaaattgagtcactgccacatcatacatgcatatagttgtagatacagaaatagctatagatttgatgtaattgaaaatatctacttttgccgggcgcagtatctcacgcctgtaatcccagcactttgggaggctgaggcgggtggatcacaaggtcaggagatggagaccatcctggctaacacggtgaaaccccgtctctactaaaaatacaaaaaagaaaaaaaaaatgagttgggtgtggtggtgggtgcctgtagtcccagctactcgggaggctgaggcaggagaatggtgtgaacctgggaggcggagcttgtgtaaaaataaaagaccataagaatatacccacatttgaattggtggtgggggcaagtagagagagaggggcattttggccaagaaaggaacagacatgctgaagatggtgtagtagtggagcaaatatcacagaagcatgaagaaaaaaaatgaggctacttgactgagaaattaggaagtcattagcaatatgcatacattgaccctatttttcagatttcagaaaaccttttggttgattcacccaaaggaaaaggtggagggagtgatgttgagtgttttttgtttgtttgtttgttttagcttttgattctcaattgttcttgccattttacagctctgctcaatttacacccagagctgcctctatcactcaaaggcacattactctggaattgactggatctaactaaaggacctttctaatttcagaaatctttctttaaatgaacataagggctctaaaacgcacgaaaatattttactaaatgccaacagaaagctctgaggaagaagaggcagatagaatacacgctgcatctctttacttcttttccaaagtgtttgcccaacaatttggggaagatttgattttcagcttcactgtcttctctctttctctgctccttattcccaataaacaaagtaaagagcctgaaatatccaaaatgttcatttgaagataatgccaaagtaatctggcaaaatataactatagctcttttcaccaatcctataatgtacattgggatcacagttctgaaagttctgggcacaagcacatttgaaggtaaatcaaggctgacggcaggcatcttaaacaaacaaacaaacaaaaagcaacaaaaacaacaaaaacgacaagaacaaagaaaaagatgagcccaatagaaaataaattggcattaagaaataggaggccaggccagagaaagaggaggtgcaattgcaaatctccaggagagcattgctatgcaaaagcaaaaggaaccagtcaagaaacccaagttctaattgcagatgttacctttgtgtcttggagggatgggaaaaaggtttttagcagtcagacaggatgctgagacttctctcctgaccttgggccaagacaatctgctttttaactggaggcaactgtaatccattctgtgaacagatggcatagaggaaaaaatgcaaacacaggctctctagtgtctcttccaaaagctagcctacctccagctgtggtagaataggcaaaagatgatttttttttaaaaggtgctagtctgtatgggagagtcgtgttaagaacagaaaagatgctgtctaacagactgataggcagagaggacctgccttggccacagtgatgctggataaatttgtattgcaatcatttttatatcagttatatctcttaactcttttggatcatccatgatttccccctccaaaacaggcctgtattccttgtccctctaataataacaaaacattctgggtatttctcatttggactacttgaaagccagaaacttcattgctaaatttggtcagatgatttactaatgcacggcagggtcacaggaaacgatgtagcaagagaaaacccttccctggatataaatcaaaaggaaaatacacatgcaagaatgaatgcccatgaaatgtccagtggtggatagtatcagctttgaacatgatgttcatttatcttctgtgttggaatcctctactgacttctgaacctagaacatattgacatcaatataactatcactaattctgtgaaattttattttatttaaaataataaaaaagtaatattagacttaatacaaactctaattactaagagaagaatgtgaagattttagcccaaggaatgagcactcccataattaactcttactgctgcataatgtatagttaaacaaagggtgacagttttagctggaacattaaatgtccaccagttgtgaatgctacagatagaaatttctgtaatgggtggcaacttggacttgattacctcagaaggaccttccaggtaaaaaagtcaatgtatcttctatacttaaattatatatgtatgtatgtatacacacacacacacacacacacacacacacacatttagttacattcagcaacattcgtggatagcaacctggtgccaaacatgctttgaaggatctaggattttcaaagataaataaagacaccataaccaagacactgtaagcagtgggatatgtttcactttggagactaaaggtgccatagtttcatgatgaaatgaaagccaattcttcccagttcagttagagaagacttcacatagaaggtaaagcttgagcgggatctgcaagaatgggggttagtttaccaggcaatcaaaagacagaggttagttaagggcattccaaagaatagtcaggtatgagagcaaggaaatgtataacagcatggtgcagttgagataatggaagcagttctgcagagttggaaaggaatgcaagtaggcaatggaagaaaaggcaaggaccattagctgggcatggtggcatgcaactgtagtcccagctactcaggaggctgaggcatgaaaattgcttgaacctggggatggaggttgtagtgagcccacatgacattgacattgcaccactgtactccagcctgggcaacagagtgagactccgcctcaaaaaaaaaaaaaaaaaaaaaaaaggcaaggaacgtgcttacagtaacaataatatccatatattctgcagacagttgggagcctatgaagtgtcattccttctcaggagatttttgtcagtggtctgctcatatcctttccaatctcctaccattttcatgtacactgccttccagcggggttcactcagaacagctgacacctgaaagtctttgtcagtgggctctccttgggctgctggtttgttctaacaatatagagctcctcaagtgaacaggatttaaatttcccttagaacatctctgtggagttgagccaaagttgtccacagcaggattttgcatcatattgcactcccatttggggttcttcccattggttatcaatttttctacttctgtactgatttttccagggaatgattccggggaaatcactttgatagtactgatgtcagcagcggaccgtctggagcggctgctgccatcgcgctggcagtagcggcaggagcagctgcgggagcagcagtggcggtggtgggacccctgtgccccgccccccccgtgccccatgtccccgaggccgctgactgcgctgtcccacccttgtgcagccaggcaggacccactcgcaggccaggaacctctgctgctccagaccctggccctgcatcgccactctcgcctgctgctgctgcggggagggcatgggaaggaggcggacagtctttggagcctgcccctgggagacttctggagcccaccaccctgggggccaccacagtggggttgggtggagggtcgctcactagcgggggagcagtatgactgggcaggaagcagggcgcgggggtggcaaggaggggcccagaggcagagctgaaccagggcagtgccacgtttgtactgatttttccagggaatgattccggggaaatcactttgatagtactgatggcagcagcagaccgtctggagcggctggagcatgggggctgagcccggggtgagaaatgggagcagtgactggtgcccacttcagggatccagccagcagtgtggccactgcactcacccccaactgatggtgtcggtttcttgcgccttgggaagaggcttctctgcctgggaagaggttctctgccaggctgcccagggccacatcctgaggcccaccctccatcagggtgactgccaaccctgacactccaaatggccaggcccagggcttcaatccactcccaaaggcaccccatgggcagggccatgagcctggtgatggggagccttgggccacagcatccagaccatggaaagaaattgcggagatatcacacctgccctgaaagcctgcccaggcccagcaagaacctgaagctcccacaccaggctacaaagaggcatggccggggtacacattccactgagccagtgggagctggggacaagcgggagccctgcccattttgagttggtggagtgggaactctccaggtgcagctacagccacccttccacagctgcagactcaggcatctctgcactctagggggcctgggaaggtcctcctacctcccacaggctggagggtgtctgctcccactgcctggcttctccccactgttcacacttgctccaatctcagagtaaagtcaggggccaagcccaggtgctgctgtcacagcccagctgggggtgcacacactcacggcaacgctgacatgccagctccctgccacctcagcctcctctggacttagggcactgacaagcacaggagagaggctgaggcggtgctgaggacagcctggtgctggcctgaaggtgccccttggcatgaaaagcctgggcatcagcaagcaagctcctgggtggaaccaggtgggtccctggtgaagctccaccttctggttggggagggtctgaaatcagggggctgggctgccagtcccatggaccagaggggaaacttgtggtgcttttccctgggcctgcccatggtcacccatggaccaatcagcatacacttcctctgaggctcataaaaacccaggactcagccagacttgagcagaggatagagagacaatggggagatgacgggatgacaagctacagagaggagctgcccatcccagggtctcctctctgttgagaactaaggaaatgatgggacaagttgctgcaaagaggaaccaccctctctgctgagagctggacacttgatgggacaccttggctatggagacaagctgcccactgggggtctcctctgagctgttctattgctcaataaatcttctcttcatcttgctcaccctccacttgtctgcatatatcatgcttccaagtcgcaggacaagaacttgggacctgctgaatgtcgaggctaaaagagctgtaacacacacaaacagagctaaaacatgccctttgcccatgacactgtgggcaaagagaaggagagaagagctgcagcccttcagagagcccagacctaggaactccccaagccagggctgtgactccctctttgggcccctgtggttcctggtatctccaagtttctaggcatcagtgcattccctggtgccagctgggtaaacggcttgcagtgcatctggtctagctgcagcctcacagagaaccagtgcccgttatggcacctggagctgccctccctgaagcaatagccagtgcatctgacagtgcacagtgcctggaccccacgcttgctcacatacccctcactgccccatgtctgacttacagtctcccttggaggtgtgggacccaggctggtagtgtgagtcaagtgcagcccaccaggctgagtgggtggaatgagcccagcaggcccgaacaaaaactcaggcaaagacaccactaaccacagagttttctagccagaaaagcagcaccccaaagatcccataacaatgcaattcctcattttaggatctactttttagggatgtccaatctatgatatccttttaacttatagatgtgagctattaaagtaagtctgtagagataaggttttattgataaactaaatataatgttgtgatgaactgggaaatgtgtttctaactagcttctggtatatttcaaggttggtggcattaagaatagatgagattatatatttacactatgtttgcatggaacgacaaggaagcgaggattttgctgcatcacttacattgaagtactgttttatgaatgagtctttagttgggactgattttattatggctggaagaccagcgaatctgctcttctaactccagtattagtgttttgtccatatatctaaggcacctgtttttgtttcctttctatatctctctttttattgtggaaagcttgtgttaaccccacatgtatcgggttagaggacaattaagtaatgaggtactttgttccacaggctaacattcagattctgtgtccatcatcagcatctccatagtcccaacccaaactcaaccttatggatatttcactgcataagaagactcaaatttcttatagatgaaaggcaactaaatgaatggtttttgatatagatatgtaacattatctgtgattataataacattgagataatattcatataagccattaatagaccttaatcctgccctattgctccctctgttatccctgaccgaggccaatgaagaattctgtcaacacaccttgagccagaggaaagcttttttgacattctctcctgaaaaatgataccttcctcccacctccacacacacaagtcctttcgtgtaacagatgccaacctgctataattttgactcattagagcatgactcagaccagccccctcattatgctcactttccaattactgggactggacaattttacgcagaaagaaaaaccacacactgagatccttgatgcttgatatcaagtgactttttattctggctgtgactcttttctcctcccaactccttgccccattcctgcttcctcaatttattgaactaatacgtgtttttcttccacatctattggtagaagacacaatctctcagcaagtgttaatatgtaaaatctttccccctcacctttcatctttccttgattattagcttttataagtgctgtggctgtcgatacatagttgcatttatgtagactgacgatgatttagcaaagagatttcaaatccacttatttttaaatattatcaagagctgtgcaccagcttcctacaaggcaggccatctctgtgttttgctctcatttctacagttgttttcccctttgcaaccactgttcctctctatttttcatttcttctatcattctatttgggttttttcccttttactctcactacctaccttgcttcacatgtagtgacctgtacattcatttcttttactggaaatgaaataagaacttcaaaggagcatgaataatctctcctgttttaataattaaagatgaatccaccataaagctttctctgccattcccagtgttcacattagatcggaaatggcatttgtagccccacaagaaatagagtagttcccaccctgagatgcacggcacacagctcagctcttccctggatgagcatgttaccaatgagtttgtttcaaagtaagtatagcttgaatatgggaagacaggatttgatagtgtttgataattcacaatttaagggctaaggaaagacggcttattattaaatgcaaataaaacgaaatgaagtccggctgtctgggtgcagatagaaattacacaaagctcataagccacattggagatcttaactactagacagcacagagctctgggagttgcaagcaagcacaaatcctgtctttgaagaggactgcacccagtattatctctagagaaagactcagattgtacagtctgcttggaaaactaaggtgtgactagaaacagggcaagtaaagccacttcatggaaggggaatatgttttgatttttaaagtatttcaacctctttggttcccattgttacttttcccttctgtaggatagcatttactggccacagaaaaattgcctattttcttacagggttgccagacagcctgcctagagcaaaaagatatatattgcccttgactatccaaatatataaaaatgatatgacagcttcataatggacagaagtgtgaactcaaggacacattaataattttatatcaatattatttaaatatttttgctaggttgatttatattttaaaccagtgaaagctcttcaaaagctatggaattatatttttttgttgtttattaattaggctcccaggctctaatggacaacattttggaggaagtactaaaggtggatttataaaactgaatatatgcaatgtggctaccaggctgatttactgaaaacaatgcattaatctgttattcactaacaaaaaatctctaagagagtgatttgttttatcagatcagttttcttatgcaattctatcctctaaaatctaatttgagacttccatacatacagttttagatgggaggaaagagcgtatctatgtttcaacagttttgtgttcttacttcttctgggcctgggattcgcctcttttttgtaactactaaaattcagcacctgcttcaagtccatttcaaaccccatcttctctaaggaccttcccctggatatctatctcccatctctgaagtgttatgacacttattttcttcagcactcattttggtactcacatactttgtaaaaatactacatctactgcttttcattgcttaattactttcacttatctattatatacagccaacaaactatacatctctagaaagcagagatggtattttagagctactttatatttctataggatctagcagtatatccattatatcttcatcctggatatctcccttggactctagacttgtttgtctactgttctactcagtgttttcctgtgggagtctaatagacatatcaaacttctgatatccaaacataatgctcaaccttttcctctcaaaatctgttcattgttttctctaactcagtttttggaagctccgttcttccagttgctcaggccaaaataccttggattcatctttctgtcatacttcacatcccatccatcatgacataatatcatttctatcatcaaaacaaattcaaaatacgatcaattcttcctcttgtaccactatagcttttgtccatgctatcatgattacaatgccatcacaatattcatctaattggccttctattctcaacataagagccaggttgttctttgaaaacgttaagtcatcgtgtcactcctcttcccaaatggcacttatggcttcccatttcagagtaattgtaagtcttaataggataagtgttaaagtcctaacagtaacctataaagctctatagacctgacattcacttatctctttgatttcatgtattttctccaccactcactccactttagacatgtgggctagagaaatctccttgcaattccttgaattctctaggtaagttcctgcctcaaggccttttcacttgctgttctttcaacctagagtgcttttccctcagcctaccctatttaaaatacccgccccccccccacacacacatacacacacataaacctttgaaaaccatatcccttttcacttaatttttgttcttcatagtacttatcactatctaacataatatttacttatttatttatattattgtctatctccctacactacaatgcaagcttcgtgaggactgaaatttctgtgtgttttgttcattactttagtgcccagtgctagaatactcccaggcaagaagtgaatgctcaataattatttcaacgaatgcacaaatgaagaaatgaacagcctggtaatatagtcctgctgaagttcttataaagtgaatatagtagaaaataaatgggaattgcactgaaaaaaatctcagaggaaggcaccactcagagaaagcacatttttcttgtagcacgagtcatagtatgtgtcccacgtggccagaagtggtaggctgtaggccaagctcaagccattggttacctgtgtaaccccaggaaaggcctgaaattcttcttgccttgagcacacatctgtaaatttgttttgatgcctgccttccacttgagtgctttttatattgttttgtagatttttctcatgctgtcttttatgggaatatttaacttctaaaatagggttgaatatacttttacatagcattctgtatctagtagtagatatatgatacaggattggtaaatgtgataatttctaccatcccaaagtttactctctgttgcagaaaagcaaataaaaaaacttcaaaccataaatttaagacgtataataaagacataattaggatttctaatattactatacagtcctgagctccacacttgtattctcagtacctaacactgcttagttagataataatatctgttcaatgagcaaaaagtaaaaatacacataaaacactgtggaaagtgagtattcgttgagaaaaggagaaatgaagagagactaagatgatcatgtgtaatcagagacatcgcttctctaattgctaaatccccagtccataggagagtatctggctccgtaggtattcaaatactcatgaatcaacggataatttgaataacgttgaccgattagctgacaaagctctatgaaggatagaggtatttaagaattcttatttgttttgatgaaatagaaagagacggtccttggactatgcagcacctagactacatgggaaaatcacttgaagaatgaatgtgtttggaaaagcattagaaaagtgtatttagggagggtgaggaatattcagcttctaattggtagaagcataaaagagtctgtaatttagaaaataagtgtcttgaatacattgtcagtataattgggccattcatgtattaagaatctataggtaccagcctgtgcactagatgctaaagatgaataagacttcactgttctcaacgagttggcagtcttgtgaggcagaaacatgacaatataaatgaatccaataagaatccaatagacagtgttgaatgtaaaaggattacctaaccaagagaactggtgggttagggaaagctttccagagggaaagaaaagtgagataaagactgaggaaaagttggagttaggcaggggaaagattggaagaactgtgaaagagaaacttgcacattgaaaggcatggaagaagttcagtgtgattacatttcaaatggactggaaagcaagagaaggtagaggtggaaggagaaagtaggcagaaaatgatttaaaataagactagagagttatgtaagcaggagcaagattacaaaggacttgttcatctttggaagacattttaatttcattctaagaataatggggagcaattaaataattgtaagaaaagccgtgatatgattagagtagaatcaacatttagaaagccataactacaaaatgtagaatagattggaggggcaacacagagcattgaataccattggaggtgcttttaaagatctaagcaagaaataatatgggcctgtgtatgggtagtaataatgggagagaaaataagaagaaacagaattgagatgttaaggaagagagatgttaagtgaaattggcagggacacactatagaaaacactggcaaagagaggaacggtgatgctgcaaagtggttaggatcaaacacagaggggcagcaccaaaagtgggcaatatagagaaatttctgttgactgatgggatcacagaggttttgtcaataagcagaggtgggggcagttagtgataaaaatactgtgcatgggtcttcccttttgagtctgcaggttgaagtcatatgctctgtgaagtcaaggagagaaagaattccttttgatccacaagtttatatcccattgagcaaacgctactgaccagcagtccagaggctatgtgaattgtcaactctgacatctcattgcacatctacaagcataaacttatccgaattctgtcttcagctcacttatgtagaaagcatttgcaagacacagcaagagactgtattcagagtgctgggtgtgtgtgtttctgagcttggtggccagaaggaaagaaaggaaacagaaaatcaaagaaaagttgcaaaactgatgtttaaaaaactcagttctggtataaatatttttgtctatgcttcattccatctgaactactcaggaaatctgaggactaaatattaaggctacagtaatactttctacaaatctaaaaaacccctaaatttccttgattctctcatatataccaggaggagctagctgactattttgttcttgctttgtactattaggctttagttttctaatgaggtttcccttttttctcacagctttagtccactagatgggcaaacatatcaacatttgagataatcattacacatccaaaaagtcatgtgccttccatggctggcttgtccacatcagcaccactttgagccaagtttgatctttctttcctctttctttcttccttccttttttttctctctttgtctttctctctctctctccttctttccctccttccctccctccctccctccttccttccttccttccttccctccttccttccttttctttcttttctttctttcttgaggtggagtttccctctcgtcacccaggctggagtacaatggcacaatcttagctcactgcaacctctgctacccatgttcaagtgattctcttgtctcagcccccaagtagctggaattacagggaactgccaccacaacttgttaatttttgtatttttagtagggacggggtttcaccacgttagccaggctgttctcaaactcctgacctcaggtgatccacccgcctcggcctcccaaagtgctgggattacagcgtgagccaccactcccggcctgatcttgtttcttttagataccactcttgtttgctgagtgcatttttttccacattctaccttttattcctttttcagtaatgtttggttgtactgctatttatctctgcagtggtttggttgtactgctattgtgacctgtgcatatatactacctaccacaggatggatctactagcaaatagtgtcccacctctctttcaaaagaatcatgtaaactcagatcccaacaagagaagacccactgataatagtgatgttgttctgctttagctgcgtattttcctaggtaaaccctggcctccaggacatccaggatatgagccagataagggctaacaacaaactattgctcacctaatatccctctgtactttaccatgtgctgaatatctcagagcttccatataaaaccccagagagatttattaaagagaaacttgttgcccaggctgtattcaacatctggaatgatttctttacatcatactacaatctcccttggtgacattttttttttctgagatagggtctcactctgttgccaaggctggagtgcagtggcacaatcattgctcactgtagcctagacctcctgggctcaggtgatcctcccacctaagcctcccaagtagctggaactacaggcacatgccatcatgcccagctaatctttgtataatttgtagagacagggtttcaccatgttgcccagactggtctcaaactcctgcacttaagccatccacctgccttagcctcccaaagtgctgggattacaggtgtgagccactgctcctggctgtccgttgctgacttgatcatccctgctaatccttcaagactcaagtgtaatcttctctttcagattttacctgaccagcttctgactctttttttgcacagaatcggatttatcttcctcaattcacacagcagctcatagatacaattagttcactattcatagagatagaccaagttaaggctatatatgttctgtcatataatatcatcaaatatatacataaagagatatatacacatttattaaattgcttaagtcagttcactgtgtagattgttatattcttgagatgaaaggctaggtcttatgatttttgtgttctgactgcctagtagtacactagtaggtagtattggtaggtagatactacataaatttttaagaaaataattaaaccacttgctattttatgaagaatattatttcatgcttccattatccaacatagcaacccaaactagaaaattcagccactgtcattttctaataatacatttcactacaccattgtgaaaaacatttggtgactcacatctcaaactgtgaaatagctgatattgtgctattttaaagtgataattttgtattttatttgcgatttcacatgttagggctaaagaccaatttaggctaatatatctgaagagtgaatagacattagtacatccattcattaaggtatgatttgccattttattatgatgaataatcacttttcatttaagaaagatcttgacttttcctgcaaactgttatcttgtgaaactgctgaggataggcctggctaggaaagcaaaatgtgtacatgttacttatacctgtgccactctaatttaaaaacagcatatctcaatatctcaatcaccaacagtaagaaaatttttaaaaacatacaaacaaaaactgccaagatcttcattcaaagtcattttaattgcttatataaatacagacataattataaccctaaaaagtatgctaataattaattcactatttattggcattaaataaggttaaggctgtatgtttttatacacacatatacagacatacgtatacatcatcaagcatatatatatgcgagtatatgcacataaatgactgggctgatttattcagagtatgcactataactgtcttcagttttaaaagataaatctactatacaaaatactagatgcaataaaacccccatgtaatacaaaatactagatgcagtaaaaccccccttctcagcattctttgcactctgttatgactcaatggatatatgtgtgttttacctgtgcagtaagcacatctttacactgtctagtgaaaaccactcttgccttcagggaatgctcctctggaatccacctatgtttcaagtggaagctgccaaattccctaggtttctggactcaagtgttagcatataatccagatatggccaatcactgtatcctactcctctgatcacagtgattagtccagagaggtcatgaaatctaaaccaagttaatcagtctttccgaacttgtagtcataaaataattgattgcccaaagtggattttttgaaagtgaaatggatgttattcacagttatgctggaacaagaagtttgcagacagtgccttggacaataaactaatgctaatagtaaccctcttctgagacttttctacgtggcatttgcttgaaagtttccttttctttatagttaaaactacataattgtgaatgtaagctcaataataaacaaggtatttctatttccataaaaatcactgtgaatgtattaagatattcatcttaagggtttgcttttgcatctcttatttattgaacacttaaatatatactactgatggtagattaatttgggagatatttgtgaacttttaaaggacattcttaaaaagaaaaaaaaaatcccttggtagaaatttaacaaatctacaacttgaagagcatacattaactaaatccaaattaataaaatttagctaaaagtctaattgaaataattctgtgtgctctcaaaaatttatgggttgaaatacatatgggtttattattttacatattttctcaagatttatgcagtgaatgtgtctcatacatgattgattaaccacactaaaagttgcaaaatgtagatttggcatagaatcttttttttttttaaacaaaaaaaggacagggtcacattctgttgcccaggttggagtgcagggggggtgatcatagctcctgcagcctcaaattcctgggctcaagcaatcctccaaccttagccttctgagcatcagggactacaggtgtgtactactacactaccatggctacttttgtaattttttttttttaacctagagacagagtctccctatattgcccaggctggtctcaaactccttacctcaagcaatcctccagccttggcctcccaaagtcagcttagaattttttatatgttaaaataggagattaaagggggaagtatttttcccctaaagttttaattcataaagaaatcagaaaataaaaacaaatcatggtaaaaattcaccatttgaaatgttaccatgtatttttagatgccaaaaatgggtacaaatagtctatgtgatccatgattatattgattgcaaattttagattcagttgtaaatacaaaatcaagtttaaggatctatttattatgatctaatagagaaagttagaattctctctgtttttaatgcttcagaaaatattacttttcccctgctttggaagggtttctcataaagtaaaaatatgccagttagtaccagactggcttaaatagatagttatagtaaactataaggcacttcctagttccttgcaaagtgccttacatagaatatatgcacagaagacattcaagaaattaacagattaatgatggatggtgaatggatgaatgtggtgggtagacgaatggacagatgggtgaataaatgtaaataagtcgtaaagtcaaaggaagacagcctgtcattattattacaatgataatgatgacaataaaactctctacagatatactatctcacaaagaaatactataatttaatttaataaaacagatggctttttctccttgttagccaacctcagacagatcacatgattctaaggtgacaaaattgtttttttgtggtaaatatcaaaagccacactcagaatttacaggagaaatatggctcatattttttcctagaaattttctttctcttttcttctgtatagatattcaaacatgtgaccaattctgtttctcttcctctaaatgtctcattttctagtctctgaggtcaatgtaataatgcacctcaggacttgagatatgttaacattgcacaaaaccaggatttattgaaaaggggcaactcaatgggaaattggaataaaaagagcccaaaatcattggattcagaggctaagagtttattcatattgggctatctgtaagttttaggtagtacgcaagtaatatatttgcttcctagatataggcagcttgaaaagattcaaaagaacaggcatagatgcatggtactgaccgcaatacttctgtgagtaggaggctggagtaatttaccactctgaacaacagggctgtctgggttgcagtttgggggtgtctcatttcctattatgttacactatcaaaattgcaggaattacacatgctatgccattaccttctagacagacaagctgctaaattatttctatgaggaacatgagctacttacttatcttccggataagaacagaagacaagtggagagcatctgggagacagacagtgtgagaaacttctttgtctgggttgcaaaaatgccactctgagatgttctgtctgacacactgctagtaacagtcacactggcaatatgaaatgcttccaatacgataaatagttaaagaggagatgttgcatcttgactttaaatgaacaacaagaaaaaaacatgtaaaactccaagcagatgagcagtgttgtgatcaacagaagcactaagttataaaataagaaaaaggaaagaaaaataagaaagaggagaaaagtttttaatgagtctcatgaatattgagatctataaggctcattagaggtgcaattgattaattattttttgcagatgctgatatggaatccacagattttgaaacctgcccatgatcatgcagttagttaataacagagaagtagaatccacctttctgatctgttgggagggaggtatgtgtgaaccatagtgggaagaaagagaagtaactacttgaacatggaaaaaccagaaacaggtaagattttagtttctcactggtgtatgagcctagaaaattatctggactctcagcaagaattttataaaatttctagttgtttcctatattcactttgctgcaaattcaaatgatataatttttgcatagcagttacatttctatcttttttaatattctcttttagctctggtaaaaatctggacgtgtacatctgccaaaaaaattaaaggtcaacaaacaacatggtatctgaaattcctttctattttgaagactcacttattcgagacttggggaactctgaggatgtactgcatgaagcagtacaggccacaaccaccaatgctgaataaattagcatacaaagagaattatccaaacacccagctctttctatgtcttggaaatcataccatagatataggttaaagtttatactacccagtatagcttggaatcaataagcagcgttaaagctttatcatcaaagagtttaaattttcagaggcatggctctctttcaggaggcatgatataattatgaatcctttcttggtgatttcccttttggttatcctctctgagcctctttttttactctgctgtcttacatttgcttcctgccttttttatttttaattgatatttaaatcaaatacttccacttaaacctcacaatttttctttgcatcttcttctcatcctttgattaggaattgagtagaaaatgattgctattgcaatagagagaaaaaatggcaaatttggaacagcacttctatttctttttgaaagcttatctcctcctgttctccatgcacacagcacccccataataacaagtaaaaactaaaataaatggtcacttttgacagaactaaggtagaacaaaataaagagagtaacagggagactgagagaaaaaaatagcaaatagggcagtagaaaatgtaagtataaagaaaaggaagaggaggcctagaaagaggtaaaaagagaaagcgcaaaggaagaaattatggcaagaagagaatggaaaataaaaaagacaagtgatggctctttttagtaattcttaagccacctgtctttgattctcaaagcatctgctgcaagagtatgaagaaactttaactttctgccttcactaattgaatttttttaatttaaatttcaagttctttaagaagactgataaaaaaaatagccaagcatatctgtctgtgaagggaacacacagtacattttcatcagttcataatccatttatgtatccttctctctgttcatcttccatctacttgtctataccctataatatatatacaggtgtctttccaaacatgcatccatcaaacacctatgtgaagcagatacagagagaagcctaaaagactattttgaataaagcagaaacagttatgttattagaggcaaaatgtgaaggtaattaaataaaagtcaaatttaaatgacctttagttgattctcaatactgattattgcaaatcttaaatatagattctcaatagtagtaaggttttaaggaacccctatgccattcccccctatacccaccagtaaggatacagcaagattctattcttcatcttcaggcctttgcaaggaatgcttatgttaggaaaaaggtctaagtatagcctgaggatgtgcataaaagcgaatggtgacttatggaagcaaccttggggttgttcaatcttaagaaattgttggttattgttcatgtagcaatcttcatgactatggtacatgatttgcatgcctgatttaccttgtcatggaaaatgatgaatttgcatgttaaaatttgcaagctgagcatgacaggaacaatctagaggccagtgtctactaaacccagcttcccatgtggccactgacggtatttattcttaactccagacccaactatcattcaccaagtggaccaattcttgtgacaagtgacaagccataagctcctacaaacagagtcaggctctaacaagtttcatcctattttatatagtattaaaatatactattatagaaccatgatgaataagaaggtacatcagagcctaatgtaagcttattaaggagtaggcttgaggtaatcatcacacaaacttcttatcataatacttccaataaaataaatagggacaaaacatggactctgagaaatatgttcttggaggagattgtaaagaaagatgcatcaaatactattaatgttttccatctttacacatatctatgtcatttaaattttatgtaatgattatatattgcctacaattggaaaatgtgatttatataaaagctacagttatagtgaatgttactgtaagtaaataaatggatagatgagacattcatcaatgctatgtgtttgttctaaaagtgcagaaagaatgtttattttcattctttggagaaattaactaaaatcaaaaatttatttgaaattgacaaatctacagtgtggaacttctgaaaataaaatctgaatgaagaagaatatttagcattcttatacttttggcattttattttagaaagaagcagtgggtattaaattgagttttcctgcctagcaacttaatcacacctgaatgactggtacaatctttcaatttacactcaacacattgaaaaacatccagtcttaactatgggcagagtaaaaataggcatgtaatcctcatagccaccgtgcatgatagatactattttcctccatttaacaggctcggagaagctagagagattgcacaatatctcagagctagttaatggctgagtctatctaactccaaagtcaatgcttttctgtcacaccaagagaataataactacataaaaacataagaactggaagtttgaaaatgagttggcttactgattgtcagatacacaatgactataaagcataaacccttctttgctttagttgtacatatggtctttctcacaaggaattcctcattaagtatgtggtccagtgcctacccatgcggactgcagtcaggagatatacgttctattccttgctgttgcgtcattgtgcagaaacagaaaaagtgatttgccctttttctacattggtttccccatctgagcaccagagatcatattggctcctagttgcctgggaggggtgttgggagtgctaaaaagtgtctatcatgtgtaaagctctccagatttcttgaatgagagagggttatcattgacattgttatgagacacagtaaaagtttaactaccagctgtttgtttaagcattttccctctgcatccatcagggatgatgtaagtctggtgtgggcaaagtgtagtttccagcccaaatttggcacagagatgctttaggatgacttcagtcatcttcctctttactgctgagggacatctcaaggagatgaaacatgtctttttgtaaggtctttttctgatcagtactgccaagctgctttgcatgatgggatctgtagttttcactcatcccatttcccttttaaagatgaaaataaaggtaacctgctccaatttatacctataagaaattgcactcatgacctgaggaagtcagaacaactggtagaatctgccccctgcaatccattctttaaaaatagcactaatggcgactggaagggtgagccatagatccatcgtaatgctgatgacattggctagctctgaggcacttctcctgctatcatttaattactccatattaacgtataaatacaaggagacacaaccgaatatgaggtaagtagagaaagagctgtgcttatttagttaataattaattactagaaatattaaacagtgggacattaaccacttgcccttttaaatggtaataaatagcagacatacgtctaattaaggagctgtaaatactttggaggagctgaattgaagaagaaagatgcttatttacggaggcatgctgaaggaaaaagagaattattggcacgtttagagccagctctcccactacgtgtctgctcagattcctaactctgcctcctctgccacgacatttctcactgaggctagtgccacagggaagaggactcacaggattcccttaagtgttttgtttgtttgtttcaagaacagtcctttagtttacctcaggtgaatctcactttcccatcctttctgagttttcattatgaggatacaattttcagcacattaagataatttctgctgtttttcgtaaatctctatatagcacctcaatcacgactctaagtgataagattcttggcactcttcatagacagttataccgaataggggggacagaattttttttataagactcctgattcttgacctcactaaatagaggcttaaatattgaaatgacaaggggagctcagaaaagggatttttgaacaaaacctccagtgtcatgttattctaatggactctggtgaagctgaaggacactgcacagcagaaggattaacattagaggaagctccatcacctgctagaatccacctctaaaagcaactgctagttttaaaaatcttttgtaggattacctaattagccattttttttttaaactgggaacaaacttcctttgctttcttctatttctagcttctattttaaaacacctccttaacttcttttcttacgaaaacttttcatagcaaaattcaggtcacagaaataatacatggtcagacaagtacacaatggttgtcctttggttcatccatgaaactctatgatgcttcctagaattcttttcctagagatccaaccccatagccacatcaggtctctcctcttcattccttgcccatcaagctcagtaactcgccaggagagatggaatttttcagctgtcctttctctggtctaacttgtacctccaaagcataagcagaaaatgttacataatggctttttcactttttcatagggtcttcttttttgcgaacggaggggtcagcctctcctatagcagctctatttctccaggccataggtggctggctataatcttattgctgtggtttgaatgttccctgcaaaacttgtgttgaaatttaatcgtaacagtattaagaggtgggacgctcaccagcactggccatcagagaaatgcaaattcaaaccacaatgagatatcatctcacaccagttagaatggcaatcattaaaaagtcaggaaacaacaggtgctggagaggatgtggagaaataagaacacttttacactgttggtgggactgtaaactagttcaaccattgtggaagtcagtatggcgatgcctcagggatctagaactagaaataccatttgacccagccatcccattactgggtatatacccaaaggactataaatcatgctgctgtaaagacacatgcacacgtatgtttagtgcggcactatccacaatagcaaagacttggaaccaacccaaatgtccaacaatgatagactggattaagaaaatgtggcacatagacaccatggaatactatgcagccataaaaaatgatgagttcatgtcctttgtagggacatggatgaaattggaaatcatcattctcagtaaactatcacaaggacaaaaaaccaaacaccgcatgttctcactcataggtggaaactgaacaatgagaacacacagacacaggaaggggaacatctcactctggggactgttgtggggtggggggaggggggagggatagcattaggagatacacctaatgctaaatgacgagttaatgggtgcagcacaccagcatggcacatgtatacatatgtaactaacctgcacattgtgcacatgtaccctaaaacttaaagtataataataataaaagaagaaaaaaaaaaagaggtgggacctttaagaggtgattaggtcatgagggctctgacttcatgaatggattaatgctgttattgccagagagggttaattattgagggagtgggatcctgaaaaaaggataagtttgacccccatttctctgtcttgtatgcttacttctgccttttgccatggaacaaccactcaccagatgctggtgccatgctcttgcatttctcagcctcaagaactgtgagcaaaacaaactgttcttattaaatacctgtggtagtccattatatcaagagaaagcggactaaggcagttatattgctgataccattattaccactaattctgcttccctgaaactattcctcctcagggacttcaatggacacaggtggaaactgtaattattcatacatgattattatacccaatagccagaatgaacatggacatgtatgaaatgaacagaaaggcaaagcaatagattagattgagttaaaaagatctgttctctagaaagcatcacagaggattctcttggttctctctgtctggaactcctgaaaaacattcagtctcactatgcaggttcccacatcaaaggcattataaaaacatgctttactcatgattctttctacatctctgatcactcacttgaactctcttccccctctataagaaatgttttgagaaatcaaggacctaggtcaatgaaaataggtttttaatgagaaaataagccatctaccaagcaagaattaaacaagtactgacagcaagttcgtagtttagaagcatcttcagaaatcatgaattacattgcatttgagcttgggtcgaagaaagctgtcacatcaacagtctaaagaaatactaatccccaaattcttttaaaatgggggattttattgtttaatgttattatttaacatcgttatggtttggtgactttctgaacctttcaaaaaaatgagataaacctaaacatcaaaaagaaaattgagagtcctttacttcctgagaataaatctgagatggcagcatcagtatagtattggaaagaaagcagacattaactctttgaagttaattatttttttccatttaccaggcagaaaacaataaagacactaaatactcactaaatcactgctgtagccagatgctgttcaccatcagcatttggctaccacagtgattctcaaaatgtggtttcttagaccagccacgacttcacctgggaacttgttagatatataaattattgggttccacctagcaatccatttttaacacatcttccaggtgattctgatgtaaagtttgataatcaatggcttataatgatatcagcaaccctaagattataccattaaaaccacaaatttcttgtaaagaaaattacaaatgacttcaaactaatcatgctttaagcatacttttcatgacattatatatatatatatatcatatttctgtatttcattaaaataaatcaggttattcaaaagaataagctacttggaaatcctgaaaactacctaaatgcctaataaaataacattaaaaaccaaataacactttctcatttattaaggacctattttatgttaagcactgtcctagtctttgcagatattctatataatccttaaaatatttatacaagatgctcaaaggctctccccgtatgtttgtgtgccttctacttgcttgccacaaggggtggaaaggtttaatttgactgttcatagcctagatactcacttaacccaatgattcagtcaccatgagcaaaggtactatactttaaattgaatcagcaccaaagtcctgtattttctcatccactggttcctatgcacatgcagcaggcggagaaaggccactctgcatcaaagggtatgggtacaaattatccacagaaaaagtctcagataccaattgtagttcagggcttcctgtatacagtaaacaaagagaaaaattcaagagaaagaacatccagtgacagaagcaaaagtcttcctagcatattggtggttctggtaaggacaagaaaggacaagaaagttgaaaacagtcacctggtagtctcacagaaaattacaaaaaaaaaaacaaaccaaaaaaacaggaaactgctttttgcaatcagtcctttttgtccctttaccctaatgcatgtctctaatagttaatcaattctaagaaggtggaaaaggaaggaggcaggaaaggcggctggatgaaaatatccaattgaaggaatggacattatttgttttaaacagcacttcctgcatctttaagcaggctgttgtacactgtcagatcattacaccaactttcattttggggaatttatatttttggagggtaaattttatacctcatctggggatcattattactgcaaaaatggcagaagtcttcactacaggagaaaaaaagccagcagactctttttctttccctaaaataccccctactccttcagtagcaggtttctcaaaattctctaccctgcagcgcagtggatttcaataacacatccatcctctgtattttacagcacaattctttctgcatatcacagtcctaccctgcccagccggtgtcttccagttcatttgttcattcattcatctatttatttatttattcttcatcagacatattttgaaaacataggtctgacctcaacaatcttacatctcactgagttgaagcagacagagcaatcgtccaacgtttggttcttctcatctcagtggaaattatattccagctaaaacacatctaactcacacaaaagcctgactagactctttagtgtatcttgaggaactggaggaaaatggagtctgagagaaatcaaactgtgtttgttgaacactttttctatttgtctcatggaatatcagtgagttctgtgatttctactctgtgatctgtgactttttgcatctgcactgccatttaattcccacagtaattgtaaataatagtgacatagtgaccaagtagtcatgattgcccattttttaccctctgctttgtattgaccaaattttactaaggtttctctttcctacaggcccttcactctgcttgctcccaagcctgagcaagcaataaaaaagtggagcatgctcccttagtttctccaggcaagtggctgaccacagcatggtaactccctatcagacctcattggccatctccccttgcttgtccagtttttcttccaaagattttgcttacctctgcttgcccctccttcacactaaaaacgaaaaaaaaaatctgcttaatttgaagatgctttcagatttgtgagatcagagcattctccccattgcaatagtctttctaactaaaggctctccctatcttagtccaaatttgtttttattttacaatagttattattttacagaggaagaaatgaggctcacagagatggcttgagctcatatgacataaaaaatgacagaatagtgattcatagacttgttcaaaaaaatggttgccggacaaggtaaaggtaagtatttcaggcttcacaacattgctgagggagggctatagatacaaagacctataggcctaaatgacaaattttggaggacagagttaaatctgctatgatacagattcattggccactgggctgagaacaagaaatacattccttgatgcttttcaacatgcataacaaaatgatctagaggagggagactgttctctttggtacagtggcaggaagaattacccagatcatcttggttttctcgtttcatcttggagagagcttggcatccctcaagttaggtgtatagatgattatgggaaactggcatgatgcattcatttgaaacttcccacaggtaaagtataaactcaaaagcacaataaacaataatagtgttttacccttcatgctggattgtaatgctgctgatattgaattaacataggcccttgcagaaaatgcaaatgaaagattctggactatatcaacaaggctttgggcatacaaggggtgagaagctgccaaggggaaggccagcagtgtagttagggatcggggtgaaagaagctgggctagtgaaaatgtactccataaattgtatacattttaaaatgaaatgtttattccaactcaaacattttccttaaagtgatgacattcacaaaggcttcactgtatattcttgcaattctaacatagaaataatacataaattcaaagaagcagagttacaattcacatggatttttatttccatagatgaaaactttattctgcaaaactgaggtagtatgggaaatggttccgggccatttgccttcagtcagcattattgaaataaatagtacaacaagcactaattgagcacttctgtgtgccagctaagccatacttaattgctctctctccaagacatgtgttgcctctccgtggtggacacctacacatgttttgtaccagaactggaaaaggagtaaggcatttttactcacagttgcagtgacatgtaaatgttaaatacagaatcttaagggagcaccatgattagagttggaataaactgaaaacctagatcatcagtttaagatactacatttgggaggagaatgggttatagaagcaaaatggggataaaaagaacaatggagttagaaagtgattgaaagtgtcaagctgagtggtgaatatgctgcagttgtcaaggctggaatacaggtgacaaactacctcaaaacaccacattctttcatgcttacttttggaatgctcctttccttgccttttggtgaccacctgaccatccttcaaggccaggacaaacctaatgtcttatatgaacctatgaacccttccctggtatctttctgctcccgtacacatggcttatcacattgctgttttgtgatttatcacctcctgggtcccttgctgagttaaaggcacgtgcagcataagggcagagacttcttcttcttcttctttttttaaacctctttgtgtcctcaacatttagcaagtgtcttaataataactaatacatattaaacagaataaaagacgagagaaggaagttagaagggtaagtgaagaggcagaaaggaaggaaaacacaggaggggtccaagagaggtgaaaggaaggcagggaggaaaagtgaaagattaaaggaatctcttttttcttcccctacttaaatttggatgcagtttgtaatttatttgctcttttctttttaagattgtatttgttcaaatctcccacatttttctccatcaaaaaatgtgcatacctcaatacttaaagttcaggagcaaatggtgtgtatgtgtatcaaccaaaaattcagagaaaagacatctttatcctgagcaccataaattaagcccaaaatctgtccttactacagtggatttcaaagcagaggtagctgggttttcagttcctcctcaaaaggaagggattccattgcacatttaacagggttgtttctctgggtcagtcctagccacgtggaaacccatttgggatgcagccaaggggctatgctgtccatgctggaggatggctaaaccagagtgagagaagagattaatcaatccaagacaacatctgtcaggatattgagtttggctcttgttatcagctgcctgcacttcaggggctgtgtaatatttaatttgattatctctcacctgcaaagagtaggtttcttcctttgcttaaaaatcactggtactagctgaagaggaatcgacctgctggagaaaatgctgacaagaaaacacaaatcagaaatacgacaagggggatgaaaaagggagagaaagagagtttggcttacatcttggccattttttaaaaaaccagctggcttggtttcctattcttttaataataggagtctttttgtttcacctgtcagtcctgattataataaataaatgatgacaagaggacagtataacacttttgtgtatctttgaggctccatcagtaaaaagtattttgctgtgtctctaagtatcagtgcctaggtcctgtaggtcttatggagttcctgctgcaggagtcacagaaaaggcctgcacccttttacactgcagagaaaatgtttacattctagagagatagaagtttgagactaattacagtggctttaataacctaaactcccttgagttatcaaagatgcaatcttaaaaagttgtgccatttttagaatatttgttttgtaaatatgtgtttattctgtctctttccctctcactggtatctggattttttagttggtcactttcctgtatagccacagttgagccaatgtatttttatgccatttatgtttattttaaagtacaaatctttcttccactataccgcaaaccttcccaatccaatctttagcactgatctcacttgtgaaacttacttatctcagttggccagcaaaaatggtctattagatatttcaatgtcatctcaaactcagcatgtgtaaaaacccaatttgtcatctttcccacaccaaaaatgctccccttgcttaattccctattatttgcaagcttgaaatttcaatgacatcttcactcacacttgtcacgttaagccaaccagctacaaattcttgttgatcatttcttcattatatttctcatgtttttttttaaatttattttcaatgccacacttactattctagcttatcccttcatgtcatgaaatacatactacttcaggaagcttctggatgatcccctgctgcaagccattcctcacctttaaactatgccatgggacacaattatatcaatgtgcattaacaaattactttcctttgcccagtaaaattaaaattaaattcagaaagctgaacttggtattccaggtggctgaaaactaattcttgtctacattttcatgtagacagatagataaatagatagatagatatcttaattttctctgcaaccttcatatttaccaggtaaagggattcactatttgctaaaaccgcttgagctcccccaggtttaccccttcgctcatggtcacattcatactatgcttcatccataccaattcactactagtcccctgaactctccataaacctgtatgtatctgtgcttttgcatgtgctatttcctctccccaacatatctgttcttattccttttaaccatcataggcaaactgttacttgagcattaaagacaccatattgatgtcacctttgtagaagtgctaccctgtgtctcctattctgggtaggcaattcataaatattctcccaaatcaccctacgcttcctgccactatggcattatacctggtgatgactgaatggataaatgaaacaatactgcctggagttccctacttttctatcccctaccatatcactacacaattaatctcatcctccttaaagaagtttcatttgccacatattttcgaagccttctttgacaattccagttaaaagtgacatctttttttaatcccctgaatgtgtactcaagaaatcatttaccgatttcatttggaagttatagaatagataatcccctgtgtttctagaggcttgagaataggtaattgagattttaaataatactggtttcagaattgtttaaatttctttttttagaaaatgagtgctctgaggtctagacagtgaggagctagaagccaggagaggagaaaagtagggcagagtgggtcaagattcagcgtacaaagataaggaagatctaaaagacacttatttggggtaaagcagtaatctttttttaaaatccaaaacaggtatcaatagggacaaggcagactaataatggaaacccaagtctgtaaattcgcagggaaaagataagaaacctcaaagcaaaatgaaccaacttgggccagaaaagataggataagttgctcattgtccaacatagagatgagatgtgtataactctgagtattcatctacttgtattagccatttaaaaaaatagaggaaagtattttagacatacagccaaaccactagtaatatatttatcataataccttttacaaaaataactctcacgtcagtttctcttgacttagaaattctaagttttgttcctataacatctaagtgacactgtacctattcttgttgaatgctaaggcagatatatcatttccttcctgaaaactgagagcagaaaaagggtttatagctacctgtgcctagcacagacctattttttctttttctctttttcttttctttttttttttttcaagagaaagtcttgctctgtcacccagaccagagtgcagtggcacgatctcagctcactgctacctccgcctcctgggttcaagtgattcttctgcctcagcctcccaagtagctggggctacaggcacctgtcaccacgcctggctaatttttgaatttttagtagagatggggtttcaccatgttggccaagctagtcttgaactcctgacctcaggcaatctgcctgcctttgcctcccaaagtgctgggattacaggcctgagccattgcgcccagcccaaacccattttttcagagtagataatcaaaagactatatcttatacatcttttgaaaactcggcatgaagtactaaaaatttcagcatcagataacaaggaatgatctaaggacaaactaacatatttcagctttcatgaaccattgttttcttctgaaacagagcaattaaaaataaataaattgggccgggcgcggtggctccagactgtaatcccagcactttgggagggaggccaaggtgggcagatcacttgaggtcaggaattcgagaccagcctggccaacatggtgaaaccccatctctaattttaaaaaatacaaaaatattagccgggcgtggtggtatgcatctgttatcccagctacttgggaggctgaggcaagaaaatcacttgaacccgggaggcagaggtcacagtgagtggagctcacgccactgcactctagcatgggtgacagagagagacttgtgtcttaaaaaataaatatataaataaattggcaaagatgccaaagcaattatatagaggaaagatagtcttttcaacaagtggtgctggactaattagatctccacattgaaaaaaatataaatttagaacctgcctcatagcatacatagaaattgataaaaaatggatcatagacccaaatgtaagagctaaaactatataattttagagaagaaggtaagaataactctttgtaatttgagtctaggcaaaaagttcttagctacaatgccaaaagcagaattataaaagaaaccttgataaattgaacttcatcaaaattcaaaacttttacactttaaaagaaaataaaaagataagccatatcctgaaagataaaagacttacatgcagaatttataaagaattattggggccaggcgtggtagctcatgcctgtaatcccagcactttgggaggctgaggcgggtggatcacctggggtcaggagttcgagaccagcctggccaacatggtgaaaccctgtctctactgaaaatagaagagttggctgggcatggtggtgggcgcctgtaatcccagctacttgaacccagagggcagaggttgcagtgaactgagatcgtgccattgcactccagcctgggcaacaagagcaagattctgtctaaaaaaaaaaaagaagaagaagaagagttctcaaaattcaataataaggaacaaaattctcaatcaaaagtgaggcaaaatatttgaataacacattacaaaagaagacatacgaatggctgataagtacaagaaaaaatgcacaacattaggtattaggtaagtaaatattaaaactataatgagacatcactacacagtcacttgaatggctatacccaaaagagagacaaccataagtgtcgacaagtatatgaaaaacctgaaacagtcatatattgctggtgggaacctaaaatggtgtagttattttggaaaacaatatggcagtttcttaaaaagttaaaagatttaccatataatccagtaattccaatcctcagtacctatggaagagaaatgaaaatatatgttccctcaaagaattgaccataaatacccaagcaacattcctcataacagccccaaactggatgcaatccacgtgtccattaacgggtgaatggttaaacataatatggcatatctacacaatggaatactatttagtcattaaaagggagcaaactattaagtcatgctacaatatgcatgaatctcaaaaacattatgctaaggcaaagaagccagatgcaaaatacttcgtagtgtatgattctatttatatgaagtgtccaggaaaagcaaatacagttagcccttcatagctgtgggttccacacccacggattcaaccaacctcagactgaaaatattgaaaaaatgaaaaataacaatacaacaataaaaataatgcaaataaaaagcaatatagtataacaattatttacataacatttactttgtatcaggtattataaataatctagagatgatttaaagtatattgagcatatgtgtaggttatatgcaaatactaccccattttatagaagagacttgatttgggtatcaaaggacgttctggaaccagtcccccagaacaccaaggaacaactgtatatagaaacagaaagtaagttggaggttgcccagagtctggagtacaaatggggactgactaaaggtgggcatgaaaaaaattttgggaatgatgaaagtattctaaaactagattgtgatgatggctgcaaaactctgtacattactgataatgaattgaaatgaatattttacacaagtgaattttattatatataagttgtacctcattaaaactgctaaaaataaatagtgctgctaagcttatataagcagcttttaggtctcaactgtaatattaccccttcagaaatgtcttacctggataccttctccaaaatatccttttcatagttttgttattataatctgtttattttcaactttaccatttaccacaagctgtaactatcttatttatgtattgacatacttgtttactgctttcctcttcaatcagaatgtaagccccgtgagagttgttactttatttctcttatttactactttattcccaaaattttgcacagtgcctggcacaaagacatggttaacagccatatgtcaaaggtataaacaaacagattaatggatgactagacaaatagctgagtaaatagatgagctatatttgctaagcaaattagtttcgtgtatctttaggagacacagaatataatctttcattttaagaggggaaaaaaaacttgcaacagaaggaaaatggtatttcctcatgatcaagaaagtggaattccttcctcagatcaggcatctgagacttttattcccaaagaggacacgatgccagaactgagcacagccaacatccacctctctttttctttaaccatcccattaacaaagttgttttctctagagtctagatccaattaagagcaagggtggcagagaggagaacactgaggaaagcaatgttaaagatgtttgcacacattcctctgggggatagagaaagctttattggctttcctatccctcctcctctttttcccctccatcccccacctcctaaactcctttgcagaaggcatcaggacaaagaagcacccagcattcagctcaggaacagaaaataaatacactgggaatactccacggtccctggctgaatacaaagcagtgattcagcagagaagctgcaacctcaatgggaacagagagcgagtactgaacatagcaccagaaacacgagagaaagagagagactgagagagagaccatcttaatgttctcactgcgttttcctcctgtgatgtctcctataataacagtttaaatgcagtagtaagtgaaaagaaaaaagaagaggaaatagattcataaataatactgcacaaagagaagaagaacacagcaagatcaaaaagaaaatatcagtattttttaaaaaatttaagacaagaatgaaccagagtctaaaaccagagtctagaacaggtgatggaaacaaatgactaaaaagggaatagagagaggaaaaacaagcaatgtactttattggttagttgagaatgagtcagggaatgtgtttcactcatgtcctgtggccctttgacttcaattatcttgttaaaaagtctgagctttatttccactgtgtgtagtgggaataatgtgcatgtcctcctttcctcctttactcgggtctggtgaggactaattaggcaatgtatgtgacatgtctttagaagtttagagtgctagataaacagaatgcttttttgaagtgcctgtacattgttggtgctgaataaacattaaatcacactcaagttttgaggctgagcaagagagagcagtttatagttcattggggaaatatttccatttcattccagtatttctaagttagtgacaaaacacaaacaattttccatagtcgtaccttctccaaggggcaattattgatggaaaaaaaatcaaaggaagctcttactaatgaaggctgaatgttttataatcaattgagggtcacaggacaacccagaatacggcagtacatggataaaaagtagaatccagatagatatgaggcagaaattataaagaatacttctaggtcttacatagagacttagtcttatacagaagagaggacatagtgtggattaaataccacattacttacccaataaattctacagaacctagtaagtgaaatgcagtattgagagtcttggaatgccaggctttccattttttctgatcgatggagctctgtatgcagcaaataaggctgggtgccaggtttatactctacatataaggaaaactttgggagtgtgccattttattataatttcatttattctgtatgcagaattccatttttctttcctttcaactagattaaatactgtaaatcacagctttattgataggaaaggaggtatctgcattactcttaaaaatgccatctccaagaggccaacttcactagaagttgaagaaggaaaaaaaaaaaaaagagagtggagtttgccaagccaaataaattgtctaccgtgcaggggctgggcatttagatctgatggtgcctctaaatcataaaacatttgttaagtcatcaactcaggaaatgcaattatcacccaaaattagcaagaaagtagttttaaaacaattgctcacctgtaacgaacagcatagtgaggttatatgctcacctttgatattttcattgacccttcatgtttcaccatcccctatttacttatgacaagggaaaaatagatcctctattgtcaacctttacctttggccatgtaaccatagaatgagtcattgcaacaaatatacttcattctgtacataccattaaaagaaattattgagcacctgctacctgttcaaccctggcccaggcaacacgtggaacatggaagataagggttagtggaaatagtactgatgcaaatatggctctgctaacaactagttgtttgaccatagaaaagtcattttttcttggagttttacctcttcttctttaaaatgcagagaatgtgatatacttgggtgagtatgtcaataaaaatattgattgaaatgttactcagaccaagttactcctgtaatctctaaccgtctatgacttagggagcttaaaatctggttgaagatacagaactaaaatgcagaaaactatcagcaaacataagcacaaaattgatactgcctataagtccataaataataaataaattaattaattagaggggaaaacaataaagatgaaaaaattaatgttttttgagaggaggatgggcttaaaaagagtaaaatttaggtaaatagatgggaaaaaaaccatacatcctaaagcaaaaaaaaaaaattaatacacacaaaaggaaagatggacttgatatatcaggaaacattcctaacaaaaagagagggtgagtatgagagagagatactttaagacctgatggtgcctttaaattgaggctgatgcaacaaaaactggaggccaattttagtttattgagcaaaaatagaaaagaaaaagaaacagatgaaaaggtaagtttaaaaaagaatataaatagttgtgaaaatctaaaaggctagactataaactccatctcattcactgctcatcaccagtactcaactgagtgcctaccagaaagtaagaactcaacacatgaggccgggcgccatggctaacgcctgtaatttcagcactttgggagaccgagccgggtggatcacttgaggtcaggagctcaagaccagtctggccaatatggtgaaaccccatctctactaaaaatacaaaaactaatctcagctacttgggacgatgagacagcagaatcacttgaacccgggaggtggaggttgcagtgagctgagatcacgccactgcactccagcctgggcaataaaggcgaaactccgtctcaaaaaaaaaaaaaaaaaaaaagaactcaacacatgaaaagaccgaggttggtaatacagtcatgcactgataaggatttggaatagaatgatagcagtgggaataaaaaagcaccattacttagaaacagctcattaaatttaccaagtgtaaagaaaaataaaggcaaaataattaataataaaacccaaacagcattgcagcacaatagggaaaccaaatctgaaatgtgaatacatcatctgtggctgcctgtatcttctctctttgtcctgaaccctggggccatcatcttaccatatttcctaactctgtaacaacatggtgctgtcaacagcatagtgaggttatacgtaatggtaaagaattataagccgaagtagactatagtatgggggagtgtaattattattattaatactaatctgcctcaaggttaaaaaaaaaaaaagtctgccaagaaacttgaaaacaaaaatctcctggggtttttctggtagcatacaacctgagactgatttattctatttattgtgtcctcacttccttatgaaatgcctgcatttctattaattctctatcttcgttcattcattcatttattcattcaagtgtcattgcaacccttaagactcagctctttctttcttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccaagactcagctctttcattaaacatgtccatagaaacacatcagctcacggcattttttgaatagccatcagagctacaattagaaacaaactgtttttattgttacttaatgttttatttgtacaggttccttgagggactagaacatgtatagatccagatttttgtggggcttgcaatttttacagtgtgaagtctttctcttaaaaaaataaatacaaaacgataaattaaaaataagagctatttagaggtaaaccctcggaatggcccgtgcaagtaaggagctccaaagctaagcttccctgtaaatccacttctgttgaacatttatttaatcctcatagaatttccagcagagggctaggcatactaactacccatgttacacactctctctcttggcaatttcatcaaactcacagtttaaactataccctaataggaaaacagctgatgttcccaggtaactcagagcattctcttaatcaggtcctcagagtcacttgtcaatgggctctacctgaatacctgatagtctttcaaactcaatttagtcaatgaaattaatcttactttgaaaatctaccatttcattccatatgtctttttgtatttgttccccatctttgccatgtatttccatttacgctctactttatttacttaggactctccgtctctctaccctcctgccagccttcttatgtgaatttcctacctatatttgaactgaacatatcattacctggtctagaattgtctgcaaatttctttattaagaagatctttttttgagaggccgaggcaggcagatcatgaggtcaagagatcaagaccatcctggccaacatggtgaaaccccgtctctactaaaaatagaaaaattagctgggcttggtggtgtgggcctgtagtcccagctactcaggaggctgaggcaggagaattgcttgaacctgggagggggcggttgcagtaagctgagattgcaccactacactccagcctggtgacagatcttttgtcatcaaactaattttcttaactgtttttaaggaaatgtccactttttaaaaaacctaccatgtatttagaaaaaaatgcatttttcattatacaagagactacacagactcaaaaaagagtaatacatttatgtttgagatatgtaatgtctacatataatgcttagtgtgtatatggaagtttggaacctttgtactaatcctggagctccccaggaacctatggcttgggaactgactgcctaaagcttttctcttgggactaaaattgagtgaaactgtactttattttcaagaaatgaactctgacatatttaggacttcattagataattcttaggatcccttgcattatcttttaagaagccccatttttattttaatatccatagatgtttccactgggaatttgtgacattcttgggaatattttcagctttacagacagataactaactttgggatgggggtattagtgttttactgaaatcctgatatctgatccttccctaatctgttagttcctaaactctgtctaccttttcactctttttgtaagtcctcaattttctttgtttgggctttctgagctatttcaaaactgttacccaaaatgctatattatatatttaacagttgcctggccccacagacaaagctgtgcataaatgcttctttcactgtaaatactgctaaggcaatgatgaggtaattagctaagtacatgtcagctctacaggaaagagactggtttcatactctgataattgctgtttaaaagttttaacagttgcacttttaggtaaattaaagtcactttacaaaaagagataaaatagtgaaccatgcatacaaatagtaagaaagcaaaatactggtgttggagaaagaaattgggttcagcaagaggtggagatatattcagtaaaataattgacagatgactgccatttgttggttgacctcatattttgtggaagaaaagtggttttttttaattataagaacagaaaaccagaaatgcaaattattttgcttcattattgctgatgagtgcacttgatatgaaaagtaaagaagtcacacaaacaaagcattcctcaatttagaaataacagatttacttataggcaaataatgtctacatacgaccaccgccactacattctactgagatcatctctgatgatactgtgggaatcagtagagagaaggattacatcagatatctagggagatggctgagttccggcagggttcagagggagcaaaaattgcagagggtcaaggcctgggataacacaggccttggagtaggaagacagccaatatgagacatggatttgcagacgacatcatgttttactctttgggggagtaaagagtttgaaccatattgaccaagaggttgacaacaggtaaagatatcatggttaatataagagaccctgttttcataatttcctaattcagatggtagcaaaatgttcagttagaaatgagatatacagtgggaattaaaactgtagtgtagacttcaggcaaaagtatatcaacacgtgtggcaaagtaatagagggaattagaagacgtaagagatgaggtcagcatttgacctgattaatcttatgcatgtgtatgaagctggctgatgttaaaagtaactctctgagaccagatttgtcttgatactgctctacccagaaagatgaaaggcctaaatagatcttcagtcttaatgatatacagtccctctcttttgatatgtttgcaaattctccagtgggaagaaaataatagaggcatgaatattaaaacacactgaaaattattagagaacatatttccaaatgaaattcttcataagcaaagtaataatagaattccattaaaaaaatccaaaataaactagagagggaattcagaatatcacataattatgaaatataagtactagcagagacctgagaaatcacccatttcaatcttctactccataaagatgtttttatttttgtttttattttaataatatttcctaatagaggtctacttaaatactaaaatagatgaaaatgtagttccttaacaggaaagccattccatttggcagaagagaaacttgacatttacaaaataaatacacctatatccaaagatatgcctaaatataattatagatacttctaattccttcttataatgaacttcttaggtgagaagtttaatatcattattataatttttattttataaagaaccagaggcttagtagggataaataatttatcaatgtttgcagagctggtaattgatagggggatacttagagctaggtcttctggcccagaaactgtgttatttctactatgccatttgaatggtcatttttatgtcattcaactagatttgcttatttaattaaattatgtcctatttaaattataaactaccatattttttctttctttctgtttttcatcttcctttcttcttttttgaatgagatttggtataatcacaaatacacataaataacttttttttaacattaactaaaattttcttccctatagttttcatccatatttaccttataattccatcaacaaacacctcagctatccccttatctttgtctcatacacatgatggaaaatttgcttcctatggttttatccaagtgttgatcctggcctgagagagaatgagagagacctctatcactatcaatcagtattattttggcgtaattgcttgagaaaaaaaaatctagctcatttttgacccataatatattaataagtctattggaagcctgttgaagtacagatactcaaagtaaatggcatttccttgatccaacagcctggaattatatttgctcatttaaaaaaaatctatttgccacgctatactttgttcccagggaacacatgttggcttctagtgatcactgctttcttttcaaaatctatttaacactacattctagcacgtaggcttttggtgggtagagtgatttaatatgattttccccttgtagttataattaggacaatattttacatcaccattatgaaactgtttctgttttctacagattttctaatgttagtaatagtgtttgtataattatgctctcaagttatattagtgccctggatataatgcatatcagtcttacagctgaacttgtttatattattctaatcacgtcttcatatgccctggattttaaaaattgcaaagggtataatagcataattttgagaatttcacttggtaaacattattcttctcttccagtggacaccagtcatcttcattaagcatgctcattaacaaatcactagatctctttgtgactttgaaagaaaatagaaatttagtatggacttggaatcacaaattcaaagaattaaattatatttttaaaaaatacagttatttttccttcagctaaggcagcattaatttttgtcctataatagcaaatagaaaaagaaagtgttagatttccttttgctttttatgaactatatgattgccaagatctaatagaaacaaaaaacattgtctgactccccttacaatataatcttagcaccttgcatgattaattaaaaataaaacatactaatcaaaaaaattacggtagccattgtgtgatgcctcttatatatcgtatctgtttacatgcttgatacccttaaaaatttggttttctgtataagtgatgcaacaaattaattaggttcctattaaagtgtgacgtgacccaagttcaaagtaatattcatgtccatattttgtgtacgtaaattttatgtacatataaaaatcacatttatgcttttacttttttacatataattataaatatatacaaaaataaaaataaagttaaggtcttgtattcaaatacagtcacactatatagattaaatatattcatgatacaaattaattatacttcataacagatcctgtacaaatacatactcttagaagaattagattttgagttctgttttatttttatgcaagaatgaaggcattaatgtaaacatatttttaaagttttctatattatgatatttataatataatttaggattttttaaaaaaattgtgcatattatcattctatctataacttctggcatttcttcttcttgtgaatgtagctatattcaaaaacgtaaagccacttcaccagaccaacatctttgcttataagacaagtaggagttggaacaatggaagctaattcccaactttacacagtaatggtttttgcagaactaaaggctaaattttttcatgcccaatctagaggtttatccaatcaagtaatatcttgtagtctttaagcagttgattgttgtggtgatgatcagtgcatcatattagtgccaaaagagatagaacagaggtcagaaagagagacaaagaaaaaaatccattctcctgctaagttaatgattcagcaatatagaatgctgatctttagatatgcttatacaattacatcatgaacttgtataaggtgacagcgatctttagttatctcaaaacaaacaccagctacaaattggcaaccatatgtggcttacgtctcacaaaatgaacagccctaacacacatatgctagagtgaggtgtgtgtaatgacacaaaacaatcagaagtcaggaaacaaattatgttccccagtcattgttttcacatgtagatacttactatgcatgacttagtgttaggctgcatcactttatttttttaatattttgtttctagtaggatagggtggcaaatagtagcataactaaagtacaactttagaaaggatagaattaattttagacaaattatagagattcaatatagagatgcatcattagacaattacaatagaataaacagtaatgcattattttatggaaagctaggttgcatttttcctcatggttattggtttccctcctatctcacataaataatacccttgtacattagggaaagatatacagaaggaaatttgggattattgcaaactccactgaacattccagcgttaatttttccaggaatgtgtaatgagctctaagatgcaatgcccaggtaagcatcactatcagtatgaataaccagttttagtcaaataaatgtaagtgatatgcacattgcctcatttcaaaagaaactagaatggatcggtggagatgaatatacctgttgcacacaatcctgctatttaagtaactcccaaatcccctatttaatccctgaaaattcacagtcacccctagagggagaaagccacctagctctccaggaaggtagattccttcttctcagagctacccaggatactgacctcttcacagatatctcacttcagggccattgagtgattccttgttctgtcagaaactactattttacctaagaaaggggcatgctttgtctaggtccctatgtctgtaactctgaagctttgggatccttcccaaaatacccccatttgcccttctcattttccaaaaaaataaaattcctgaaaagaataactgcaatgggaaatattgaaggtatttctaaccaaatctctttaccgtaccaataatcagagaattatctatctctgattttatgactagaccctcttcaaccccacatccacaattactccagtggtggctgacttcaccaaaatatcttccttcagtctgatcttcttctaatgtgtttcctcttttataaatcaactttagtcagcttgatttatagtacaaccatctttctctgttcaattcagtaggcaaatatttatttgagcatccacgggtactgagctaaattctgggatgaaaaggtaaagcaaatgaaatgcctatatttcaggcaagacacaagtaaacaagatgtttttaagacatgtagtaaatgcaaagtttaaagtattcagagaggctagtggtgataataaacaggatacttagcttagcttgggacaatttaggaggatttcctgaatgcgccagaactgagacttaagtcttgaaggaggagcaaagaggtaactagtaaagatgtttggtggagtgaggggtagaaggagaaggagtcttgctctgttgctagactggagtgcagtggcgcgatctcggctcactgaaactctgcctcccaggttcaagccattctcctgcctcggcctctgagtagctagggctacaggcgtgcaccaccaggcccagccaatttttgtatttttagtagagacagggtgccaccacattggccaggatggtctcgatctcttgaccttgtgatccgccagcctcagcctcccaaagtgttgggattacagcgtgagccactgcgctcggccggggctttgactttatgctgtggatgttctttgaaggatcgagtgacatttttagatgaatactggaaaacaacaggccttgcataggtcatctcaggtccttcattctgccaactccatgaagtctggaagttctaagtagactgaagatgtgatctggtaaacttaaccaaagcaggaagaagcactagttcagttcttacttaatgtcagacctttgtctccatcttttccccacagagctagaccaggttttatgatctgagattatacagtaagagttttaaaagatagagctccgtgctctgagattaaccttcaagtcatccctgggttactatagctttggtacagagcttcagctctaaaaactgggaccctctcttttactccttaactaggttacccatcttggtaatgtgctcaggtctaagtccctaattcctgaggactcaagttcaagtcagctcttgtcccaaggactctgttcctttcctgaactcctggggcttgtaactgagtcttcaccatcagctgataacctccgtgtcacccctgcctgcctccctatgggactacctagggggtgctggcctgttatttctccttattctgctttgtccttctcttgataagaccttgttggatatctctgcctccacctctcactctcactgctcagaaaacctcaagagatcttgtcctgcgtgccacaccagaaaccactagacacctgcaaaagggctttttgcacactgtcttcaccactcaggagccagagctggatctatacccagttcctcccaattggccaccatcagcttcattgttagcccaaggtaaattttgtatctattgggggaaaaaagttctgccttcctcaaaggatcttaaataataaatctacaaggactataatgagtagagaacctcttgagggtgttcaaagaatatctacatccatcctaatcagggtccctctgagagggacagtggtaggaaacttaaccaggcagaagttcataaataacaataagaaggcagcaggtttagaaactcggctgtagtaaatgggagaaagggtcaaattcagatgagaagactgagtaacaggcagaggtaccagaaaaaaagaggaaaagaattttcttaaaagggggccggggttgtgaggaacaagtgatccttatagaggttctaccaaatgcaaaaacagctttgggaatgatcgttgacaaagcaaacaaaaacgtaaagtggggaaaggacacccttttcagcaaatggtcctgggataactggctagaatgaaactggatcttcatctctcaacttatacaaaaatcaactcaagatggattaaggacttaaacttaagacctgaagctacaaaaattctagaaggtgacattggaaaaacctttccagacattggcttaggcaaggattttatgacccaaaacccaaaagcaattgcaataaaaacaaagataaatagctgggacctaattaagccaaagagctttgcacagcaaaaggaacagtcagcagagcaaacagacaacccacagactgggagaaaatcttcacaatctatacatctgacaaaggactgatatctagaatctacagtgacctcaaacaaatcagtaagaaaaaatcccatcaaaaagtgggctaaggatgtgaatagacaattctcaaaagaagatatacaaatggccaacaaacatatgaaagaatgctcaacattactaatgaaaatcaaaactacaatgtgataccaccttactcctccaagaatggccatactcaaagaatcaaaacacaatagacgctggcatggatgcagcaatcagggaacacttctacactgctggtgggaatgtaaactagtacagccactatggaaaacagtgtggagattccttaaagaactaaaactagaactaccatttgatccagcaatcccattactggatatctgcccagaggaaaagaagtcattattcgaaaaagatacttgcacacgcatgtttcatgcatgtttatagcagcacaattcacaactgcaaaattgtgaagccaacccaaatgcccattaatcaacaagtagataaagaaagtgtggcatatatatatatgcatatatatatatgtgtatatatatgtgtgtgtatatatatatatgtgtatatatatatatacacacacacaatggaatactaagccataaaaaggaatgaattaacagcatttgcaatgacctggatgagactggagactattattctaaatgaagtaactcaggaatgtaaaaccaaacatcatatgttctcactgatatgtgggagctaagctatgaggacacaaaggcataagaatgatacaatagactttggggacttgggggaaggggggcgaggaataaaagacaacaaatatggtgcagtgtatactgctcgggtgatgggtgcagcaggatctcacaaatcaccactaaagaagttactcatgtaagcaaataccacctgtatcccaataacttatggaaaaaaaaataataaaaaccaataagctggaagctgcaagtggaggaaggaaaacccatgtggtacagacagatagtagacatgtgcaagatgggacatttccttgaaacaaatcctccttgaccagcactaactggatgatcctccacaggtaaatgcagatttgatttacagggagaagagagagggaaaaggggagaggaaggagagaggagaagggaggagagaaggcaagagggaagaattggagggaggaggaagggagagaagggaaggggagaggagagaaaaggagaggaaggaagaggagagaaagacaattttaaggatacatttatgtataataaaaatggcatttcatcagataaaatgaaaaccaaaaaggtaatctcagtggtactgtgaaatgaaaattaaaatacatgagttctaattctcaattgatcactcaagtttttggataacgaactaaatttttctcttctcagttaaaacactttaaaatgagatggtggactgcctaatctccaaggcctttcctattctacatatctatgaggttttcctacagtaattaacaaaatctgaagtaaagtgttttattttgtaaaggttaatcacacattaactggagattaagttttaattacaggtaactacaaaaaaaaaaaaaaaaagtctacttgccctgcactcctgataagaaactcaactatatcgtaagatacttgtgactttaaaggacttgaaatgacataataaaaacatcgtagtgcaaatggcctgtgtatagcatagaaataagaataaaaggcttgttttcttacatttttaaaattttctaaaagttatatcctgctgtaaatatatgactatagtcttaagagtttatagtttataccattatagagtttatacaatactttgatacatacaatatcatttgatcataaaaatagcttgtgtagtaggcaaaaatagttgtcagttatctttatttaataaattacagtatttcatgctattaagaggttgatcttctgactacttgttgaccattttgaacttattacatcctttatgaaaagtctttatctatgacataggcttttctataagtttcaactaaagagaaatcactatataaaattgagatgaattatacaattatttagcaaatcacatgttcatatatataagtgcacagaatttactgtgcttgaatatgttggcacagaagccagtttccttgtctaaatattgtctgttttctcccttagtgatagcattagaagcaacaacaaaaacaacttagaacagttctgtaccttgtctaacccaaatgagagacagcacagaataataagctttatgttatttccatagacgttatgtaaatctgatccatattaaataaagtcaccccattttccatggctcataaggatgaaattgtgtaacaaacaaatgggtttatggtggtctatttcctctctcccgtttgaatttgttcatctttggctactgatatatttctcaaacgatacaatgtgactccaatttttttactgatatctatttagtgctgccctgaaagtgatctgtaaaggagactccttatccagttaggcattggtttttacctctatgtacatagcagaatcattaaaaaacaaaagaacgacaacctgtgcccagtcccttccccaaacaaactacatcagaatttctgagaagagaggatatgtggcagcagtattttttagaagttccccagctgatggtactgtgctcccgtggctgtgaagtatcgaatgcagtgcttctccaacctcaatatgctagcgaatcgcttggaagtcttattaaaatgtggactttgatttagtccctccagcataggtcctgagattttgttgttttttttttttaatgcaactatgtgatacttaagatgcccacctgtggatcacacttgtagtatcctgtagtatcagcatcacctgagaacttgtgagaaatgcaaattctcagacttaccagggacctactgactcaaaaactctagcgatggaggtcaagcaatctgctatagcaagccctccacatacacactgaaatttgagacacactggcctaaaaaaaaagaaaaaagaaaaaagaattctctgaagtctaaataactggctgtatgtggttgaaaagccgttgattgtttacatttgtgtagcactttataattcaacaaacttctaccttacctcctgtgaacgtcttaaaacaaccctgtagggtaactaaaatagatagtttcagcatttttatttatttatttatttttgagacggagtctcgctctgtcgccaggctggagcgcagtggcgcgatcttggctcactgcaacctccgcctcacgggttcaagcgattctcctttctcagtctcctaagcagctgggactacaggtgggcgccaccacgcccagctagtttttgtatttttagtaaagatggggtttcaccatgttggccaggatgatctcaatctcttgaccttgtgatccccccgcctcagcctcccaaagtgctgggattacaggcgtgagccaccgcacccagctgacagtttcagcattttgtaaaggaaaatgaagctcaaagtattcaagagacttgcttaaagttacagcatgcaaggatagatccaaattcagagcccagatcttctgagtcgtacaaactaagaggtaggacattgagagaaaaacagggccagtggctataagctgtaaattatgccctggaggagggatatctctgaggctcagatgatgacagggagagggacaaggatattgaggcaacctcctatcaggggagtcacagccctttgtatttggcactctcagagaccagggtaaaatgcactaatcctttttgggcagagtttgctgttatgtggaatcagctttgagaaacacaaaggtttaaccctcaccagtgactcagtggatgagtcagtcacctttggttctttccacaattctacaaatacgtcattctaagtcaaaccacataaaataaaaatctcctgtgtattgtatgtgtgtataaacccacttatatgtcccatacttacagaaacacaggtggccacaatttgcttttcttgcgagatttgcccactctgtttctcaggccataaatgacaacaaatgataaagctcacaggtacataaatattctttaacaaaatgtatataatatgccatattcctagatgatatatagtatgctatactccatcatttactaagtatatttgataaaggatttatctgcaatgcacgatccttacagtatcagggctaaccaacaaattttgataacatttagtgatttaactacagaaaaagaaaatttcatgatggtcacaaacttacccagtaggcccatgcccacagtttgtttcaaatagtgaattgtaagtcatagaaaatcacatatcgtatcaagaatttgagggttgacacttcattagtgaatattgccattccacatgatttacagaagataaacagaaatttgaacaagatctttatatttcactatcaaataatcaaatctccttttgttgtttcttcttttccccccttggtgtagaaacaaacagggaattaaagaccccaactttgaaaaaactaaacattagctattcttcatttagatacttagtttccttgggaatctgtaatacttgttaggtacgctaacatttaactgggaacaatgttattatcattaaaagtattataatatcctgtaaacatcagatagggtcagaattgtgagctaaataaaattttattaccttgaatttagaatatttaaaatcacaagtgtgaagtccctgtattttatcacatgcctacttgttttatatccagatacgcatgtgtatgtacgttttacaaagttgccttatgaatagatatgtgataatataatgtattataaaactaacatggttctttgtggccaaatattttattattatcttttcagaaatctgccactcatgttgaaaatatggtcagtaggactattaaaaatgaaattttaaaggttggtttgaaataccctctatttctgctattctttgacttgtaagagaactattaatacatagtctcaaccttccaatattaagcaggaggtgaatctctatgggtatgagggtaggagggaagaaacagtgttagaaacttatcctgtaattgaactcttactcctgtgggagctggtaatgaggcaggtagactctgtttagaaaagcacctgaggcagcttcatgactgaagtcctgcggataagcgtgtctcactctttcctgtacacacaaatataaatgcagattctggttgttctatttagggaggaccgccaaggctgctgctgctgccgccactactctgtgaatcacactttgattctttgtccctgggacagaagttggtattgtggttatctttagttctttatataatttctcacacaggtctgtaatctcctctagaaaataattgagttaggtatgtatacatgaagctacctctctttccctccaattttgtcaccataattatatagtttttattattttcaaaatgatagaaattgagggcaagacctgaagcctagtgtgcactctcctatctgatgcataattacactaaagatcataattatacaaaaatgagcatcaatccccaaaagaaactcttgtttcacagaaaactttaagtcagtgaaggtaaatgttttggggacagacagccaaactcctgtcactggattaccagaattacaaacctcccttgtctcctgttgccatctcatatcattcggggccacaaactcactaagagaattatttttttctcctagccatttcactttctcggtgccagacatctactgtggcttccaatgaatcaagttctccttcctttccttccctgaaagctcatgcacccagtaaaatgtcacaaataaagtgaaaacacacctttcccaggctggccttataagcagaaagcaagagcaccattcttcaccaggaaactgacccagaaagcttaccggttttaaagagattgagaagaaggtcagctaagaagacaaagggaattctctccatagttaattctgatgaagctccaccaaccccaaaataaacccttgtccaaggcaaggaaataaaaaagagggcatgtaaggtgaggtctggaaaagaaatggtgtttcataggcgacttatttgcatgctctgtttgtctgtcttttctttcccagagaataagtggttctgtgtttattttttctctcagagtccctatttccacactgtaatgtctgctaaagcgtaatgtttaaaactctgtttctattgcgccatagacatacaaaagcacatatgtatcatccatagatatgtatacagtgagactgcctctgtatgaaagcataagaatgtttttattcttctgaattaacatttctatacttatctaactcttagacaactgtagtttaaggtataggagatgctaacttagaaagaccttacaaagctcaaggacactgaaataaaaaacatatacattcaagttattcatttttctcatattcaatcttgtaaccagtgaacaaaatttctagggatagcatatatttatatagagtgcttcaccattaaagggttaatgatgttagggagtatgaatgttagcaattgaaatggcatgcttgtgtgtttgcaaaaacattttctgcaccatgtccaaattcctttgcaaacagataaattactctgtaaatctgattactccatgtggataaatcacacatgcaggtttataaggctgaagagctagaagggaaaatctgctttggatagtaggatctttgggattcgtaatcacccaaagctcaggaaatgaagaaaggagtgcttacacattagcattttcttactttttacaatctggagaaacacatacccacacaacacacacacatgcaatgcacggcacacaacacacactttcgtctctaacaaggctagagctcccaaagcaggacactgtgacagccaaccaaatttatttctgagaaaaggaaagaaaactttgctgctgtcggcagctctgctagagaactgctccctgatgccccagggtttatgcactatcagctccttgcacacagattagaggtttattttctattgtatactgtgtttttattgccacaacaagcaatattacctagatagacagactgacactgggtcattttatttggaggaaatgagatttttaaaagatctccaaggagagtgattctttctttttgttagcatctgccagaaattcaaggaaagctagaaaaaagaacaaggggtaggtacagttggtggagaggaggaagagaaaagagaagcacaaaaaataaccttggagcattttagaaataaaaatatgactaggtctcatttgagtctctctagctcacagtacctgataggggtcaaactcccaaggacttgggactcttctttccaaatttcaatctcaaattattttagagtttgccagagctgcacagaaaaaaagactttgaagtcaataatcaatttgaaatatccattttatgccaggttaattctctcccaacctctgtgtttaacactcctactcttaaatatcagcaatttggcaaattccttttctttctgctcttcatatcttgtgttgatttatatccacattccaggaaaggctcagtaaccaaccaaagttctaagattgatttattgccctccatgtcaattagaagatccttacagaaagtcttctatcagaaaccctcacacacaaccttgatatgtgtgtgtgtgtgtgtatgtgtgtgtgtgtgttggcatgaaaaacacacacacacacacacagacacgggaggagcaaggagaatgcagtactgtgtactactctctgagagccataatccaacaacctttctttcagaattaaggacccccaacaaaactctcaagtgcaatgccacagcaattacaatagtgagaatactgcccagaagtcactaatgccatgggtgaagttaggcttccttgataagagaaacaaggtcctaagaaccgaacaacatttaaccaacaccactgctgcttgacagggaccagaattcccttgaattttgttagctataatgccaaccagtcagtaaaacagggacacacacacacacaccacacacacacacaccacaagcctgcagcatcaggagctggagttcaaggagatcagacacacacacacacacacacacaaacacacacacacacacacacacacgtgtagacgcgcgcagcagaaaagttgcccgaaagccctacctgaggatggctgtgtccccctgcctcacggtgatgttgtccgtgcctcggttaaaatccacgctgcgaacaggcagtcctgtgggaagaaggcagagcaatctcagtaggaccagtggcaactgtttccgatccggctgaactctcctgaccatggtggccacgccgaggtgcgggtccgcggggtgctctggaggggtgcgcgctgctcgcgaggagaggcttcaccaacacggggctttcatccacagcgagcgcagagcgggctttgccagtttatggtcctttccactttgcctctctctttccctcgctcagtctcttttccctctaagacttaacaaagccctcataaaacccaagcagaagggtgaaaagtaaaagcaacacaatttcaaaagagagagtgcaaatagcaagccctctggaagagctgaagaggaagccaaaggaaagggttcttgtttggtctctctgtgactggatgctcctctgccagtgtctgagctgagctccttcgctctgtaacccactttcccaggctggcgggcgggcgggcgagggagccggcaccaagcctgccagtgagtgtacagaaacagccacacagcagcagcagcagcagaagcagcagcaacccagagcctctctccccctcctcc

SEQ ID NO: 1134 - DNA, 187268 bp, Homo sapiens
gcacataatgccaaacatgatattatttccttatagtgttgttttaagttacttataaaggaggggaacttggtcttttactagcaaaaactgcttaacatttactattttttaaaatgttattttaaaaaattacaattgtataagctgatgtacaataacattgtaaaggttttagttttaaatggtagtttttgcttttaatttgaaagtggttgaagggtagaaaatagcatcttgttaaagaactggcttttctattgtacatctgagttcattgttttcttaatctttaaagttttctctgtgaataatttggtggactgagtttgtgcatctgaccaataattaaaatacctaaaaagcattccaaagcttttccaaataaatttatggtaaaaatagttaaaaaaatagcaaaactgaaaaagagtcagagtctggttctgtttaccaagaactctatcatacatttgcacccaattacactgcaaaaaacaagttactaatgctctgtttttgttgaagtaatcccatggggtcattgaaaaattttatgtaaaaatttcatttaaaattattcacatcttgcgaatggcttagattttgaaatcattaattcagaaatagaaaaagagtcctcactttatagaaatgacttacttatatcatttaaaattaaaactttccctacttatatttggagataggagttgagacccataaaacattgatgggaaaatggtttttattaaaaaatcttccatgaatccattttgttttcattgtattcatttttatcaaaatgtaaatactttaatcccattgaattttaaagtcacattctaaactaaaatataaaagtcttactgaattttgtcctgttatatcaaattattaaacacaatcacatacagttaagtagctattaaaagtctaacaaaaacaagggtgctggcttgaattgttcaatgtttggcaataactaaaaatacatagctataatacttatttaaaaacaaagttgtttcccgtatttccaccttcgttcctagagatacaaagtttaagaaaagtagattgtgactgtaacacgatctcttgttatttgttttaaatttgcacagaggaaaacttaatattctaaacaattaaatttagtattccaaatcattaaagtcttttaatgctcttatttaaaaattttcaaaattacatatgttgtttaaatagtatttatatgtacaatcctccattaatatgagtgaatttcccactgtaactaattattttcccattttgtaactatactataagaaaatagttttaaatctcaaactattggtttactgtgcaaaatttgcttttgtatgatttaatagcattgaattacaaatcaaggaatttcaaagtagttttcatgtctactattatgagatattatataacatataaacacattggcagtaaagcttccacttacatggtttactgtgaaaaaacaaatcacctggaattaatatgaaatagaatcccctaataaatattttatattcattaaaagaatctcatctttctcatgactttgcatagctaaccaaaatacaaagcttttccatatgccattttaatacaatggtcatcatttgtataccacacgcacacatatacacatacacacctatggcagagacactttcttctgaattgaccatttgcatttgcatgcccccagagacttaatcttgctgctgatgaatatcctcatgcctaagaattttatagataacccagtagaaaatattaaaaatcaaaaaagctaatgggaagcaggctcgggagatggtatcaatcttcttggcccggtcgataaagaccttcctcatttcatcaggactttttggcattacctggacagggtggttggggccctttggagtcatgccatcctttgcttgtagacatggtcccattccataggctgtgaagctgaatcggctttcccttacctcatcatcctgtcaaagaaaaatgtgacaaggccctttaataatacaatagagcatgtataacaggcatctcagaatcataaccaattttatcatggttaatatttacattaatataaggaaaagataaccgaagcatataaagatgaattggtttttattccctattgaagttttattaatttatcttgctgcattgtatagctgtgcccattaataaatgtgaaatcccaaagggtatgttttaatgggaaaactaaattctgatattttctacatattgcttgaatatctaaattaaaaaaaaaacaagataaaatctattgtgttatatatgttcataaactagatttttttttttgcatttttttttaaatggataaatgtgtgatgtcgaaggggaacataccaggatcattgactgaatttttctttctcatggagacaaaccttttaaagtttttctttcaattcgaagtcaattcctcagaaaatacagtctagttcaataatactgtttggtttatgttattctccctttatgctacttttctgttttacactaacctttttggaatacttagaagatggccatgtattctagtttatatatgactatgttccaggcacattggtttggttgaaattgtgaattatatctggcagaagtttatttcatgttaagaacataaacttttcataaatttattactatgttcttctaaaaagtatcatttcttttaaatgtggcaaactgaagagaattttccatgtttgtaaatgaagggaataaagaaaaatttaaataaaaaattatttaataatatatgatgaaatatacttgagagaaatataatatttaataacaatgcaaattattaataatttactttaacacatttatttagagtgtaatggtagctggctaccaatgagtaatggtttatttggctactaaattgaaggtctaaaagatgagaagacatttaataaagttgttatatctctcctatgataatgctttttcataataatataaaagatcaaataattggcttgaactcttgaaaattatgggctgggcatagtggctcatgcctgtaaccccagcactttgggaggctgaggcaggtggatcacaaggtcaggagatcgagaccatcttggacagtatgctgaaacaccatctctactaaaaatacaaaaattagctgggtgtggtggcacacgcctgtagtcccagctactcgggaggctgaggcaggagaatcgcttgatccctggaggtggagattgtagtgagctgagatcgcaccactgcactccagccctccagcctgagcgacagagtgagactccgtctccaaaaaaaaaaaaaaaaaagaaaatgatgttggttctgtgaaagtagctcctcaatgaataatatattataaaatatgaaagtgaaaaaatagaaattattatggattctaaaaatgagaagatgaccaaaattgatgcagtaaggtataaaatagttattttgggaattatgaaagtaacgtgattccacctgcaaaacaaaagtatatgattattggaaaatatttcaactgtaagatgtataagccattgaattttgaggacacaagtttgaaagaaaaactgacagtccaaactacctgagactactgttgtaagctcgcaaaaattgaaaatcgattttccactactctttaacaagcatgttcatttagactaccatttctttggcgtccatgaaatttttaaggcaaatttattatttgccttaaagttttccatatcctacaaattagaattaaattgttcttatgtaaatgctaaaatagcatccttataacttagaaaatcatgctggtgtttgcatttctaaaggaaaatgtaggttacccaggtaatttgcactattttgtgtaaaaatcacctgaatgttgaagtataaaataggcttttaaactatagcaacctatgtgttaaaagacatctatctcaaagtaagacaaaatatgacttctcagtgagcatttccaatgaggtgttgacatgttaattgaagcagttgagaaattcattatcaaaatgctcagatatcaggattctagctgatgtgcttagtaaagcagaattcattgactacctttctaatgatctgttctgaataacttattttaaaatctttagagaccttagctgctcatctcaaaacaaacataatctatttaaaattaacatattagtgagcaaccgaatttttctcaattgtatctttccatatagctgagggtgagtaaagagttaatacccagcctgggctgttacagtagtgctgagaatgacccctgattcctaaagcatcatttccttgaaaacaatggagataagctacagggggaattggagtcggccttttttactgtgaggggctgcacctgcactgggggagctgtgtattggcctgaagacctttggcccatgtgactagatggtatgcaagtgtggtttggaacaaaggctgtgattccctgtgtgaaggcaatcataaacaccctgacttttgtccatggcagctgtacctatgtgtcctgtgtgatgaggggcaaaggaagctcttgagaacctgctgagtctcctgtgtgaggcagatgctggaggtctgatgggtttcctgcctcacatcctcctagggggctgagtgaacataaggttagattaaagcctatgggtgttctgagagtctgtatgacaattggaacctcaaatctcagcagtggtggacagaagctgaccaggctttcagatcctttgagactcaatatggccaaatgttccaggagggagttctgaggagaatctgatgctgatccaatccggttttgaggtagccaaagtgctacagaaaataacatgctgaatcttattattggaacatggatcgcacaggtttatcccctgttgaattggcagatggatgatctgtgagataaaattgagaggaaagtggctcaagagacagttaattccttgtttcctattaataatttcgggggctgggggcggaggctcacgcccataatcgcagaactttgggaggccaaggcaggtggattgcttgagcgcaggagttggggaccagcctggccaacatggtgaaaccccatctctaccaaaattatgaaaaattagccaggtgtggtggtgggcgcctgtgggcccagctactctggaggctgaggtgggaggattgcttgaaccgggaagcagaggctgcagtaagctaagatcgcgccactgcactccaacctgggtgacagagtgagagatcccatctcaagaaaaaaaaaaaaaactcatggaaaaaactactcaagggaaagagacacagccagtaaagcaagcagcttcatgacctgagctcaagatgaaaacaaaagcccagttggtacttggaaggacactgcccttaattttaatcttcccttctgcaactccaggcaagtgacactgcaaactagtgactatagtgcagccctgttccataaaaacataatgtgagccacaaataaaagccatgtgtgtgattttaatttttacattaactacatttaacaagttaaaggcaacaggtcaaaataacttcagtttgaaaaaaaaaataactcagtatgttcccaatatcttttcaacacttattgaaggaaaaattgagatagttttcattctttatttcatacaaagtccttgaaacctggcatgtgttttacattcacagcacatctcaattcagactctaaatttctagtgctcaataaccacatgaggctagtagctaccaaattggacaaagcataaagaagctgggtcactttgctaagaagtggtagcagttctctagggaatccatgctttcctacatctttaatttaattgactaaggagctgataacatatttttggatgcagtagtgtgaaaagtaatgtttggtgtgaatgctaacccccaatctgctgcagtgttaccattcaggaattactggcaggtgtaatgtcaatgactcttttggagtaggtgaagcctggggtggtataaatctatgttgaggactgagtgtggcagcttacgcctctaatcctagcactttgagaggccaaggcaggcagatcacctgaggtcaggaattcgagaccagcctggccaagatggcgaaaccctgtctctactaaaaatacaaaaaaaattagccaggcgtggtggtacatgcctataatcccagctactcgagaggctgaagcaggagaatcacttgaacccaggacgtagaggttgcagtgagccaagatcatgccattgcactccagcctggatgacaagagtgaaaactccatctcagaatcaatcaatcaatcaatcaatctctgctgagaaggactgactgatgctctcactgctgtgaaatgtaacacctctacagaagagtagatatgttaagtatagcagcaaatctggggtggccatatgacaatgagaaagaagcctacccaaaccatatcccccaaccaaaacttgggtaagcactgggttaggagagtccttaggcatgtggccctcattctgggaaggcaggagggtgttttgattcatgggtatattaactcttggagctactacactgggttttactgatgagaagaaaatctaggctgttcagaagaaagatcatggccagaggtacatctataagctctctttaggtggctgttaagacacaaaaagaacacagcaaaaattgacaggatttctgtgaactatttcccagcagattattgcctgctgggaggacggaaatctgttccaattttggcagcggactccactaaggaaccctgttcgatctgttcttttcagctcagaagttaaatcccacggtgccaatggggaatggaaacaaaaggcactgacataggttgctaaatttactccatcagttaaggcagctgaaagaaacagactgactcgaaggccaggatttccatgcccaattcttaatggggctctatggctgtgctatggttaaagatgaattgtcatgggggtagtgaacacagcttcttgcaattacctgatgccaaagcaaaatatgtggtaatatgctggggaacaggaaagcaatataaagagtcaaacagaagctgcttgagcagggaaggaggcaaaggatcagctatagtagcaggtatcatggtcacactaaaaactgtaggtaggaaaaaagagagtaagatatactcagtaggtggcactgcctttaaccaaatgtatgattggaaaggatgtgatacataaatgaaggatcttggcatctctggcttgagcctagtcctgggcaagtcattccttagcccagttttaattggatgtaataaaatgggagcccttagaattgcctaactcgtcctttttaggaagattacaggaactctcagctctgattaagggaatggcgcaggggtggtagttttcattaattctctctagaatagcctgtctggcctacgataaagctagatggatcctacaggctgactgctgactatttgggttcagtaaagaagtttcccaacagcctccaccatgctggctggatgtggtgaaaactattcaagagttttggacgcaaaactctatccaagagttcaggacagagatggctggttggatttgatagacttgactgatgctttgtttttagtctcattggtaaaaaaaaaagtcaaacacagcatgtcttcatgtgaggtggacacaattataatcttactgtccatccctaaaggagcctaaattctccagtatgttgtcacaaccggataagaaacaatttggtccagatcattgtcaaaagtaagttttttaataagtgatactttccctgaccaagcagaaagtcagggaagagtttggaaactagtggcacctgtgactaggtacgggtggctaattaatccagataaggtgcaaggtccagccccatgagtccacttacaaggcataaccttgtctgaggacattagctacaagtcacaaacattaagggacaaactgctatttcttctgctttctattattaaaaaaaagagaaaaaacttgtggcactgttaaaatttggcaggtacattttggatttctgttggccccactgtataaagtaaccagactgaatttcaaagggaaactaaagcagactgtgagagatctaaagcacgcagtagccaagctggtccctctgaggtcttaacattcactgattgtgcaagtatctgctgctaaaacacacatagactggagtttctggaaaaagctcaatagtggcactctaaggtggctgctaggattctagactagaaaatcctctgacactgtcagcaggtataagctacatgaatgacagctactgacattctcttgagttctgattagaaacagccgcccagaccaaaggaatctgaaaggcatcagtccatatctaggcctgaaatacctaccccatcatgggtgatgtcaaaaaggcattccagtctaagtgccctggcaaaattaaaatagtgtattcaagaccaactcaagggaagtgactctgctgaagtgtatcatgtccatgtaaaaaaattctgtgtgacaatgggccaatgatggaccctgcagctgagtacccagaatggtctgaacctcatgactctctttcaacagaggcaaaacagaccatctagtttaccagtggaaagtcccatatgtggtgagagcttgtcctgagtatcaacaagagaaaacttgtatgaaaattgcttttggcttgaatcttccatggacaagtgctaacacatagctgtagatgaaatacctagggttcttgcccttggcttctggaggattcagtggcttttgcctgaaattgacagatattccatcttgggttttgtttacgttgtaacaaaagccatagctgaatatactattaagggcttggaacaaggcatctttatattagcttgggcttctcagatagatctcactgaacaaaggaacacattttagcccaaaatgcacaacatggcccaagggcacagcataggaagagtacctcatatcccatctgcccagagagcaaaggcttaaacggatattggaatggccaattaaaacatttaattattaaagatgagatgacaaggacatggaaagtctgcatagccttaatttagctacttaactttatgattattggtttcttattccaggaaaatatttattatactacctatcagttcttttagggtgagagaaaatatataaaccaccggacaaagcactcaaattgctgctattatattattcatattttgagtgtaatattacattattctagaaattgcacaaagcacaataggaaagaatacaaataacaacttgaatcattttactattagatgttttaaactcagagtaaccaaactagcactaaaatactatgtaaaataggcctacccagtcacctgttctccaggtggccttgcatttgagcactattacactaaaaggttaaccaacagcataaaagtaaaaacatcattcacccctcaagtcctcactgtcttattattacaatacatgggttttgccatgtgactgctagaattccttgcaaatctaatttatggaaccaaagagtctttgtgttttaaatgtgttccatgaaagagtgcagatcattttgaatgtgcccatgagatgaggcatgtggagtcatatcagacccctttcagaaacaggatctcaactctgtgggaaggaaaggaacagactcctgtacagggtcctgtctgctctcgcagtaagacaggggatgagagagaccatgagcccctggaccttaaaaacatcaagttttttttttaatgacctaaacaataattttaagcatggatgaagcttttctatcagcttattattattattagattactaaattagaagaagcactgaaatattttattactaatttttctgctttgcattacccagtcataaattatcctgtgtttatgtatgcttacgtgtgcagtgatattccttattataattagcactcaaattttttttgagataatttaattttctggaaatagcttcagcttacattctcatggattacatgtcaaaaaagcaaggaataaaaaataagtctagaacttttgactcagagacattatgtgttagccaatatttagtggttataaaattaaggcccttgacaacataaaatatagaaagtgggcaaaatcgctgattaaaaagttaaagaagtagtttagtttacccacaagtaaaccttcttactatgtttcaagcaagttagaatggtaggcaacgaagaatggagataaccatttagctactgcacaattctttttacaggagtatcttttttctgtaaatttaaaactgacaaaaaaaaatttcagtcattatgcttctatatcatactgtgagactttgtatgtctcttttcattttatttcaattattatgccaagcactgattcatataaaatgcaagttatagctagaaatattagagacagacagaaaatagaagggtgcatacagtcattgaataaaattgcttcatctctgtcaccaaacatgatactgtatattaacacatgtgtgaggcaaggactaattttgtatcttcttcttagtcctcaaaattgaccagaaaaaagaaaacttatgtggatgtgagagtgatgaaggcatgaatattgctattgagtgtgaacaaaacattaagcatctagaacagcatgaagtattgattatgtgaattgctgtaagatataacagcattaaacacattatttgcatcttaaagtttctcccttagtaggtacctttggggcaatgcttatacaattaaagtattaaatagattattccaaatgtctttttgccaaatacttttttgtaactttattaccaaataggaatgtaaaaaacaaaggaaaattaaattgttattaatctctatttatatggtttcaaaatgtgtagattattttaaattgctaataaacagcaatgacttattttgttgggaaaaatcattgtcctttgagaatatgaagaacagatgaaaaatgtgaatgaattaaaattgtttttctaaaatatctgtctaaaataaaatattcagtttcatatatctacacacatttttatatcatttataaatggaaggtctaaaataatgcaattatagatgaggtttaaaaaatactttgctgttgtaagtcaatcgttaatataaaattatttgaaagttcactccaagagaaccctgcatttattatagatgacatctgaattagctattaattagccaagtatacacttggcatattaaacttagattcagaaatagtttggacattgataaatggtaaaatttaaatttaaaaagatgaatgttttagatgaaatattatagaggacggataagaaatcaatggaatgatttatttaaaaatctatatatctatatctagcataatatgttagattcacttactgccaacttataattacggagtgacatagggtattacaatagacatcatatgttaaaaagcagcatttctattttaattaacattgagatggaagtcactaaaatgcatgtaaatttgaacagagattatattattttattaagtattattttcctgaacagattttcagagaatatagctataagaaatagctgcgtttaacataaactaaatatctaaatatttgtttacagggaataactgaagtcttgcaatttttgtcttatttgagaggatgcgatttcaactcctgatagtagagtcattcaaacagaattttgtttgaatctaagttattgggaaataagttttcttcgggtatgcatgaaagacatttgtaggaaacactttatctatttaaagaacatcttagctctagaatagcataagctgacctggaatggaaagattattgaataattagtgtatatggatgccatatggctttcaaccgtgaatccttctcacgttcatcagaatagtatatacgtacgtttgtgtttatccttagactatagacttgacaaatgcacagggcagaaaatcaattatttattatccttagaagctatcatgaattatttttaaagtaagacagcatataaaaacataagcaaataaaataaagtttgtgtacagatggtcaaaatgcagtcaatgatatctttattttttcaaaagataaccattgtgcctagcaaaacataaacttggctaggatttcttaaatctagaactaatgatccattcctatttcatttgcatatataaataataattaataaataatcatcagtagggaaacaggcactagaatactgtgtgcctatgttttcttgcagcaaaccattgcactattacattgcattgtggaggaagctacatgaaatgcattaaagcaatctcatttcattcatatctctcaacaaataacatgttcggaaataccttggcatgtctttttaagcctccaggactaaagtaatgatatcatacatgggaatagcgactctaaccaaaatgcttccatatcatgcatacagacacacacaagcacacacacacagcactggagatagcatccatgacatggtgcagtgcgtaatcagcacacagcaggctgggacagtgtggggtggggaaatttggatacaagagcaaacttgtgttctttcacaatagatgcaggattctctggtaccttcacagagggaaaagtaagtttaaaaaagcggtatacaataactaagccaatgctgagcctagttaaaactttcctaggaataataattgcattaatgtaaggtcccctgttgtgacaaactttctacagtgagactattttatttactttgcctgttctgccaaattagagtactgaagaaaattcatgtaaaccagtactcatgacaataaagggcatagtaccaacattgagactcattttgattctatttatttcaaaatttagattactcagactgtttctaagcaaaatacatagttttaaatgacaaatttgatcagcccagagcattgttagtttagggaaatagttttcaacaagtcaaagaaaacaaccacccccaaatttgcccaatgcttgaaatattttaaaaacaaatgggatgtataaactttcttatgaatatatctgtgttatattattgtttcttctataaaaataagaatgtattgacttcccataagataagcctgttttttcattagagttttcataaagtaatatttaattaaataggtacctttcactctatagtttctataaacattaactgtttagctactggagatataattatgttggtctcccagagaaagattagagagtctgctgtatagtctaatacctacttgtatctataaatatatattgcaaacactatatctaattatgtaatttccatgcaatgaaaaatttacagttaagataatcaaataaaagcaagtggatcatgtgaaattatctttcagggatgaaaaacaaagggagaaatggatgctgggaaataagatgtaaactttagttgcaaaggacaatcgctgagtgattatatattataagagaacgtagcaagtactttaaaataataccaggtctagacaatctgttatgaggttgagattactgcaagaattatttaacattaagtctcttgcagagatgcttacctgcagtgtacaatagaatcatctggagaactacttataaatatagtttaccccagaaattaagtttagtagacagaactatttgtgtgtgacttctcaggctaaattcttggcttcagtagatttctgtttaattattgcatactatattatgaacccccaagttaaaccacgtacagacccaaactatctattttagattgctttcctaatatttagtcattatacttggacatgtgtctttgtgacctctttttatttgataatttcaaaggatgctgctatcaaaactaaattgttcacttgctataagtaacctcaacatattttaacatttagaatggattctaaagatacacagaaggcacgaagcattttgttgccttattttgaggtctcttgtgcagttgcttttagaatttgtttgtataaataaattttccatttattttcaactaattttatgcaagcatctgagtgtttcttctctggtgattattacaagatatatgtgatatttctctttaacatatatttttaaatcattttgaccaatcaaatagctctgttaataaaatgaagggtaatatttaaatatccttttattgatgagagaagacaagaataaagtttttagaaaaagaaaatacccttcttagctgaagggggatgatatttgctcagctttcaatacaaaaggggctgtgtttccccaccaaacactgccttggtagtgcagaatatgctgtctgctttttactgatgaccacattcctctatttagagttaagaaagtcaatttaccatatctgagaaacggtaaaacttctccagtgcaaaagcttctgtctgtgggaaggtaaagtggaccaagaggaattgagaaaccagagaatcaattcatatatgattaaatataattacacaattggttgtaattgtatataccatttgaacagacatatgtagcaattaatagattttcacatatgcaaagtatctaccccaacatacaaaactgaacttaaaaaaccttttttcttcattaaatcataattatgtttaattacatttgctccctgaatatatcaagtagttatcagaaaataataagatatgattgtttttgcatttctgcattttcccagggtaccaatcactggagaaaatgaatgtttccctctttctatgagctaaagaggaaggagcatcaaatattttaatttcacttttacatgtggtaaaactgaataaagaggcactttggtaaaaataattttttaaaagaaggaaccagaattgagcatctaaacttgttgtctaatactttttctactggatattatgattactggatgtgtggtggatgtaggatatgtctgagctttcacagtttacccatttggacaccggatgcacaatacttctcttttctagaatttacaggacatgcttgatacattctaaattgtataaggagaaggaaaaaggtaaagaaatggaaaaccaaaatgacaaaaagcaaatcataatgatagggaacatgcgtattgctttacttctaattaatgatactagaagggaaagtggtctttatcagttactagtaacgaagaaagaccagagtgtcatccctgtgatacagcatttgtactgtcgttgttcaaccggtgccagttatcatgaaagaaaagatgagaaagtaggcggtggagagggagagagaagaggaagaaaaagagataaaggcagaatgaggagaaatgagaaatgtaacagaccagtagaccagggtgaggtgagggaagaagataaagttaatctccccatcacaatatgtttcagtgtacaaaagatatgcgtctgttttcataaaaatttaattaaatgcaagtcttagcctgttttttgttcatgtattactaaatctcccgatgctgaatgctgatgttctttccacgtagctgttaattgtgtgtttattggagcagtgatgcttttgggaaggccaattagaaatgataagtaaagttactgctttagaatatgtttaatactaagtagattcaagcactgagaggtcaaagcttagtgctttttaaagaagtttaatcaatacataaattgcagtataatttataaagaaaccttaaaaaattgaaacctttaaatacttaaaaatgcacactatgtgaactagactgttaccattaaggtttatcttttgacaaatatgccaggatattggatccttgccacaattacacaaaattttgacattattgtccattgctttaaaagaccatttgcttttaaaatgtctgttggcacattcacattagaagtaaatgcgtggatctgcggttgatagaggctctctcttatagaaaaagaaaggggattggtcaaaaccacatgcatgtcaaggaagatgccattacagttctgcatagaggaagaacttcatttagggcatccaaatccaattaggggtttacttctgcaacttcctacggtgtcttcatgatgttctaagtttcctcctggtttcatcacttatcagatagtagccaggcaacaaaagcactttattgtgtttcccacagggtttcaaaagaaatgtctttagctcatgacaatatgcatcaagaagagaccacagagatttgcatgtatttatcatcatggtattagtaaataagtaatatttgatggaaataatgaaatgaattagctctgacaaaggaacatgaataattacatttgatgacttatatcaagtgaaactattagaaatgctctaacattgcaagtaagaaatgacataattcattaattaaaatttaaaaagtgttgttccaggaagcgcattaaaaagaacttgatataggtcccatgtcatcggatatgctgtttaaagtagagctaggtgtcatcattttctccctaaagctatttttgacacttttagtttggattggaaaaaaatgaaaggaatattatatcatttcatccccagtcccaattgcttctcttttcatctctattaaatacaacaaattcactttcgagtgaaaactggattctgccaaacccaatacgtttaatcacttaccttattctttctctttcgtcgaaatctcagaagttctttgtgttgtcttgatacaaaatttacagctgcatactccagaagtgctgaaaacacaaaaaggaggcatactgccatccaaatatcaatagctttgacatatgaaacctagccaagagagaaagagaaagcaagcaaattcacttatattgttacttcctttgagaacaaaactgagtttttctgattctgaattatgtcatttatacataagttttaaaaaataaagaaaatgacaattttttcttgaagtttccttagttatttttgtaaattttatgtattatgagcattttgttaatttttttcaaatttaggcaatagcccaaacacgatgaaagaaaacataagatgaaatataattttaccttcagaacagtatactgcttgaaaagtatgaacattgaaatatagataatgctgttggctttttagttccatattttcatcaatttttttaaaaaaattaaaattgtatttattaattctgttaagatatttttctttcattgcatttataaataatatatggttatttgctatctattttgaaatattttttgacttttataaagacatgttataagaatagtgcaaagaggtcaggctcagtggctcacgcctgtaatcctagaactttggtatgccaaggcgggtggatcacctgaggtcaagagttcgagaccagcctagccaacattgtgaaactccatctgttttaaaaatacaaaaattagccgggtgtggtggcgggcgcctataatcccagctacttgggaggctgaggcaggagaatcgcttgaacccagggggcagaggttgcagtgagccgagatcacgccacttcactccagccagggcaaaagagtagaattctgtctcaaaaaaaaaaaaaatagtaataaggactatcagcttcttcagtcgttaatatttaactacatttattgttgtgtgtgtatgtgtgtgtatatatatatacacatatatatattccctcaaactatttgagtgtaatttgtagacacaacaccatacactcaacaaaatcaaaaatttgacatttataacattgataaaatcctaccacctaatccttaaatccctcccatttcaccaattgtctcaagaatgccctttttaatttaaaaaacagactttttttgttatttgttttccagcccaggatttaatccatgatcatgtgctgcattttgttgccatatctctttagttttcagtgtgggacattatctgtctctccttgcttttttgtggcattgttacttttgatgagtacaggccagttattttctaaagtttgcctgatatttcctcatttacattcagatgatggatttttagtaggaattcccaaccagtgattccctgttctccacagtgcatcatatcaggaggcacacaatgttgatcaattgatgaaggtaatgtctgctaggttgctctattataaaattgctaatcttcccatgcatggaatattttgaagctatataagtattctgttactctttaaatcttcacacactagttttaacattcgttgatgatttttgcctgaagcaattattacaatgatggttactcagtggtgattttctaatttctttattcatctatatttatcaattagcattctactgtaagaaaaattcctgtcttctacatttatctgtttattcatttgtttatttatatgtgtataaacttatggataactgttttcttccaagtgatgtaatacattaacatcattatttattttgatgctcacattattctggattgggccattagaagcccctagatgttagcacatatatccgtttgacaagtcgccctcattatttgagcatttcctcactttctggcacaagatactccagattcatcttgtacttttcctgttcttgtttttgagtcagccctttctctcaggaactcttctgtagtgaagagtggtttttagaaaccaagatctgggcactgggtgtattcacatctccctaagtggtatcgtttctaggctctcatagtggacagagctagcaatcacacacacacacacatattcacacacacacataaaatgtagcacctgtgtaaatttctgtatcatctctatctatccatctatccatcaaacatgagcttacattacatctctatatctaactcaacaccacagggttccctttagcctataccctttctatatatgcaaaatttttctctaaaagtggaaaacttgactcccattatcctcaacatgtacttgatcattcaccgtgtatgtgactaacatctcaattctgccaaccatattttcagcctcagcaccttaatataatggtagaaccagatactgtgatcattcacctcatttttggttcttatgaaggtgctttttgtgtgcagattgttgttgcatttggccttcctgttgggaggattatggctggaggcttctatttggccaccattggccccatttggctccttgctcctggtcccatcccccaatggccccactggccttggtcctaactaactatttatcctgctccataggatctggcaatctggcagcatccttgactctggttccaccagacccagccagcctccttgattctgacacctgctcagctatggccctacaggtctcactgtgtcttgtcacctcaaaggtagaaaagggaagggaagaacaagaaaaagaatggaaaaaacagacaactttaaaaatgaacacaaagggaagagacaggaagagaagagtaaaaagaaaagctacgtccgtattttctagaaatagacttatacagacctaagtcccttagaaaaagtaattcagtaacctttaagcaactgttttcatactcagtttaattgggcagtgatttgaggttgtagctgaactcatatctgtgtatatgtccattgctcaaggttgaaaatttgcttgagtattagtttccgctcttattgtatacatgtgcatatattccagagttaaggaagcatatcttgcaagcaatgccagcaaaaacataccttttgtggagtgagcatgagataattcattttgtttcatactttatatagccaattagatgtgtaaaatgctgtcatttgccaagtattagaaataaaaatgagagatacttatatttatgaaaggtaagatgtttttccatctttcattggaaatggacaattagctacaagtctgtttccttgctataaaaataaatatccttacttccaagaagatgtggatctgggagaacagaatgtcaggctgggttcaaactaatttgccctacttctttggacccaatgcataattatcttaaggatcaacaccctacattttaagaacttgcctgtctttgtgctgtttatatcttctgtattctttcctctttcatcttcaatatttagtgcagctatttttatgaaacgttagcctgtgggaattttgaacagatttagatagtagttttaaaggataagtggctcaacatttgggggaaagttagggtggcaggagtggtaaataaagtaaggaaaaagctctttcctatctttcccagcaggttcttcaggtctcaggctagactttgcccaaatctggttcagaatctcatggtacctgtgctgacttgctgtgttaccctaacacattgcattggaattgttattccttgtttttttttttttctttttttttttttcctgtttgtaatgtgaactctttgagggcagatgacatctctgttttggtcaccatcacatcagcgtttgtcacatgtacatatctgctgagtgaatggacagataaatgaaggcattaaatggtaaactacaggcgtcgggggagaaactgaatcatagatgacatatggagattcactttctggagcaatgctttcttaataccttcaattgggttgattttctttttgaaagagtttatttcttgacactcggaagggtgtcaacttacatatgaagtatttcaacagggaagcacactgcatctcctcctgcattttaagtgtgacttctactgatcagaatcatctccactgggcaaagagcagtgcatctcactttattccagtgctgtatcaaatgtccatctgtttgcaagtatagatttaaatctcataaattctgtaattcggccagaaatttctggctgcttccaaatatatacagtcctggaacaagtaatatggctttcaaagatgctgtctcaagccacattattcctgaacgaatatgactcataaagtatttgtgcattcttgagcatcctgaatccataatgacatgaaccacagaaattacatcagaaatataatttccaaattaattcaatgagtgttttcagtgacaacaaatatgtggaaacatcatttgtgcctgtcagggttctgctaattgttaacagcttaaaagcattgagcctaaaggcctactttcctcatcatctcttcgaaccccttcaccaatttcaagtctgtttctcctcctccattctagcttctccgccaagtacagcaaacacaggacgtgggaagtttggaactttggggctagtaactttaaaataaagacagcagttcttacttcaatgcattcacaacacactcatgacacacagcgcactccccatggattcagagtcattaccttctttgctccccctcctgtatgtctcccttttgggcagtatcattccaatcttgaccaccttcccaaaagacccattgtccactggaatcctagttctatattctggaagaatgcctcctcggtataactctgtgaataccagtgtctatggaaataaaatctaaaggtttactaatgaggtgcactggtcaggggacctttgtcccagaaaccactcccaagccatcctgcagaagaaagcttccttctcagggggtgctctttccatggcttctgtgacctgtgttttctgggtttccctccctccactccaccccatcggctttgtggattctctttcttttcctgagctgcttagggagatggcctgggcccttttctattctcactgggacacgactcactaatccatcgtatctatccctatggattcagttcctcttctgtgctcatgatccccaaatctctatttcctgactaaagccccctttatccaggttcttccttcacggcactctgactgtctcccacgcctcaaactgaatttgactaaaaaggagtcaagaatctctaccagactaccacctcccccaccaaaacaaacaaacaaaaaaacaacaacagcaaatatgcacagctcccctctcttctcattaagagactccactctgcagttgttcacccccaaatctaggaggcttctcactctctcttttcaaagattcagccctgttaattatgttttctttccatttctcaagtttatcaatttctgttcttccttatactgtcatcacactgattgaagccacagtgtgtcctagtccctcagcgatatccttgacacaacagttagtgaatcttaaatgcaaatctgattgcattgctttaggcttacagttcttcatttgctttctgttaatttaatgttcaaaatctgttttatggggtataaagcccttcaaaattagcccttcataataattcatattaacccttcacataaagactagctttcatttttgttttttattcaacatttactgaatgccgatgatgaacccaagttctgttgttaggtgttacaggtatagagatgagaaagacagacaagctctattattaatggagcttatactcaagttagaaaaacatacaataaaagcaaacacatacataagataatttaaaagaagtgttgtaaagaaaatttgggagggtaacgatatgaaagactgggagaaggaggctatgttagatggcagtggccagggaagacctccctgtggaagggataattaccaccttatgccagtttcttaattgcttattatgtagtagctatatttcccttcttttagtttttgaaacctgaaagcaattgacaagctccactctgcctcagctgctttgtatttactttttttttttttttttttgctattactttggactggaaccctccttctttgggtaactactgttcatcctgtaggtctcagcttgtaagctacttcttcagggaaactatcttcaaatgcccaggccagaataacgcatctcagcatcccacttccacttttttcaaaggtcactcattacaacaataattatatttatttttgtggtagatcctgtaagatgtctgctggctagcaccacttgaatgccccaccatcagttaattactctatcctgcaagttttaagtgctttccactttccaaaaactttgattagaaggatgcaaaaattagtatgtccatgaagatttgaagatgagatgtctatcctaatatgttaacaaaatatgtattgatagcaaataccaaataactccattgtatcattgatttcgtctcactgtactgacattatccacttatgtatcttctgcttttaggctgttacattccatgagctaagacaaaggccagaccttatgcatttttgtatctctaggatgcagcacaaggttctttatggtaaaggctctcagttgggttgactcctgtgtattgacttgtaatcactggccatttattattagagaaataattatattaactaatatgccaggaaatgctcttcatacagtagtgttcatatggtaacacttaatccccacaacaatagagggaatcatccttattttaaagatgaggaaacagttgcagtgaaataacttgcttaaggccacatggctaccaagttgcaaaactaggatttgaatataactcatatggttccagagcttatgaacttaactactattctatatcacctagttattaggctgcttccatttaagatactactgcaaatcaacaactgtaaacaatgtaaattggaattcctctctgtatcttaaaattccaggctctataaatttcatctgatatttaagagtaatgtcagtgcacaaaatacatactgtaagatcctccatatttgctagctttgatcctaaaatctgacagtcaacttcctagtagacaacgtatgaaaagaaatggtcattatatttactagatgaaaacaaactagttgcccaggtgaagcaaaactattaagataagagaaatattttatcctacaaaataccatgtatgtcccccagcagtagtaaatatactaaagttgtttatgagccaggagacaggaggctattgtttacttgccatgtaacaatccaggaagagatcagcttgataaatgatcaatagagtacacaagctaggttattgcaaggactagtctttttcattctaaaaaaagttttataatttaggaaaaggaatataagcaccatatggtctgtagatttcttacacttttttccccaagaaattatgcagtttttcttttttgcaaaattatcattagaaatagagaaagcctgcctcttgcatctcaaataagaatatatatatatatatatattatatatatatatatatatataattggattttattgctgtcagtcatcttggttattaaacacagaatcaagtcactttggctctgagaagcagtcatgttcagggagcttgcctaaccatgagatttctccgtatctacccctccagtgacatgaggggtttgtcatagggaggattcaagctaggatacaatgcaagtagcaaacaaccacaaaatttcactggcttgaagaaacaaaggtatattttgctctcatactgcatgtctactttgagtcgaatgctgaccctgaaatggtgttgtcattgctatcctcacttgtaacacagcagcagaggaaaaccaagtcgctggtggttctcacatttggtcataaatgttccagactggtagtggcacaggttgtttctgctcaaagttcattagccagaactactcacagtcaaccctgatcacaagagcactaggagatgtaatcctaccacatgcctagaggggaaagtggccttcgtggcacagagcattatgataactccagagaaagtcaggagggcgatttctatttgtccttctgaaacaagaatcctcataagcacagaattgaggaacctgtggattatgatctgatcactgtgatatcttgaatagcacataaaggcagctttgttaaagagaaaaactcactgctttatggaaagaagctgtcaattaattagggtatgacaaagaataagaaatgtcccctgattttctgccaaaaatttcataaaacgatagtgtcaggtccaaattcagtaatatgaattgtaaggaggtacaaaaaagtagagtccaggtagtgctttgaagcactaacttaacctaagacagataatcaattctctagttgcagagagtaaagacaggcagtctgcaagccaaatttatgtatgagaataagtttgtttggactgcacaatatcttaaaaaagaaaaagaatatgcttctaagcacggaatgctcatcatcagttaaccatactgctcatccctcttcccttcattaattataccagaccactttgttcatttatttgtgcaactgacccctgaagtcatttgactttgtgctctttgatcctgatatggtttggatctgtgcccccacccaaaactcctgttgaattgtaatacctggtgttggaggtggggcttggtgggaggtagttccatcgtggggttggtttctaatggtttggcaccatccctctagtgctgtcttgtgacagagttctcgtgagatctggttgtttaaaagtgtgtggcaccttccctttcaatcttcttcctcctgctccagccatgtaagaagtgcttacttccccttcaccttccactatgattgtaagtttcctgaggccccccagaaacagaagcctggatagcccatagaatcatgagccaattaatcctcttttctttataaattacccagtctcaggtagttctttatagcaatgtgaaaaatggactaaaacaagtccagagaaatagatggtttgcatatatctcaggtaatccttcataactacgtttacttttgcacgaacttttgataggattattgaatagcagtaattttggatcatattccttaacaagtacattgagtgagctgtattataactacggcagtatatgctatggttgagagacctgccgagatgtatgcctttacttcagtccacatggaggtggtcaaaaggattttcctgtgaccaataaattcctgttacagcttatagacaacaatatattaatgggcaaagatatatttgatgtggctagctaaattataacccagatgaccattaatcaatggattctagaaatagaaatttaaatgtatttataaacagcatagtttaaacttaagaaaaagaaattgattaaaccagaacctggagtttgaatcacaaaatctcatctacacctacgtgtaggaactctataaggtaaatttccagggatcccttaagagagatagtttgtcaattcttttctcaatccaaacttgctttttatttgagaaaaaagtgtaataaaacatcacagtgtatgcttttgatgagctaaaatagccctttgaatagggtaattggttcttcctttaataacattcaatcctggtggattgccctagttcctcagaaatgtcaagtaaactgtgatgagtacttttggctgtgcgatgggcaagtgattgaagcctacagataactgctttttctctgagatatgccgaaaatgtctctgcttgtgttatgccttgttttgtgaggttttaatttcagatctcattgactattcatttaatcattcatttttaaaatacaaatttgtagtacccttaatcctacatttctccttagtgcaagaacctgtataagaattttacattttgtaacaggaaaaaataatattaatctcaaaagcatttcaaacttcattaagacctaaagccagcgagcaaggaatctggacaaaagaaaataataaataatgttttaaagacaggtgttgaagtggaatgaagctgatactgaaaaggcaaaaggaggtaactcaaggactactttctcggagcatgaataactaggcaatgaaacttacggcccaggatattgtgagtttcgacattctgacatttattatcctggagggtgactcacaacagtcttgctggtggaatgttcatgctgattatcatagtcataaccctcagtaaatgaatgatgcttctaacacaatatttatttttcacataagggatttttgttttgttttgtttttgtgaaagggtttttctctgtcacccaggctgaagtgcagtggtgtaatcataactcactgcagcctcaagttcctgggctcaagcaattctcctgcctcagcctcccaagcagctaggactatgggtgtgtgttaccacactttgctaattaaaaaagaaatgtggagacaagagtctcactatgttgctcaggctagccttgaactcctggcctcaagcgatcctcccacctcagcctcccaaagtgctgggattacaggtgtgagccactcacgtaatggtttttacttcatgagataaaatacaacagagaatcacataataacaaaacttcattgtttccaaagaggtgaatttaaccaatactttcgtcaccagacaaggaaagtacaaccaaaaagactaaagaattttgaaaagacacagttatctctgactcccacttcagtaactggagttttaccatcattttttctgtaggatgtagctctttttcttatatttaacactgatatgaaattgtcaaatctagatgtcactgaaaatgcttcttaggtgcatgccgttagacttcctggcatttcttaatatattacctttttttgatctactcaggctaaattataattgtgacctctcttttcttcatttttgtagtgaaggttttgtgcttctatagcatcatttttattgtaatcatataagttcctattcccttttcctctggagttcaagagcttcatttaaaacttcaaataggaatcatggagacagataaagcctgtaaaggtgtttgttttactctgattttggggcaaagtgctttctttcactggcgaagtggtagttttacattcacttttatcttttggggactcagggtacgattctaggatatatatgaacgtggtggatgacattgtttacgtagtctccaaattgcaaacatatctttgtttttaaacttagtttgatgtcaaagctgtggtatcatgccattttaaaacagttttaaagtttatgattcggccatatactttccctagttctatcagatttaagaatttatgtagcagccctgtctctatctcaagtacagagaaaatgcttgataatcattaatttttcagcttgatggaatctaatatttctagtaaagtaggtcctaagtaggtccttgatgaaatctagtaagtctagtaaaggaggtcctaagatgaaatgtagaactagagatatccatcaatttctatccttcttatcatagaatccacccatttttaggacttttttatttacaaaacagataattttttttatcagtaataaaattggatggtattcatatacattatatcttgtgataagggtatgaataaataattatttcattttctgggccttttttctttttccccttttttctaaattaatgtatatggaatcatattagctagtatgatccatgaacatttaaaaaatttagttgaatatgttgcttatatcaaacactgtatcataaagttaaatttattacacattctgtcacagtaataaacttaaaatgaactcacttggatcatgtttgtactgaacttgattgaagtaacattagttaactacattttcagtaaatattaaaatgttatgtttaaatggtttggaccaaaatattactgacaataataactattaattgctatattaataggaaaacctgattactatgtagctctcctgaccccattacattatcactaacacaatgtactctcctttaaaatttaagggtttttttttagaagaataagactgcgtatttgctaattagctatgaacacaacagtgaatataaatccttcatttttcttcccatttcctatccttttattgtaatcaaccacacatagatatctgtgtgccaacacaattgtggtgttcaaaaaatgtatcagttcaatttatattttctaatagttataatcatttttaaaattggtgttatgaagaatgaaaacttaatataatataaaagctatcctcattatttttcttattttttattatttttttgagacagagtctcattctgtcacccaggctggagtgcagtggtgcaatctcagctcactgcaacctctgcctcccgggtttaagtgattctggtgcctcagcctctagagtagctgggattacagatgcccgccaccacgcccagctaatttttgtattttttagtagagacggggttttgccatgttggctaggctgttctgaaactcctagcctcaagtgatccacccgcttctgcctcccaaagtgctgggattacagatgtgagccaccgtgcccagacgctatctctgaaaatgaggacagtttcacagagaaattgaaagggaaaaaatgagtggaattgagaaaggtaaaaggttctaagtaatcattgaccataaacagtttttggtgcagaatttgcaatctccacaggctaccagcttctgagcttctgtaaaatattttatcaaaaagccatatttgaaatttcaaggactcattattttttaatgtttagtagctgttttcaatgagatggccatagtgatgggagcagagaagtccacatagaatctccctaggatacttccctatttctttcctatcccttccacccctcttgtttttctgaacatttactgacaagccagagcgtggtctaagaaaggagaccgaaaacttaaacaaataattttcccaaggtagataagattatttacaattccctttttctttcttcctctccaagtcttccctgtgggtggagtgcactcttccaccctattgactttcggtttggccatgagacttgtataatttgtggaatgagaacagaagtgactgtgtgccaattctgagcacaagccttgcatgtttctgcttgccttcttgatctccagcactcctccatggaaagaccatgttacaggtccctgcagccccagaatgaggacacagagggagcagatctgaaacccactccacagcctagatccaagcccactcgaacagccaatctcagggcaagcgcagaagagatacaggcacctcacagtcctgtgagcaagaagaaatgttgtaaaccattgagattcagaagttgttatgcaggataattgcgatgtaactggattatcagccccaagtgccaagaatctcataatattaatatattgtgttaagagctagggtttggataaacttgaatctagagattcccccaccctgccaagtttctatctgtgtatgtgaatgtgtgcgttgtgtatagtgtgtgtgcatgtgtgtgtgtgcatctgtttgatatgctatgttcaaaagtctctgatatgataataagtttaaaagactaaaataaggtatgcatagtgacacttgtgtacttctgcagatgatatgaaacataaaacacacaacagacctggtccttagccagtctctatgaaacaggatgaaaaaaaatgatgagggtaggtctctaataggaattaattgattgttgaaatcataaaataaagggtaaggtgtatataatattgctgtatatttcaagatttctccagagttccctaatgtggattccttctagtactcagagtttacaaattaaaattatattttgtctcttctactgattttctctattcttacccatccccatacttaattccttcagtgccaaggtcttaactgaatattgaaatcaaatttatactaaaaataattgaattattattactatctcctctttcaaccctgatgaaatgaatcctcctaagaaggaggattttccatatctaaaaaaaagattacagaatgctgagatctcaaagagtttgggagtaaagttttggggtgagtgggtcttgcctttaaccaaactgtctaatatattctgtttatgggtagggatagccccgggaggggaacagagagagaagattttcagctggaggaagagagccaagcacaaatatatcttctttccctgtctttccaggctttcttccactagaaaaatcacctctattccacttcccaattcatttgtagtttacaccctaaagtctgagggctggatgtctttggtcagaactttggaagttcttagtttttgacaattccatgtgattgtcttgtaaatgtctccaagttaacatgttttagaaaagaacccacaattaacctttcccctaaccttccctattagtaactatcatctctacttgcctagttacttacttgaatgctacccttgactcctgcatttccctgaattttccatgttcaattcataagcaaatcctgtctgttttacttccaaatatattttttcagaaacatttacttctttctaaagccatctgctactctctagctctgttgctaccaatcttgccagatcatcatctgctgtggactacaatagcttgcttggtagactccttgctcccactctgcctcttctatctggtcttcaaacagaagtcagtgtaattgctccccttattaaaattcatcagtggcccattgctgcacccaaattaaacccaatcattaccaaggcctatgaagtcttccttgataggccccatgatcattaccatcttttctcactctgccccaagcacatggtgtaagaaagtgctcctaaagttacacaaccttgaaaatttgctgggaatagaatgcatatatcaccttcttatggccacctgatacagacactgcaaaaatgtaaaagagttcaagtttcaaggaatcaatcacaggagtgttcttgctttgagagactacatgcttgagttatcatgacattgtagaggctgatgcaatagaaaatatcagagaggaatatcagctctgtagttctctagaagctggctaaagtacattctttgagatttcattctctgagtcttacttaagcaatttctgagctctttcttatcttacaggagatgtattgacacagagcctagaccaaacactaggcaaagatcacaaaattatgatttattgtttcactgtcctatgttttatagtcaattttcctgaatgtaactttgttttcctacttcctagaaattgtcagtaggtaaattctgggtgttttagtggcaagactctcagacttctgagggttcttttgtgagattgagaacagaagatcttaaggtgcacggtctcacacatctgtttctaaatgcaagttataaagccctcacctcctgtctctctggcccaaaatagttgcagaatcagaattgtacttttaaagagattttctactcttttgaatggtctcatccaatagattaattcttttgtttatcctgggtccttggggtctgccctactaaaattgaatgtaagtaattaattatgccaaacctcctattcctgacttatcttgaattctaagatgatacagtcaacttcttttaaggtatcactttctcaatcaattccttttgtgggtcagagtcacacctgtcatcacatttttagatgtcattgtctctatgatcagagagatagactttgtacacatgtatgtgtatagctgaactcatggctgaaaatttatttcttctgtaagttcttgtggaaattaaagccttttaaaaatgtctcctatttcttgagaaaaaaatacaaagcagtcctagacattcttcttttttttaagttgtgcctccattctgtgtttttaatttattgcttgctttatttctgcatcctctactcacatttccatgctcccccaattctaccttactctctgtatctaaacgtctttctgttgtgccttgtagaagccatagattctcctttttctgactgacagcatacagacaaatgagctttcatttctgtttagctcatgaagatcagtgagtaaactgacgatttcctttacaaattaactatgaaatttccactattacccagagctcttgcaacgtttatccttacgtaaataagcattgagtattattagtttacatttataaacagatttataattttcacatgaaaaatattttagaaaacactagttgatgcgaacaattttgaaaatacaattaattgttaataaaagtagacattattaggaaagacaaccattaacttttagtgaggcagagcatgttaatatcatattttaatgataaaattcctattttcaatttttatttatatgggcatttcaatctaataaattgaatcatagaatgaactaatagaaaggactaagggagccatgacaatagatttataatttacttggtgtagcaagaagatagcatcaaatgcacacaaaaaaagttaatatgattttattgcattgaagtacttcatttcaatgaaagtaatagtaaagcttcttggaagctatgcagaattacttaatttagatgacagaaacttcttcttagacgtcattttaggggaagaaaataattttctatttctatgcagctaaataaatgaaaagagttttatttcactatatcttatgcaaagcaatattgggtcttttacaaacctcacagagggaacaattttattttaattctggcagctcagcatggatgaaaatcgtggaattagataaggtctccttcctattgacttatggttacttaaaagcaaaagggagaaaaaaacacaaaaataatatataccatattgggctcagggtgcagcactatgggcactctgataaaatacttgtagtataattggtatatttcttctggaaataaatttggcaatacatatcaatgcatatggctatcactgcagcaattctgtttataagaatatatgctaagaacataatacaaaatatgtgtaaagctatgtgtgtgtatgtgtttgtgtctatatatggatatatatgtgtgtttccataaaatatgtgtgtttataaatatagatgatatgtgtgatatgtatagacacaggcacacacacatatacatatatattcatatatataacatttattatagtatcagtcctaagagtgactaagtaaattatggcatatccatacaatggagtactatgccaccatttaaaattaccatgtagattcaacttaaatgtttaatatatttctaaatattttaaaacctattgatacaaataattccatagtgtataagagtattattgatatttaaataattgggaataataacacaaaatgtgaatagcggatatcactggtttgcagaatttttttcatttatttctgttttacatgttttctgctttggttatatattactttaaaaaccagtaatgccattgaaatgccattgaaaaatatctgaccaaagctgacaatgatatctttgcaagatttataagtgtgtgtgcaaagatgtgcatgctcattcagtgcacttacttttggcaaggaagctcgtgatcctgaactctgtgtagtcatcgttagcacagtggttatccccagagctaccctggccggtgctgcatccatgttgatccagaatgaaacccaggatagaataacaatcaggagactgggaatgtacatctggatcagatagtatcccatttgtcgctccagatggaatcgcacttctatacacgtaaactttcctaattggtggtaaggtaaatacagcaattagtacaaataggtctttgttacggcatcaaatatcacaatttctcttttttttttgagacagggtctcactctgtcccccaggctggagtgaagtggcatgatctcagctcactgtagcctgcgcctcctggattcaagagtttctcctgcctcagcctcccaagtagctgggattacaggcatgcaccaccaagcccggctaattttttttttttttgtagagatgtggtttcaccatgttggccaggctggtgtcgaattcctgacctcaggtaatctgcccacctcagcctcccaaagtgttgggattacaggtgggagccactgctcccggcctcacaatttcattttgataaggattctgttataaaactttccatgacaatgaaaagagtctcgtattgattcttgaaaaaatatttttcactgttagcatcaagaagcaatgtagtaaagagagcgtactcttttaggaaatagtaggaaactttattacttccgacttgaaaagtgctttacacttgtcaagatatccaaagatttattatttcacttgattacgacaattgcttctgaggcagacaggagaaatatatacttattatataaagatcttctttactcatagactgtttctggtgttttgagtgcttctttagagccaggtgctatttgttgcagaagcctttccattttctttaaagtaagtgctagaggataaacacaattgaacacgaattattccttgaataataaagcaaacaaataggaaaatatgtgttatttcccattaataaatttgaaaataacttaaaaacacactaaaaacaaagggatccatttgtactatacacttatgcttttatgtctctattatttacctctattttggtaagcaatacatagaggagtaaatgatggtttaataaacattaagtcgatattttttgcttgtgtcctggttctactccctactctattgatattgatttatactactctatgttatctctcctttataaaaattgttcttctaaatcacccagttcttggtttaattgtttttatttgagttatttcaagaaggatgaggtcagaaagttaacattctgctctttaagtaacattctgttacttatgatgaaagaaagatgttaaagagcaattgctgtcctattgctaggtagggctcagtgcaaagcttctattcatgtgacttgggccgtgcgtgattgcacaggtgatgcacaggcactatatctggatgaacccatgcatgtgtttccagagcttaagtctcaacaaaagttcataaagtccagaaaacgtggattccactcttaagtgaatagcaatcagaaacatatgtgcaaaccatacatgatccttttattgatttatcaaatatatacaaaatgcctaaagattcctgaaatatatgaaaatactttagattttaaagtgctattaaatataaagatttaaattttgctatgagaaataatgaaatggaataaaacaagaataactgaaacatatttataatatcagttaaataactcactaagtaatcccatagcataattagtaacaaatactaaccattcagatactttgtataaattctctaaatttcaggtgattctcaaggaaaaaaataagctccactgtgtttttatttaaaaagagtgtttttcaaagttcaaaatcactaatcatcagaaaaatgcaaatcaaaaccacaataagtgcaatcccagcactttgggaggccgaggcgggagaatcatgaggtcaggagatggagaccaacctggctaacccggtgcaaccccgtctctactaaaaatacaaaaaattagccagtcgtggtggtgggcgcctgtagtcccagctactcagggggctgaggcaggagaatggtgtgaacctgcttgcagtaagcggagatcttgccactacattccagcctgggtgacagagcgagactccaactcaaaaaaacaaaacaaaacaaagcaaaataagatattatctcaccccaatgaaataactattatcaaaaaggcagaaaataacaaatgctgatgaggaagcagagaaaggggaacacttgtacaccattggtgggaatatagattagtccagctaccggagaaaagagtataggagttcctttaaaaagtaaaaataaaggtaccatatggactacggggtatatatccaaaagaaagaaaatcagtgtattgaagagatacatgtttgttgaagccctattcacaatagctaagataaggaaccaacccaagtgtccctcagtggaagaatggataaagaaaatgtagtgtatatacacaatggaatattattcaaacaaaaaagaatgcaattctatcatttgtagcaacatggatagaactagatgaaataagccaggcatagaaagacaatatcacatattattattcacatgtgggagctaaaataattgacttcatggttgtagtaaagcaaatagtggtttcgagaggctgagaagaaggcaggtgaagaggttggtgagtgggtttaaaaatacacttagaatgaataaattctagtgttcaatagcataatggggacaattacagttaacaatactttatcgtacatttcaaagtagaaagaagaaaagatttggaatgttcccaacacaaagaattgataaatctatgaggtgatagatgtcccaattacccagatttgatcattacagattttatgtttgtatcaaaatatcacatgtacctccaaaaacatgtacagctattatgtatctataaaaattaaaaaatgtttttataatattgctgggaaagaaaataaagggatacacacatgaacacaaatatacaccattgcttgtacataaataaatatactcagtatatgtggatctgatgagataaaagaacaagttggacaaaaaaatccatcacttatgcatggcagcagaccccagaaatacagtgatcaacagaataaatataatacaaacttagggcaatgaaagaaacatgcaaaaaataagtaaacataaaattgaatgatataatttcagatggtgaaagcagaatttgggcgtttaacacatattgttacatatggatgtttcaagagttggcatttgaataaccctgaagaaagtgggagtattaggcttggaacaatttcaggaagaactttacatgcagaaggaagagcaagagcaaaggccctgagacagacagagatgagtttggtgtatataagcaagcaagtcattgtggcagggtattacggagcaaggggaagagaggtaaaagattttggagaaattattagaaggagacagatcataggatgctgtagcacataactaataaatacttcaggatagtgaaaataaaactgaataaatcctctaattttgtgcaattaatttgtgtatgaaaacatttttaacttaagtatatttcattttctggggggaaagggtattttataaatgtggttcttaggtaacctactattgttgtttgttgtattttcacaagcaacataaaaggtatatgtggtatctaggcctattattggaaaacaaaagattcttgtgtaatgtaaaagcaaatatgaaatggagtctgggatctgaagcaaattaaccacatacttgaatgaggactctatgagatgcttttattctctacataatttgggcacgttattttgcttctggacagtacagtgcttctagaatgtaaagttgtaagatctctacgataccacccaagatgtcccattccttgcttatagtaggcattcataaatgtaagttcttttcctttaagctgtaatagctcatttgataactcaaggaagtatgcaaacttactttacactaaggaagtgtcttgagaccctctatcataaaaattcatccctaattgatgtttataacttcacctcttgttctggattaaatgatatctccctaagattcatgtccacccagaatgtgtgaatgtgaactgacttgaaaataaagtatttgcagatacaatcaagttaaaatgaaattgtcctggataagagggggtcccaaatccaacattacttatgtccttatagaaagagggaaatttggacatggaaacacagacacacaggggaatcccatgtgactctggaggcagagactgaaatgatgcatctgcaagctgagaaacaaggttttccagaaataggtagtcaggaagagacagggaacaactcttccctaaagctttgagggaaagcacggccctgctgacaccttgaattttggactcctaccctccagaactgcgagagaacacatttctgttgttttaagacaccgtttgtgataggttattatggcagccctagaaaactaatatacctccctaagccaactctaggggatttttagcatctgtctaagggaactgagcaaggacagtgctattgacttgcctgctctttatctttgtgttgagatgttaaacttgaactccctaataagttagatatcagcttcatctctgagttaaaaggaaaatggtagtgactttttgatccgatattgtgaatttgctaaggagataagagagactagggactttgaatagtgaaaggtcacagcacagttctggaaaatgctgagtccacgatgaatcatagttactgtaatgaaatgataagaacagaagctgatgctagtgggaggtcatgtactcaccacaatggagtgatgcctcaatcatgggctgtttaatggcattcagagaattccattactttctaactgtatgtatacattctaactgtatagttagaatacgtcttatggaaatagcccatgttagttaaagcaactgaacagaatttgccgatgtacaaatatcacattgagtctctcaattcttagtgttgagaactatatctgatatttatctcaagtgtcttagtgtgaatagtagatgcttaggtaaaaatacactgaaatgcacgaaaatatgacaaagggaaaaattaggcaacaaagcttttttcttttttaaaaaatgcaatttaaaaaaaaatgttcttaacagatacagtgtttactgcccaagaatggttaaaaacacattttattgttcacagaaattaaaggaatagttttggaaacattattactatgtaattatgagcttttcattaaaaattatttaaagataattgaacaccaagcattactttcgtctcatacagaccaattatttaacaatatgcaatgaatcaaagtattcataggtttcaaatgcatccattttctgctatataagaaaaacattgatctatgaacagttaaataacttagcattataatgaagaaacatctggatatcataaaaccacaagtagtaagtgtaaagaacactactcaacccctacctgtattgtaatgtttagtgcagtatcgtaaatctttttcttctttcaacagaaactggggcaaagtgagtccttctgccacttgtacgggtgcctcatcttgccattcaaaaatgagatcattcattgtgtacccaactaggcaaaacataataaaaatatgaatagtctaaaaagggcattcaaagaaaagaaatgcaaattactttatagtcacataggatgagaagaccaaacagtgtcatcttatagtaactctgtggatggagctattcattgcccaattccgtttcataaatgtctgttgaagtctattcacgtggaactcccaccaaataatatgagaaaacaaaatggactcattaaaagtataccatggcatgtcaaaacttgaaggggcatgcatatacattctttccttgggatgggtagctactagattaattttgtaattttcattttgatttcattccatctggtttctccttactttctttcaaattattcaggactttctcaataaaaactgaaattgtcactcgttagaaaatgactttttttttttttgagacggagtctcactctgtcacccaggctggagtgcagtggtgtgatctcagctcaccgcaacctcagcctcctgggttcaagtgattcttgtgcctcagcctcccgagtagctgggactacaggcacatgccaccatgccctgctaatttttgtatttttagtagagacggggttttaccatattggccaggctggtctcaaactcctgacctcatgatctgcctgccttggcctcccaaagtgctgggattacaggcgtcagccaccgcgcccagacagaaaaatgacttaaacttagtgtaagaataaatgtcagaaatctcttaattatatacagattgctcaaggatttaggcatgttaattttacttctgctgtgttttgaatctctccagagttgcatgtagatagcatttatttctgtgcacttaaacccatttagaaaatatctacaaagcaaaaatggagaggaaatagaaattgattttttcgtgaagattttgatacacatttcatcatttaatgattcaccaatttcttagattaatttgaattaagtacttaattcaaagagagggtagcattcattattgatatatatgggcttttaaaatttccatcctttataaatagtcaaggtttgggccagacacattatatttttatcatggaaaaatttcaactccttaagccataatgttgaatagaattggagtattttctttagaatttcttgaacaggcaaatgaaagcttattatagaactcatgtattttcttttctctttggaacatctacaccagtatattgctggcagctattgtattttaaaaaaaagtatattttcactaccataaaggattctctttttccccctcatgaaaataaataacaacttggggttaaaaaaaaaagaaaaagaaaatgacttaaactataacatttgtgggggaaaagtactaccacataatgcctccttgatttaatcattaaacatgggacagtttgtggaagtggaaacctttgcacataatatcagggaattcaggatagaattgattaatggattttgtaataggtcagcagcctttagtaaactaaaatttcatatttctatatgggaggtatctaagaactgcagatttttatcttctccttccctctgagtgagaagctattgaaatgtatgtttaaagactactgcacaaaatgagtcaaaagtgaatgagacctgtgaggcagaattgttgttactttgatcaatgagtttcttgatgcacaattaccatggaggtagagagaggaggcacggtgtggcctctgaaccaagtcaaatggtcggtatgttaaaagcgcttgggcgcagtgtctcacatctgtaataccagcactttggaaggccgaggcgggccgatcagctgaagtcaggagtttgagaccagcctggccaacatggtgaaagcccgtttctactaaaaaacacaaaaattagccgggcgtggtggtgggcacctctaatcccagctacttgggaggctgaggcaggagaatcatttgaacctgggaggcggaggttgtagtgagctgagatcgaccattgcactccagcctgggcaacagagtaagaccctgtctcaaaaaacaaaacaaaacaaagcaaaaaaaacaaaaacagaagctccaggtctgtgaggcagcacagaagggaaatggtcccaaacaaattctcctggaaacaagcttgtattgtagagaagaggctatgtgagtgactggaaacaactggcatggagctggttaagctgaatagaacattgagtagggaaaggaactgatcaccttccaccctccccaatacctgggaaaaactctcccagacacagtgaaatctgctccagctgtggtggtagtgactggagccagatgccctaccacacttgacccctaggtatatctcacaccgtccactctacaggcagtggagatggtagtagcaagagcatcagtaaccagatctctttagactgtatgggattctgcttctgaagttttcagcagaagtatcatcagtgtgacggctcattatggagcaagtgctattcggtagagtttgtgaaagtcattgagattgaaggaagcacgcatctacatctgaattttgactccagaacagatgtgggaacctgaaggactgtcccctaggctgatggatttaacacagcagggacttaatacctgcttatactagaatacatttcattgacccctgcaattaataatgatttgattggtaataatagaaagctttcactttcattcataaatcctttaatatgtccattataaataccattttaccgagaaagtagatgcacatttctcaatgatttaaggatagcaaaataggcaccaattctaccttctgccagataagacatgtttctcattcttccacacctataatcactgaagacaaaatatatgagattgtgtcccaatttagacagatgaatggaaaaatgacctgaaacttcaattcatttttatattctaaatttttctcaagatattctgtgaaatgaaactagctttatgaaattccttcaaagacaagctttatttagtggctaatacaatttatagacagtatatgtatcttgcttttgtttaaaacagtcatccacattagtttaggtatgtgtatttcatagtcatactattctacttcactatggttcaaaaaatacttaagtttgaaaccagaaggaaaatagtaagaggccatggttgggggcaattcctttatttgagtaacttactggttgttaatgataacaactaagtggtaatattgtcttaataaactctcaaacataattttaaaaaatcaatacttttttacacaattcaaaatgttttaagatccttatgcttttggttggcagatctttatacaagtctgagaatgctaaagagaacagactggttaatgagatcaagcttgtgagctgaattacctgataccacaataagcttcccaatgaaaactaatttattcagggaacagacattaaccctaacttcagtcaacaatctcatatggtagctacaataaaacatgtaaaccaatggctcagggcaaccaaacgcttgttttaccaaatagttacttattgagtaccaactgtaaggaagatgtcctgctaggcttcaggcaatgtgagatattattgccgagtaaagagtaagtggcacgagacaggcagaaactgctgtgtgcatttagcgcggggttctgtgatatctacctaggcctcatttgagctggatcttgaaaacaaggcaggggcttcatataaagtatgcaaaagaaggtgaggcacttcaggctcaagaagcagcaaaatcatttgaaagaaactgcgaactcccaaggtttataatagcaatgggaacagcttcatttgtctagagccagtttgcatgaagaagcatataaagtgtcaaataatgtaagatgatgtaaagttcaaatttccagtttaaaattttgatcattggaatcttttgagcaaggggtgaaccacaaaatttgtgcttgagtagcattactctaccaggatcctttcatggaattcacaaggtcaaaactgctttcataaccataataagacatttgcctttttcattgagtcaacatttgccctgatgttgaaaaaacaatggtgggtaaaacttctagtgctttaacacaaataaaggggctggcaccaaactgtgctaggagttactgtatttttactgccatatcttgcagcaaaaacaatcccatttttatttatgaatgtctttgatccttcatgaaacagtaaatatcttacagtaaaaacaatgccacttttatttcggaatgttcttgatctttgatgaagcattaacaattattaattttagtaaatttggaccctatgtaagtaccttttaatattctgtgtgtcaaaatgggaagtctgcacaaaatactcagctgcaggctgtaatatgattctttcaaggaaaatcactggtgtgtttgagttgcaagctgaactagcttggggttttcgtgaaatactattttttatgtgaaaaaaatgggtggaaactggttactgtgcctaggtatttggcagaccattttctcaaagatgaaggaagtgaacttatctgaacttgtcatgttaagggaacaacagacagtatttgctgtcaatgataaattttgaactttgaagtcaaaattggaattttggagaaattgttgttacaccatgagcttcatagcttcccaatacttaagagattttttgatgggcttgatggtgacatccacaaatgtgatactttgatatgtacgatgaagtgtgtcagctgtttggaagatctaaataactcatcaatctgatattttcaaaatgaccaaaacatgtttaaaaagcatacatgaaagacccattcaaagtgcaaggtagacaagttagttttaatttaaaagagtaggaagagttcattgatatggtttccaattccacattgcaattaatctttaagagactaaaagttttttgccttcagaagaaggcaaaacaaaacaaaacaaaacgaaaaccctctcattcttctgcagtggtccacaaggattataagtcagaggtaacacttcagtagataatttaaccaaaattggcacataattaactatgtgtttacagaaaaaaaaggaaaatttcaaagttttcagtctaagtcactgacaagtagctatgcaacaatatttgcttgtatttcatacctcatgacattacagtagctttctttgaccatctaataaaacacctttcctccagttgctctaccttacctattttctgtttattttttccatagtacttatccttacctgacatcatatatatatatatatatatatatatatatatatatatatatatatatattcatcaggttttgacattatatatattcatcagattttttattttgttttcctactttgtcccctagaatttattctttatagaagcagagacttattctgttttagtcagtggcatattttctattacctaaaatagtatgtggccagcatatagcaggtgcttgaatatttgaattagaaatagagaagggataaaggggaaggaggaagtgtgtgtgtgtgtgtgtgtgtgtgtgtgtgtgtgtgtgacgttattttgggttgccttgaatttgagatggtagcagaagatgcaggtgttgagcctaagaagtctcaacattgacttatatgttgaaggtagttgaaatcatggaactagatattggaaatgagtttaggattggagatttaagttaagaatcactatctacatatactaattaaaattattgattatttgaaaacatcagagagggaatatgtaaatgaagaggaagagctataaagaatcttagagaacgcttaggaagagaaaagtgatgacaggaaagtaataatcaaaacagaaaatccaaagaggtacatttcagctaaatagaaatgagagtatctaatggaattgtctgatcataggattttaaggtgataagtttcccacaagcagaggctgggaaatcatttttcaggtataagagacattcaatgttttagttaaaactaactggtttatttaaagtagatgaactctaaggctttccaactctttggttttataaaacaattaaatatagctttacaaacctgtctaattaaaatgcactataaaataaaacaataagaagcatttggttctgttattgaaataggaagactcatcaaaggaatcaaagataaaatttagaaagaaatctaagtatgtatacacatctaataattgtactatttgcaagtattgcagtaagaatagtggaatatcaaatggaccatagcaatatgaatatctgtgtagcagcaaagtaagatgtagatataatcttgagagatgcggaaaaagcctctgaagcctgacttctttatattttgcataaatttatggagtacaagtataattttgttacatgcatagattgcatagcattgaagtcacggcttttagagtatccattacccaaataatgtacattatatccattaagtaacttctcaacctccccctcttcccaccctgtcagccttctgagtttcctctgtctatcattctacactccgtccatatgttctgcagcactatccaccgtagcaaagatatggattatttatgaatctacaaaatgctctaggctaaccttgaatgtaaacaggctaaatgccccacttaaaaggcacagagtggtaagtcgcattaaaaaaaaaaaaaaaaaaaaaaaaaaaaagcaagacctaatggtatgctgtcttcaagagacctatctcacaagtaataatattcataggctcaaagtaaagggatggagaaaaatttgccaagcaaatgaaaaacagaaaaattcaggagttgcaatcctagtttcagacaaaacagatttcaaaccattgatgtccatcagtggatgactagataaagaaaatgtggaatatatgcacaacggaatactattcagccataaaaagaatgaaactatgtcttttgcatcaacatagatgtaactggcggccattatcctaaataaaacaagtcagatgcagaagacaaataccgcatgttctcacttgtaagtgggaaaaaaataatgtgtacacatggacttagaagttatttaaacactataactttatttgtatatttgttttctgttagaagggcctacttctttattattttcaaaactacctttaccatgcatagacttttatatttcagattaatatccaattgaaaatcatgttagtattttcatttacattgcattgaaattatggctcaattctgagagaataacattttcacaataatgtatttaaataacctcaggaatggacaatttagatgaatggttcaaaacagagtccaaaatcagacctatgtgtggaaatttaaggtaaaaatgacactttttgttgtgtagtttttgtttgttattattgtatttatttattcagttttaaattttaggtttgagggtacatttgaaagtttgttacatacgtaaacacatgtcacagggctttgctgtacatattatttcatcacctaggtattaagtccagtatccaatagttgtcttttctgggcctctcccttctcttcctctcccacctcaagtagatgccagtgtctgttgttcccttctttgtgttcataggttcttatcatttggttcccacttataagtgagaacatgaggtatttgttttttgcttcctgcaattagtttgccaaggataatagcctccagctccatcaatgttcccacaaaatacatgaccttgttcttttttatggctgcatagtattcccttttctatatgtaccacattttctttatccctttatccagcttgtcatggatgggtatttaggttgatttcaagtctttgcaattgtgaatagtgctgctgtaaacattcgtgtgcatgtgtctttatggtacagtgatttatattcttctgggtatatatccagtaatagaattgctgggttgaatggtagttctgcttttagctccttcaggaatggccatactgctttccacaatggttgaacttatttacactctcactaacagtgaataagtgttcttttatctctgcaacctcagcagcatctgtcatttttttgactttttagtaatagccattttgactttttagtaatagccattttgactagtgtaagatggtatctcattgtggttttgacttggatttctctaatggtcagtgatgttgaactttttttcataagaaaaaatgtgctggccacttgtcttcttttgaaaagtgtctgtttgtcccctctcccctctcccctctctctccccacggtctccctctccctctctttccacggtctccctctgatgcccagccaaagctggactgtactgctgccatctcggctcactgcaacctccctgcctgattctcctgcctcagcctgccgagtgcctgcgattgcaggcgcgcgcgccgccacgcctgactggttttcgtatttttttggtggagacggggtttcgctgtgttggctgggctggtctccagctcgtaaccgcgagtgatccgccagcctcggcctcccgaggtgccgggattgcagacggagtctggttcactcagtgctcaatggtgcccaggctggagtgcagtggcgtgatctcggctcgctacaacctccacctcccagctgcctgccttggcctcccaaagtgccaagattgcagcctctgcccggccgccaccccatctgggaagtgaggagcgtctctgcctggccgcccatcgtctgggatgtgaggagcccctctgcctggctgcccagtctggaaagtgaggagcttctctgcccggccgccatcccatctaggaagtgaggagtgtctctgcccggccgcccatcgtctgagataaggggagcgcctctgccccgccgccccgtctgggatgtgaggagcgcctctacccggccaccaccccgtctgggaggtgaggagcgtctctgctgggccgccctgtctgagaagtgaggagaccctccgcctggcaactgccccgtctgagaagtgaggagcccctccgcccagcagccaccctgtctgggaagtgaggagcgtctccacccagcagccaccccgtccgggagggaggtgggggtcagcccccgccaggccagccgccccatccgcgagggaggtgggggggtcagcaccccacccggccagccgccccgtctgggagggaggtgggggggtcagccccccgctcggccagccgccacgtccgggagatgaggggcgcctctgcctggccgcccctactgggaagtgaggagcccctcttcccggccaccaccccatctgggaggtgtacccaacagctcactgagaacgggccatgatgacaatggcggttttgtggaatagaaaggggggaaaggtggggaaaagattgagaaatcggatggttgccgtgtctgtgtagaaagaggtagacatgggagacctttcattttgttctgtactaagaaaaattcttctgccttgtgatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcagaaggccgcggggtcctctgcctaggaaaaccagagacctttgttcacttgtttatctgctgaccttccctccactattgtcctgtgaccctgccaaattcccctctgcgagaaacacccaaaaatgatcaataaaaaaaaaataaaaaaaaaaaaagaaaagtgtctgtttatgtcatttgcccacttcttaatggggttgtgtgttctcttattgtaaatttgttcaaattctttatagatgttgggttttagcctttgtcagatgcatagttttcaaatattttctcccattctgtgggttgtctgtttacactgttgatagtctcttttactgtgcagaaactcttaaatataattagatcccacttgttgatttttgtttttgttgcaattgcttttggtgtctttatcatgaaatctttgtccatttttatgtccaggattgtatttcttaagttatcttctagagtttttacagtattgggatttacctttaaatatttaatccatcttgagttgatttttgtatatggtgtaaggaaggggtccagcttcaatcttttgcatatcactagccagttatcccagcaccatttattgaatagggaatctcttccccattgattttttttgtcagctttttcaaagatcagatggttgtagatgtttcatcttctttctgggctctctattctgttcagttggtctatatgtctgtttttgtaccagtaccctgctcttttggttactctagccttgtagtatagtttaaagttgggtagcatgatgcctctatattttgcttaggattgccttggctattcaggctcctccttggttccatatgaattttaaaatagtttttttctagttctgtgaagaatgtcattgttaattttatagaaatagcatttaatctgtaaatcgctttgggctaaccttaaatgtaaatgggataaatgccccacttaaaaggcacagagtggcaagctggatttaaaaaaaagacctaatagtatactgtcctcaagagaccaatctcacaggtaatgacacccactgctcaaagtacagatatggaggaaaatctaccaagcaaacggaaaacagaaaaagcaagggttgcaatcctggttttagaccaaacagatttaaaaccaaaaaagataaaacatgacaaagaagggcattacataatggtaacgggttcaattcaacaagaagacctaactgtcctaaatatatatgcacctaccacagggggcattgagattcataaagcaagttcttagagacctacaaagagaaacagactcccacacaataatagcgcgagacttaaacactccactgacagtattagtcagatcatcaagtcagaaaagtaaaaaacatattcagaatgtaaactcgacattggaccaaaaggatctgatagacctttacagcactttccacccaaaaccaacagaatatactttcttctcttcactacaaggcacataccctaaaattgaccatgtaagtggacaaaaaacaatcatcaacaaatttaaaactaatgaaatcataccaaacacactcttgaaccacagtgcaatcaaaacagaagtccgcactatgaaaattactcaaaagcatgcaaacacatgacagttaaacaacatgctcctgaacaactttggggtaaataataaaattaaggcagaaataaagttatttgaaaacaatgagaacaaagatacaacataccagaatctctgggacacagctaaggcagtgttaagaaggacattgatagcagtaaatgtccacatcaaaaagttggaaagatctcaaattaacagcttaacttcacaactgaaagaattagagaagcaaaaacaaatcaaccccaaagctagcagaagacaagaaataacaaaaatcagagtggcacagaaggaaatcaagccacaaaaaagccattcgaaagccaggagttgtttttttgaaaacattaataaaacataggccactagctagactaataaagcagaaaagagagaacgtccagataaatataattagaaatgatgaagagaatgttactactgactccacagaaatgaaaacaaccatcagagactaccatgaacacctctatgcacacaaactagaaaacctagaaggggtgcttaaattcctggacacatacagtttcccaagaataagccaagaagaaattgatttcctaaacagatcaataacaacctccaaaattgaatcagtaataaatagcctaccaaccaaaaaaaatgcctgggagctgaaagattcacagaatggtagttctgaattttaccagatttgtacaaagaagagctggtaccatttttacagaagctattccgaaaaattgaggaggagggactcctcctcaacttattatatgaggccagaatcatcttgatactaaaacctggcaaagacgcaacaaaaaaagaaaacttcaggccaatatccttgaagaacatcggtgcaaaaattctctacaaaataatttcaaactgaaaccagcagcacatcaaaagctaatccaccatgatcaagtaggcttcattcccaggatgcaagattggttcaacatatgcaaatcgataaatgtgattcatcatgtaaacagaacaaaagacaaaaatcacatgattatctcaatagactcagagaaagcttttgataaaattcaacaccctttcatgttaaaaactctcaataaactaggtattgaaggaaaatacctcaaagtaataggacccatctctgacaaacctgcagccaacattatactgaatggtcaaaagctggaagcattccccttgaaaactggcacaagacgagaatgtcctctctcaccacttttattcaacatagtattgaaagtactaggcagagctatcaggcaagacaaagaaataaaggatatccaaataggaagaggggatgtcaaactacctctgtttgtagatgacattattttatgtctagaaaaccccatagtcttggctcaaaagttcctccagctgataaacaacttcagcaaagtttcaggatacaaaatcaatgtacaaaaatcactatcattcctatacaccaacaacagccacactgagagccaaatcagaaaggcaattcaatttacaattggcacaaaataataaaataataaaatacctaggaataaccagggagatgaaagaaagatctctacaatgacaattacaaaacactccttaaaaaaattagagaagacacaaacaaatggaaaaatatcccatgctaatggataggaagaatcaatatcattaaaaaaatgatgctttaaattaatgtggcaaaattttaataaatgatgatgagaaaaaattctatccacttagaaaaaggagtgacgcaaaaagaaaatctaattgtatttaaaatataaacataatttgtgctatacaagttctggattaaagtaaatgataatattttgtaatattggcatgtataaagcataatttttaaagaaaaacaaattttattatatgtatatttaaaactttactatgaaagatattgtaaagttgaaacgtgaataacatatggaaaacaacatatgtaacaaatataatacaatacaatataatttaatataatataataatattataaaaatgaaaagataattctatattaaaggtttaaacaggcaacttacagaagaaacagcaatggttactaagtatgcaggaagaaaagctcaaactaaaggaaatgaaaatacaacaaaatacaaatttatatccatgagattagataaaaaaccttaaatctgacattaagtggcaatgttaatatgagcttggtacaaaaatgtttttaaatttactgtatttttgtttgaaatatcttttggatttataatcattcatatagtataggtacatacacatatgtattcatagaaacaaacacaaatgcatatgtatgacagagagagagagggagagaaagtaaggaagagaaagtaaaagggaactggtaatgaggcaaacaaagtagctaaggctagaaaggaggattatgagtagaggctactaatgcattcatttttgtttgtttctcagtttctattcaaatttcctagcacaaacataccagttttgaagaatacattcaaatttattacattatcactttttaaaaatcataaaatctttggtggtttaaaaatagcttaaaagactacacatgagaaaagaggttatataaaactttacacaacgggtaaatatataaaagaagcacttattcaaagggagaatgtgggctgtgaatacacttaagttgaaaacgagtttaaagatttactaataaattatagattcacattttgttttaaaagtaaaccagaatcatatttggtccagctatctcaaaagttaggcagggttagggtggagacagagagagatttctagtttgacccagtttgcaaatgcttatgttcttaattagcagctggaattcaaaaagcagaaggaagaaaatgctcactcttggcacatgctgactattgctaggagaaatattgctcaagtaaatttcattgacctgacaaggaacaactgctatgtcaaaacgcatttaactaaaacatttttatttataatttgtgcatttcatttgaatactcttaccataaatcaggccattacatgtggtttcatttaaattattggtctggtaaattaagcatcttcttagcaattacattttctctaaaacttctggtatagctgacctatcaccattatcttatgagacattttaacgtatatcacagacttaaagtttccccctttctcttgggaaaagtgtggatatataatttgtgacccctaactgctcttcttaaatgacaaacacaacaataactttgttcatatttctcaaaacttcacaaaattgccacactttgaacacacaaagtttaaagtttttgtgagaaatttcagtgaaaatcagaaaatgacctgaccctgagcccattttaatgaggaaaggcatcgtggttggttggatttcactgtaggagaggttataagagggtcttgcccgactacctttttggaataaacttcaggttgtgagaaaacattctgtgtctgcctcccaggatgttggaggttcagatctgctcaaatttgtgaaataatcaattcactaaataggccccaaatcataaccgacactgtgagccaaaccactttagcaatatctgaaagttgtgtaatgttttgaatagagaatagtaaggcaataatgctttgactggtcttgggtttttttatttttgatatatttatatattttttagagatagggtctcactctgttgcccaggctggagtgcagtgaagcaatcacagctcactgtagcatcaaactccgggacaaaagtgatcctcccaagtagctgggactacaggcaggtgtcaccatgcccagctacttttttgggtttttaatttttttgtagagatgggggtcttcttatgttccccagggtgatctcaaactcctgggctcaagaaatcctcccacttcagcctcccaaattgttgggattacaagtgtgagccaccatgctgtgcctgatcttgggatttttgaagcctgatttttcagtaccactatttatttgtaagaaccaaaacctatacaaaaccaaaaccaaaacaagggaagaaagttctgcataatattagcaagatgatccacttcaaattcatattgctggaagcatttgaagagtattattatgaaaaagtctttgtaatactataaaattaaaattttaacatgattggatagcttaaacatcagagaataaaattatatattttgtgtgcaacttctccttaaggtgagataaaaaatgtctattattgcaatatatttattgaagtacttgagagaggtaattagcatggtatggacagatttcaaacactaaaattcgcatttaatacacagtataataaaaactgatgcaagctattctggacagagacccagacattactgtaaatcatttattattatataatttgccatatatataaagccacattgttcctctcaggtctcagaagcttataattactttttttttttttttggagacggggtcttgctttgttgcccgggctggagtgcagtggtgtgatctcagcttactgcaacctccacttcccaggttcaagtgattctcctgtctcggccacctgagcaactgggactacaggcgtatgtcaccacgcctggctaattttttttgtattttttagtagagacagggtttcaccatattggtcaggctggtctcgaactcctgaccttaggtcatcaacccgtctcagcctcccaaagtgctgggattacaagcatgagccaccatgtctggccataattactttttaaacttactttttaaaatttaaacagaaaataatactgccagacaaggcaaaagatagctgatgttttacatgcaatcaaagcctacaatatcaagtatacctacaatgaaaatgacattggcacagaaagatgttcaagtaattggaagtgagcaactccacagtattctgttgcaccttaaaaatataattatatagcaaaatcatagctgtgtaatagaattatgcaggaaagcactaattcctaatatattgttatgaggactactgtaataataaaattctatctaagttagtatgttttcaaatgtggtatatcttttggatggaaggatcacttaagaagtatttaaggcatattagttgaagttctgcaggtcttaagttgctcatcacaaaggaaccagaacttcaaatttgtactgtttaaattatccttattttagagaattaatatttgttaaatatttaacattatttgttaattatttaattaataattaataatttatttgttaattattaattaataattaatgcattaattatttaattaatacttaatttgttaattatttaattaataatttgttaaacttaacaaaattatttgttaaatgattcaattgtgttgtaatccacactcccaggatatgttttctgtgtcctaatttataaattgttaagtatatgctgatttctatcataaaaatgaaaaactaactcaaggtacagagtttgtatagcccaaggatatattaaggctattttctaatggagatgacagaaacagtgattgtaattaggtagaagatgaagttttaatcacaaatgagcaagttaactatagccagagaaattttcaccattttctgtgtctttactgcaggcatagcttgttttattgagcttttctttattgtgctttgtagatattgaatattttacaaattgaagatttgtggcaaccctatattaagcaagtctatcagctccatttttccagcaacctgtcatcacctcatgtctctgtgtcatatttcagtacttgtcataatatttcaaactttgtcattattacgatatctgtaataataatctgtggtcagtgatatttgatgttaccattataattgtttttgggtgctacaaactacctccctatatgatggcaaattattagccaattaataactacgaagacctttaagtagtcgctgaaaggaaaagcaacacatctctcactttaaatcaaaagctagaaatggttaagcttagtgaggaaggtatgttggaagcttagataggatgaaagctaggcgtctggcacctaagagttaaccaagttatgatggtaaaggaaaagttattgaaggaaattaacagtgctactgcactgaacacatggacaataagaaagcaaaacaaccttattgaagatatggagaaagtttgagtggtctgcatagatcaaaccagcaacaacatttccttaagcctaaaccaaatctacagcaagatcctaactcatccatattatgaaatctgagagaggtgaagaagctgcagaattaaaattggaagctagcagaggttagtttatgaggattaagcaaagaagccctctccacataaaagtgcaaggtgaagcagaaagtgctgatgtagaagctgcagcaagatatccagaagacctagctaagataattgatgaaggtggacacattaaacaacagattttcaatgtagatgaaacaatcttctattggaaaaagatgccatctgggactttcatagctagagaggagaagtcaatgcctggcttcaaagcttcaaagaacaggctgactctcttcctaggggctaatgaagctgatgactctaagttgaagccagtactcattcaccgctcaaagatcctagggcccttaacaattattatgctaaatctactctgcctgttgtctataaatggaacaagcctggatgacagcccacctgtttaccgcatagttaactgaatactttaagcccacagttgagacctattgctcagaataaaagattcctttcaaaatatcactgctgatgccaattaacccagtcaaccaagagctctgatggagatgtacagggagattgttgttttcaagccttctaacatagcatccattctgtggcccctagatcaaggagtaattttgacttttagtcttataacttaagaaaaacattttgtccattctgtaaggctatagctgccatagatagtgattcctcttatggatctgggcaaagtaaactgaaaacctacatgtaacaattcactattctataatgacgccactaaaaacattcatgattcggggaggaagttgtaatatcaacattaacaggaatttggaagaagttgatttcaaccctcatggatgactctgaggggtttaagacttcagtggaggaagtaattgcagatgtggcagaaacagcaagagaactaaaattagaagaggagcctcaagatgtcaccaaattgctacaatctcatgatcaaacttgaacagataaggagttgcttcttaagcatgagcaaagaaagtggtttcttgagatgaaatctactggtgaagacaccgtgaacattgttgaaatgacaacaaaggatttagaatattacatgcacttagttgataaagcggtggcagagtttcagaggattgattccaattaggaaagttctactgttggtaaaatgctatcaaacagaatcacatactacagacaaatgtttaatgaaaggaagagtcactcaatgaagcaaactacattcttgtctaattttaagtaatttccacagccatgccaaccttcagcaaccagcatcccatcaatcagcaaccatcaacactgaggcaagaccctccaccaggaaaatgattatgactcactgaaggctcagattatcagcatttttagcaataaagtatttaaaaattaagatatgtacattatttttagacataaaatgctattgcacacttataggctacagtacagtataaatataacttttatatacactgggaaaccaaaaaattaatgtaactgctttactgtcatagtctggaactgaaccagcaatagctctaaggtatccctatattcaaatatattccctcagttttaaaacagctgtgttgggaaaatttgtgatactattggtgagttagaaaaaaaaaatcaccattcctagaaatatttttattttttgagacagagtcttgctctgttgcccaggctggggtgcagtgccgtgatcatagctcactgcaaccttgaagtcctgggctcaagtggtcctttcacctcagcctcctgaatagctaggactgcaggcatgcatcatcacacctggataattttttaattttttgtagatacatggtctcactatgtttcccagactagtctcaaactcctggcctcaagtgagcctcatgcttctttagaaaatattttaaattctattgatggtatatttgaatcatattcatatataaaggacatactatagtgaaccctcacatttaatgagttacacattataattacaatttctaatcaacagttctttagcaggcctggtgactggaagtggtatgaatctcccttactcacgcccagtgctaacacttgggcaaggttttgctttttgcaaatctgcatgtagattttcctgatagcagaactcagagaaatcaacaaattgccaggaactggggactataagtgggctatgttgtgaagaaacaggctacttggaacttctgagagctcagaaatttgatttggcattcttcaaatgccttagaaacttcaaatcctctggattgagagtggaacatttgtcatacaaacaatgaagaatccactggtgaggatctatgaacttggctgccctagaggtaaaagtataaaggaagcagtggagccattgccttcatgattcacagctcctgggctttgatctcagtatggtatcaaaacactcctaaagtccacctcactcatttattaatgtaaatgcttgaatcacactctgtgtaccttttcaaaaaatagattattttctctaaatttttattgacaaactattatttattatttccattttcctgttttctagtttggctggcttccctcttgatcctcactacatataattcacactgtttttgtttacttattaggttttgttttcctcttgatcctttttacagatattccatggttttccaatgctatgttcctaattcacagatttgtggtcttctatgtttaaagaatttatggaatcctagagttgagatgacttttgctgtcatctaatgccgctcacttatcttataaaatagaaaactgagcctctgaaaatgagcggatttatataacttatatagtttctcagtgaaagactgaagggtatgttttctgaattcctccttttatgcaggtagcagccaatgcactgcataatttaagggattgttgagattgaacaccagggtcctgtttggggatatgctaccaaagttttgaaaaagcattatctggaaaggccatttgatttaggggaattgaagggatatgagggttgaaggaacagattattttgagaattaattaaggatgaaagaggctgggcacggtggcacaggcatgtaatcccattttttgggggtgctgaggtggttggatcacttgagatcaagtgttcgagaccaacctgggcaacatggcaaaaccccatctctatcaaaaatacaaaaattagccagatgtagtggtgtatgtctgtagtcccagctacttgggaagctgaggtgggaggatcgcttgagcctggaggtggaggttgcagtgagctgaggtcacaccactgcactccagcgcgggcaacagagtcagaccctatatacaaaaaatggtgacagctctgagtagtaaagaatagcagcaaatggcaggatcacagaaataaaatgctttaaattacaggtgatctagggtgttctaaaaagtctactgattctcacacaaagaagatggctactatctgaatcacacatcctaacaagtgttggcaagggtgtaaagaaattggaactctagtgtactgctggtggagtataagatggtgcagctgctataaaaaatatggctgctttttaaataattaaaaatgaatgaccatattatctagcaattttacctctggatatatgtccaaaagaattcaaagcagggtctcaaaaaggtatttgacattcgtgttcatagcagcattactcactatagccaaaatatgaaagtaacccatttccatcaatggatgaatggagaaataaaatattatatacatacaatggaacattattcaaacttaaaaaggaagaaaatcctgacatatactataacatagataaactttgagaactttgttaagtgaaataagccagtcacacaaagacaaatactgtatgaatctacttatatatgaatttagagtagctaaactcatataagcaaaatgtggaatggtggttctcagtggcaagaggaagggggaaatggagagttgtttaatgaatgtagagttcagttttgcaagatgaaatagtttgggagattgcttgtacaacattgtgaagataccaaatactactgaaccgaatgcttgaaaatggttaagatggtacattttgtttgtatattgttatactttgaatgtttgtcccttcataactcatgtttaaattcggttgcaattgtagcagagttaagaggcgagacctttaacaggagattgggtcatgaggtctctaccctcataggtggaattactgccattataaaagggtggtttcagcccctttttgtgccgggcccttctgtcttctgtggggtgatgcaatgaaaacgccctagcagatgctggcagcttcattttggattttccagcctccagaactgtgagccaatacatttctatccattaaaaatgacctaatctgtggtattgtgtcatagcagcacaatacagactaagacatggattttaccacaattaaaaaataaaagaagaaaagactgatgaatttctgggggaggaaataaaagagggatgcacagtgtgcagaagaccttgtggtatcatgacatgagttgaaagtagaacctgggtaaatacaatgaattagcctccaatagtcttttcagttatgtaagagaagaggggagtcattccggacaaccaacttgatgttttctttaatggatctttgggtgaaatatggctacaagtgggctatattaactgcactgtaaaaaatatgaccaaattattgactgtcgttaagagaaacaaagagatcactgtcttaatttttgctagaatttctagtgataacaagtgagaaatgagagacattttccccgtctacatggaacttgcatgtagtggggtgggggtggggagggcaatacaaacgttatcagaaataaaataatcatttcagatggtgatatgtattttgaaataaatttataatttaatgggataggaagcaactggggagaagagagctaacttaagaaaagattatcacactttgggaggccaaggtgggtggatcacaaggtcaggaatccagaccatcctgtgtaacatggtgaaaccccgtctctactaaaaaatacaaaaaattagccgggcgtggtggcgggcacctgtagtcccagctactcgggaggctgagacaggagaatggcgtgaacccgggaggcagagcttgcagtgagccgagttcacgccactgcactccagcctgggcgaaagggcgagactccgtctcagaaaaaaaaaagaaaaaaaaaatgttcagaaatggcctggcggaatgatccgatgggtcaagctatcgataaatcttcaggaaacacattttaggcagagagaagagcacagttttatctgacataaggattatggtaaccccatcattaataaccacaaaagcacaatgttgaaataaatagataagcatttcatttgacatcaaacatctttgtaacaactgaaaaagtatacaaaagtgaagtaaaggaggtaaatgataagccaaacacaacattgaaaccaaaagtaacaataaatattttcttgatgtattcaggctatacatttaatttcatccatattgaagttgaaaatgcaaacaaaaaagggatcctcgggttctataagaatagaaagaaataggaaccctgcttgagcaggacaagagaaagataaactttttatctgtatcttttctccgaaggaaaataaaattccagagcatgaagatgtttgcagatgagattgctgatgctatatggaatctcaaaggggtgataaagaattttacaaagctgctaagagactaatgttgagaatattttcaagtttattaacaggtagattctgtgaattttaaaggagcgtaacaccaaatccatacaattccagaatagttaagattatatctgtgaacaggtagagcaggaagctgtggtcagtaggagccagaattagggtcataaaggaaaagccatgctacattgatatcatattataatcttattaccaactatgctagaatattaagggatactatagtgttctcagcaagatatctgatgaattctaatgttattcttataagcaaggatttcaaaattttgaaatggatatccatttaagtaatttatagctgattgaaaaagcaattgttgatttttttcagtagtaataaatcaagacaaatacctgtagtgcactgttgcaaggttttcagtcctgtccttctgggagtgtataatgatatattgttcaattctctggatgattaaccagcagagacatggatcatcaaagtagaattatggactaaaactagtaagatgatctttaactagaaaaaaggtaaagtactttgtatttattccagtgaaccaatttagtaaacatggatgggggacatagaacttagttgtagtactcagatgactgtagatgtgttctgagtcaagactgttttgcagctatctctaatgtatgtgtcatctgaaactgcaatagtaacagaatgattggcactgtcacgggggggaagccctactctgcagtctcggtttaggccaattttaatacatggaaagacgtctaggggaagggaaataggcaaaggagggaactctaagtcttttcatatgagaaaacgaatgaaattactgggtgtgtttaacttgcagagataatttaaggataccacaattacaatttataaatatttggaaatcatcacatagattttaaaatgaccaatggttgtatgaaaagtttgtgagctattaaatcatatcgttttctctgtccacttcacagttgtgtgaccttgggaaagtcacttcacttctcgaagcataatttgaccatatgactgactgtagtcaatatgcttagaatacctgatgatcagtaaaaattcaacctagaaagatgtggacagactagaagagaatggccattggtgttgcataggatggaatacttaatgtttaagtggagatttattttataagtagcgagttcattactgtatagttttgtcttgggaggacttctgttttctagctaacactgtaactgcagaggtttaagcaacaaatactcagcaaacaagaaccatctgtatttctcactaggcaaacaaaaaacataatattattttgaacagtatccaaacttttaaattatgaaagagcttggataagagtagagactattataaaataattgcaaaaaatcatcaccaaatcttatcttttgccttagctaatttagcataaattccagagtaagcggtctgagtaatgtcaaacctggtttttaaatgaatctgagaaattaaatcataaaatcctctcatctctctttagaaatttctatcccaaaaccccattaaagtgtattctatctttatatatttctatccaacaatactactaaagtatatatcaagtttcttaaagcttttgttaattttttttttcaagttggcccttaacaattaccctgtaattttcgagatttaggctgttctttttggcagacaatacttcttcactgagtcattttcttatattgtcttttcaaatctaaataatattttaacttttactctttttttttttttttgagatggagtttcgctcttgttgcccgggctgcagtgcaatacattcctctttagatatgaactacagaattagaccctttatggaagtagtaatagtttatgcaccatgtgtcatcaatgcctgttaactattattctgattctaagaaattattatccaatgtttttccatgattaaaaaaatccttcctggcttttttttttcaactagcaaattaaaaaaaaaaacagttaggaattttccttttaatgtaaataaaaaactgaaaattcagttttgagtttttttcctgcctctagccctgtacatcaacttccatcaagcattccttaggggcatagtctagatcttaatataggtagttgtacctctttctcttctatatcattctatattagttatttcttttgcgtcaaataaaataattataattgcatttatgtaaaaatgtatttataaattgtgatataaatgaaaacgtatccgttgaaaattacctcatgttgctagcgcttcaaacagctttaaaaaattcaggtaatggcatctgataagtaatcagtaaactaatgcaatctaatcctgagaaggaaggccagtgatcactttagtagtttgtcttcactaggaactttcctcagtttcatttattacaatcaagaactgcacataaaaattggggctcaaatttaaaacagttagtgaaaaacaagtcttcattgcagaattctctgtgtggtatgtatggtttgatatttttattgttactttcttaggtttctcctaataaaatatgaattttgagaataaagtgtgaattttggatatgcatattgtcatgggaactggcctgtgtcttcttaccgactttgagagtgaaaaatgagtattaaaaagagagaaaataaatgaaagcaacacgttttcttcatacctaaaagcaaacatttatagtatttatcccagaatgaagttgaattaagtatgttctagatcagaggaataaacagtatgttgaacttctggcttttatacaagcagttacatgaaactctgttgagatttgaggaataagcacattcccagagaggcctttataatttgataagggaaacatccgaacttggaacatataaacggggccacattttttcctttgacttcagtggaattctcagtgatgagttagcattctaaattactgtaacagtaaagattcaactttagtgcagttattttattttgatttttaaatggcagcagagtgaaacactatgataaataccacttgtgttgcagctaatacatttttatacctaaatattgaagaaaacataatgttgattttcttttttttttttttacctttaatgagtctaccctccatgaataaactagattaatcatattttccaaatagcctctaggaaacatattgttaaaatatcacaaagagttccttattgtctttctctgtttcacttcttccagtttttctaaaacttgatgatgctgtctttctctggctctcttttggtggtcgttttctatgctatctccagaaatttcattgattttcatgtctgcatgcttatccatgtctcaataagcagtacttctaaggttgtgtctctatatttgtacaaacattcctaattcaagctctatcctaaaatttcccataactcaaagtaaatttttagttgaacaaaaattttcacaaaaaacacagcacagttaagcagacatcagctctgatctactttttccatgaatcaccttcttttttcagattaatgtaaacaaagctaaatatccagttctcccgattgagaggaaacttgaggaaatcatctttatgcataattcttctttttatatagcaaatatttgaacaggttttcaaaatgtttgttgttgttcctatcattattgtctccgctcttggaaattctcattaatttataacaaagttagctctttacgcggacgtttttcccccagtcttccttcttgttttcaaataaaggttttggctgagtttcctttccataactatgactgaaaaagatagaattgctcaggattttctttcattgcttttaagctggcatactacgattatttctatttcttcattctgtatttttgatattcaatcaacctaatttttttttctttaaataatttctccagggatgtgtctaggttctgagatttttcaaagcaccaggtttaggggtttttgtgattctttggacactctattgtgtctttttggtctttttgaatagaatgcttagtgaaatcatttttattaaaaaaacctggcttatttgtatctagaaattttgatatattgtgctttcattgtaacttaacatcaagtttttcttaattttcactttaatcaaatagtcatttagtatttgtttttcattccagttatacaagtgtatattaatatataataatgtatgggaatttgtagcaacttacagtaattctatattgttattggtttctaattttattgcattttagttagaaatcacattttataacatgttgattcataagaggttactgaaacttccttggtggtgtataacataaataaatgtttccatatgctgaaaacaaaatttaacaaagaataaaaattctctctctctatgatttgttttgttcaaatatactgtgcttgtacaatccagtaaattgttgatttatctgttttttatgcagttcatcctgcttttgcttattatatttagaagttatatggttacatacttagattttcctaattatatatatatatatattttttttttttttagagagagtctcactctgtcgcccatgctgagtgcagtggcaccatcttggctcactgcaacccccacctcccgggttcaagcgattctccagcctcagccacccgagcagctgggactacaggcaagtgccaccacgcctggctaatttttgtatttttagtagagatggggtttcactatattggctaggctggtctcaaacacctgacctcaagtgatccacctgcctcagcctcctaaaatgctgggattaaaggcgtgagccacggcatattgattttttaccagcatgccactcaagtgtttgtgcctcataatttttttctgccattaatttttttctggttaaaattattctggactttttcaaggtacatttctcagatatacattttttcatttttctttaccaaatttttttgtgtggtattcttagaaagtgtctagttgtcaacatattgttgggtcttaatatttgttaacatctagtttgagaatctctttttttctacatgaatttaacccttttattctatttttattctttgatattatccttaactcatactttttttttctcatcaatttctaatgcaagtcttctcttaccctggattttccttgcataagcctcttccccaataatttcttttcctctaactaggaattttgtatcatccatggtttcaattataagtcataaatgtacacttttgagggcataggatcattgatagtttagacaaagtagtcttttctaagttagttattcattgttaattttgttcttctcttattcactttctcctttgttttaacagtataccattaagatttgcttatcatctttaattgaattattatattggcataaatataatttttatcattatatttcaggtagcctctgaaattcttgaaacagagacttttttgctttatttattgttataccacccaacataatatgtggaatatattaggtatttgataaatatttttcaattgatgcctaaatgaaagaatatttctcaggccacttggaacagttttgaccattgacatatatttattgaacttttactgaatttaaggaagttgtaccattgcaagccattaaagtgtttgcttttaaattatgtttcctttttgcctacttcccacgtcttaatattattgaacattttcttttcttcctttctgcagtcagatttcattcaaaagtggaccctgggattctgacagctcttgctttccagtaggttaaactctttttgcctactttccagtgggttccaccgatttacaatcttttatcttgtcattttaaaccactatttaaggagaaaagaaaaaaatagatacaaattgttcttaaaacatgcatatatacacacatatatatgtagatttgtatgtatgagtatatatatacacacacatatatgcatatatatacacacatatgtatatatacacagaaatgtaggcatttcttaatatatgtatatattatatagtatattacatgtgagtgtgtgtatgtatatgtaattgtcctaaaaaagttttaagaaaaaaacgccttgaagaacttgacttcagaagcttctactttgactgacattagcatctgccacagaggtttaataaacaaagtctctatggttagctaaattaaaattaattcctaataagagagcaggaagtgcttaatgactgaaatattaaagaaccccttgaacaatccactcatatttcttatagaggaattaagaaacaaaggggaaagaaaagaggctctcttttctcatgttgagaaatgttctgagaaaggcagacacatgggaggtcttactatgtcagcttttgtgtcctgcaaaatagccccagtaagctttccttattcaaaacataagcccagtgatctaaccaaccctcaggcactgtactttttctcatctttctttaataactaacattcttggaataaacgatttcacttgctgctcccacttcctcatcactcacctaaaaacaaaaaacctttttagattccagctttgaccatcattattctaatcacatttgtcttcgttaacaataacaattgcttttttcaagtaccttacaaaactttctttgcagcatttgattttgttacacagaactccttcacagtcctttctctttcgaggttgaatcgtgttgattttaatttgccatctttgcctttgtctggaattttttccaacaacttctaaatgtaggcatttcttaagcgtctgttcttgtttgtgttttatttcctctctacattcgcctcttcagctatttcatctgattcttgaaccactctgtatatggcttttaatagttgatcttcacttttcactccctctttggctttagacctaaatttcccagacctcaaacatattaagatggattttatcaattgtcccatcaacatttgcttctcatcccctgttccctttcttcatcaatgcttctaatctgatccgtttatctaagctatttctctctgacacacaggcattcagtgacttcacaaccactgcgaatcagcctctcctgtttctaccttccacataattgctctttgtcctactttctgttctttttctggaaaattatgaaaacttcttaaacaatcttggttcatttaactaaaataatctttaagaggtacagcaaggaccaaacaattttcttgccccttatatgttgaaccattttagggtgccacttagagggtcccgcacattttaaactctttgccctaaatgtacttaatttttcaaccaagatatacaatcagcctgtcctcaaattgcccttcttcaatttcaaaatcaggtctgctgcttctccccatgtagattgattgctaagtagccccccaaattttaatttattttatttcctctcatttacgttagtactttatccatatgtatgctaattatttaagaactacttataaaagtaatcaatttaaattttccaaggaggagttatcagagaaattgatatttccacttcttaagaaaaaccaaacaggagagggaggggtatagtcacgttgccccacaaagttggtctgccatctagtgacagctccatcacactacaagccttgtctttgacacctggagtctgaggctcggccttcaaattttcctcaaggaatgtgtcaaacagtccttttattccccctcggataacatactgtcataaggtaaaatattgcatattgcttaatttttatatgagattaaacactgtaaacaattaatttaggactaattatatagatcagagaaagggtaggatgtgaaatgttcatctgtgttaacgttgatcagtgaggcatatgggtctactttgaaagaagaaatgtagaggaatacctgaaagcttgaataaatctgtgagaaagtgtgagacattttttcttctgagctaacatacataacatacccagcagagtgatattaaaataataaacattgcttatctgaagcagcataggtttggaggcagtttgtcactgtcacctttgtgagttggagccgaatactcaaccattcaacatgaccactttcacatttgaaaacgtagggataacaatatctttgttgtcagtataagaaaaaatatatatagacacttcgttgagaagaggctcccaataaataagtgatagtttgtttttaatgattaccatccttttcacttctgatgatgtgtatggaaacacatatctaaatatcaagctttgaaaatctgttatttttagatcctcaatttgtttctttctcatagtgtggagtgcatgtgttgataggtatcattattttcagtacctggtgaaaggttacatgcctattcagtaaatatgtgaccaaaatgattacaaaataaattatccatattaggcattaaaagcttgtatctactataatgtaaaagtattttaaaaagtaagtggttcatacttacagctttccagttgcattatacatgtttgtacatccatgggaaaattcttgagatccattggacaggaaagtgttaatgttaatctgaaagtcaaagtaattatttttaaaggaaatttatgacattatattaatattctattgtacaggagaaacaatgttgctttgctggtgactaactcagatttaagtaaaaatttctccagcttatgtatcctacttactataaaatagctatgcccttatatacaaatctggctttggtgggctgggggttggataattgcatatcttaggctggtgctaaagtaatcgtgggttttgccattaaaagtgctggcaaaacagcaattacttttgcactaacctaaatataagcatcccgtcatatttatatatctatatgtttatttattcaattagaaagggctgtggatgtctagaaaatgtctgtattccaagacgacatcctcaaaagagaaattcaagagtggatcctataaaattaatgccaaacgtcaaaaggtatctttccttgcaaatcacatgctatattccagaggcattagagttctaaacgtggaaaagcagggtggagaggagcaatcatatgtaacgttcagtcatcattctaacgaccctgatgttgtcagtgaacattcagcagtgtatttagtaaagtgaatctggaggacttgaaaagttcggcctcatgttccccggtgtgggataagggaatcatcagggtcaggaaatagccctctagaatattcatgatctgattctatgctcatcaaacaaacttctgatttggcttcacacaaaggataacctagatgctgtataccagtattccgctcattggaaaggctctcctccaacttccagagagaattagtatgttgacattccagaaaattcatcacctttgaatactttttgctggaaaagcattctacccagatctcttcagggtagtttttctggttcctacacctgaggaagagatggtgagatccactcaagtttattcaaatgaagttcttttctgagaactctttagcaagcctcttgcactgagaatattcccattgaaattcagtgtcttcatgagcaccctaggtggattagtttacttaaacttcgtgaccctaggcagattacttcaaatcccctatattgcagttttctcatctttaaaatgaagataacaatagtacctactccagagagttgctatgagcagtacatgcgttaacacacataagtgcttagacaagtgcttaagccatagcaaacactcaacaaacagtggttgttagtgattattagtatattcagccactcctagactccttcatttactcatctgccaaattctatagtgtgggcacaaagatgactaaattaaattacatattaagaactatttagccaggcgtggtgtcttacgcctgtaattccagcgctttgggaggctaagaagagaggatcgcttgagcccagtagtttgtgatcatcctgggcaacataaaaatactctatctctacaaatatatatatatatatattttaaattagccaggtatggcttgtgcacctgtaatcctggctactcaggaagctgaggtgagagtatggcttgagcccaggaggtcgagactgcagtgagctaggctcacactgctgaactatagcctgggtgacagagcaagatcttgtctcttaaaaaaaaaaaaaagaaaggaaggcatgcaggaaggaagggagggagggagggagagagagagagagaaagagagagaaagaaagaaaaagaaagaaggaaagaaagaagaaacaaagaaacaaagaaaggagggaggaaagaaagaaggaaaggaaggaaggaaaaagaaagaagaaaggaataaaaaagaactatttaagctttaacaaaaaatagtctgcagctctactaaatataaccacattcgtcaagctgacatttttatgtagaccatagacataaagttagaatgatgtatagtctacagagagtatgcttggtgagttaggtccaattaacataatttgggacacataaatggagagacagtgaagctgctgaattttaagagtcttaggaggataatctggtaattcattcgagtcagagtccataacacactagaataattcatggagttcaacattcaaaaggaatttttctcctggctcagctaggttaagtatgattgtgtaattttacaaagttctctcttaaaaaggcaattttaaaattaggtagacacaatgttttttgccttgtgaaagggcttattagaagtgtatgcacacatatattttgaatgtacacacattaattttccaaatatccaaggctctcagacagccagtttcaaatgttgacttgcagaattaattctgtgaccttttgtttggaagtaaatagcattctcagaatcttttccatgctctcaccatgcatgtgatgtcaaattcatatcctggctatttttctggcataaaaaaagagacattacataattctaaaaaaatagcacttgaaaggaattatttggcaaagaaaaacacagtttgtaggacttcggtcataaatcatatcctgaaaaaatctattcatcgacttttctttctttttgtttaaggtacaatacaattgctcctttcacagcatactgaaaaatacgtgtcaacttggtgggtttgatactgaatttctttgtcaaaacactacatataaattaaagacatgtcttgaccacatcaaaagaaaattaaatcaagaggcaattaatcacattctactgttttggaaataaatgtttacttgtgtaagagagacactaagttctctttctgagacaagatacataaacaggatatggcgtttcttcttttcctttaagaagtcttgggaaagacttttaacattagtacttagtgaaacagtaatgtttaaaaagctgataataatttgtgacaaacaattgacctcattaaaattcaattattgaccacttttgtacaagcattgtttcatgtgtctatctcaaccactagttgaattaaaaaatgtttgctgactctattatagactttgtatataaatgagtatttttattagatcctaatatttctctatttggtgtcttaaaaacaatggcttcaattagcaatttaatcagttttaatctatattatctgtaatatcatattagctaacacatctattagacaatgtttactgtgcagtaggcagtattttaaacactttgtgtatgttaactcatttactccgtactacaaatttacaagaataggtaaatgatatcaccctgttttagagatgaggaaacttagaggttaagtaactcacctgacattacacagcaaaaattgctacagctgaatttgcagccctggggttctagttctagatttcgtgctttttttttttttttttttttttgagacggagtctcgctgtcgcccaggctggagtgcagtggcgcaatctcggctcactgcaggctccgccccctggggttcaccccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcgtgcttttaacctttaagtatactgcctctcaaaagcattgaagcatttttcatgaaaatgggttctgtaattaatatgacattttaaattatgtatttcttataatacaagaaatgatatattgcatgcacatatcagttatttatagtgaaattatagttatattatagtgaaatttaaagtaaaacatgcataaataatttttataaaaacctacataaataattcttccaaaagaaatcagagaaatgtagttaaactgtagaaaatataaggaatttccccagagatttgatatatttgaatgatttggtatatgattatgaatgattttctaaggggtaaatcactcttaggagagattagattgctggagcactagaagggagattagaatgagcttctgtaacctacttctggagcttaattgtcatctgatcatagagacaatcattaactcagcaacccattaccaaagcaatctcattattgttgatggtttctttatgaagctatggaccgcttaagaaaaacatacacaattaaatgtatgccaaattcttcttacgacatgcattttatagcattgtaaattgattacccttgaataaacagcacttaaaaaagcaactgtcaaaataagtttgctttcttatttaaaaattaatggctatcaatgttaaaaatacatattctcatacaagtaaactttagttattttcacaaatttcacagagtgattatatttagcttaaataaaaattaaaattatatcatgatctttgtcaagttgctatgcatagcatctttaacataaaatttcttcccgtgatctgatttttaatgcaagaatgcctctgtactacgagtagaaaagttgggtttcttagtaatattagtaaagtaagaaagtatatcatatttaactgcctatgatgggattccattattctgtggtaaagatattactatcctctttttacaagtgacaaaactgaggctgagacatcttaataactcaagagtccatgcagtacaggtttatggattctgtaaaaaaacagaacgtatacttttctttaaaggtaaaaataacaactttagtgcctattgtatgtctggcactatgctgggtgctttatttaatgtattttaatacattatttcaggctcaaggtaattagtattgtcactgccatgtatctaagaaaaaatgagccttttagaagtaaagagacttaacccaaatcacagctagtcaatagcagagcctcgatctgggctgggagatatatttctccttgatcctcttgtgctcctatacctcctctagcttgtatgccaagactgcaaagctctaatcattctttcatctgagccattttccagggttgtttatgcagctgataattttgagagatgagaacatctttcaaagagaaggcttgcttacagcttgctataaaagtagtggattcccaaagtcagtggtagagagttaaatgtacatggagtatcatatcagggaaacaaactctagttttcctttataagaattaatagacaatttcaaatattttaaaaatcaagcatgatattacagcaacttaagtatatgaatgtgagtggtagacaaatagctaaacaaaggctacctctctgacaagccagaactgggtgtaaggatgggcagggcaaaagtacaactgttttttatatgttttatagaactgtgtgaactttgtgtgtgtgtgtgtgtgtgtgtgtgtgtgtgtgtttttgagatggagtcttgctctgtcatcagggctggagtgcggtggtgtgatcttggcacactggaacctccacctccctggttcaagagattctcctgcctcagcctcccgagtagctgagattacaggcatgcgccaccacgcctagctaatttttgtatttttagtagagacggggtttcaccgtgttggctaggatggtctccatctcctgacctcatgatcttcccacctcagcttcccaaagtgaaaactgtgtgaacttttaagtgacattcatgaattatataaagatttgtggttaaattaatattcagtgtttacatgttataaatatgtaattcttgctcctgattaagcttggtagtttgttatagcacttgtataactttttgttatatataacatatatatacacacatatatataacatatataacatatataaacaagtaataattatgttacaaatttcataaaattttaaatatatttaagaatgaggcactaaaaactatctggagctcagttagtagcagatggctcattgagtaatggtcttgactgtaggatagtaatatggctgctcagaggttctccaaatgccagaatgtgtagatcttttctcttaggcaaattagttttccagatacatatatatctatatatctaagacagatataaatgccatataactaagaggaaaaaaatatgtgtgtatatatatgtgtgtgtgtgtgtatatatacatatagatgtatatgaaaaaatatgtgtgtgtatatatatgtgtgtgtatatgtgtgtatacatatgtgtgtgtatatgtgtgtgtatatatatatgtgtgtgtatgtgtgtatgtgtatatatgtgtatatatataacaaatagggaaactaacttgcctaagagaaaagatctacagattctggcatttggagaaactctggacagccatattgcctatacctgtatctataaggtataatctatctgtatatctatctatatctatatctatatctgtatctatatgtatcatctgtattcttgtctactgctcagtggaagaagtttaagtctgcctttcagcattttagggccagcaaggggtcctgtcattcttattttgttggtatgatgcctcatgacaggtagcagttgtgcctgaaacccctatgcctaaagcttttgaaagagcctctccagcattttctgtcctcttgcttcctgcttagttcaaaaggtaaaaagggcagtccctaacctgagtgcatgggaaggaaatcaggaatagagggtccacttgtcctacaaagcttaaataaattatactcctcttagatctcttctggcctctactttctgaagtcccaggtgctttacatttctaaaaatttgaaaatattaattattctcttccttttgaattcccctatgttgacgtaggtttccactatctctgtctaagtcagttttcagaagtgcattcatttttaagtttcctaaacatgttatcactcatctgttgctgttttttccccattactttcatcctcctgtgtgttaacgacatttttattctttattccgtttatttcctttttttaatggggtttcagaggaaatacagataaatatgtaagttcaattagtcgtctttgcaaggaccttcttcttctttctttaaaaaagcaggaaagccagatctctcatgaaacataacagatgctccatttgtaaattcaacaagattttttctttttctagcacaatttttgttaacaaagaaactgaagatatgaagcatttgaagatttcaaagtcctgtgagattttcaaaaacaactcagaaaaaattaagttttggattgtgcaagccaggatatagcaaacaaaatctaggagccgagagaccatctgtttcatttgaattcatactgaaagacaaaagatgcatttctaaattatttcatacctttcttcaaaatattagaagaaatgtgagcaattcataatggatgatgtcatttataagagacaaaattccagttttattccaatactttatgacagaaaatacttgagcatttccaggggacatagtagcaagatctcattaattgtatttaaattatttaagtgttcaatataataaatttagtattctttaatataatgcatttgaatgggcacagttaagggttttagtacaactgtcatcttgaaatcttcttaataacaagatctatcctatttgacaaatttttaggatggacggaattaagcgcttttgtctttgatgacatattgttagtaagaagcctctcaaacaaaaagtagtctaggttttatattctattttgttcaatgatcagggaaatactaaaagctcagtagtgtgttctttgtgttgactttctccaactccaataagacttaaaataaacaaatacatgttgataatcatgtaagatatgttacatacaaacacacacaactacaataaataatctagatattctatctttgcaaaatgactattccatgctacctggtgatatatttttgcaacctatgcaaccccaaatctgtctgaagtgaaacagtacttcaaaatataattaaaaataaaatgacaccttttacaaaaataatttttaacttagcaggaaagaatgaaatttattttatttataccctgtcatgggtcccctgataatattcttgagcccacagcacagaggagtgaagaatcatgacctcatgttaagagactttataacttaaaatatatgtgtttaattcataagtgatacataacttgttatgaaaaattcaaacaatataaaattacatatagcaaaatgtacagttcccctttattcctgcccaaattccactattcctattcatttctaaattgtttggggttcgtctaaacttcttctatagacatatatatgtatatttttacatacatagctatgcatatatatatttgtgtgtgtgtgtgtatatatatatgtatatatatatatatgccttaaaaatatacaaaacatttttcttgaactgaaatatatcatgtaggcttacactcaggtctatctcatgcaagttatttcataatatggggttattactgtgttcagtcatgttcttattagtgaacatatataggcccttttttgttgctatttcagtgtttcagtgggtctctttgtaaaagatatcttatgtacacatacatatgtaatttagattcctagaaatagaaatgctgaattgaaggataaatgagtttcatatttttatatatcttgacaaatcctcttcccagttaacatcaagtcatgtgaccacagaagggctattagacagctcgaaatcttaccggtctcattaacttctgtcaatgcatttataaaaaaagttatctcatttgtttctttcattttccccttacatctgtcttataatttttgcttgaactgtcaaatataatttaggaaactcaaaatgagaaggaaagtctattgtattcactcatatttttgcttcctgtgtccttttttccttcttgatattcgtatgcttcttcttttatcattttcttttttttagaaagcttctttgaccatactttccaggcagatttacttgtgattaattctctattttcctttatccaagaatgttttgatttcccctttattcccgaaggatatattccctgggtacaagattctcagatgagagttccttcctttcagcacctaaaaaaatatttgtagcttctttctggcttcagtgacgtctagaaaaatctactctcattctcattgtttttcctgcataagatatcactattttctggatgctttcaggatttgtatttagttttcagaagtttatgcattatgtgtcttcatatggacatctttggatttatcttgtttgggaactcaacttcttgaatctgcaggctcacgccatttgcaaaatgtattaacatttcagccattgttttctctagttttttttagcttcataccctttccccctctatctgacactctgatgacatgaatgttagatcatttgttgtaatctcacagatccctgaggctgtttcccaggccccacggccaatctattcatctctgttgctcagattgggtaatttttgttattctgttttatggttcactgattctcttttccatcttctccattttttttggtccacccatacactgagctttcattttgattattgtatttttaggtctaaaattttgatttggtttcactttgtagcttctatttctttgctgaggctatttttctcatttgtttcaagcatatttgtaattgctcactgaagcaaatttatcatggctactttaaagtctttgccagatatctaacatttttgtcttttcttttgagacagggacttgcttttttacccaggctggagtgcagtggtgcgatctgggctcactgcaaccgctgcctcttaggctcaagagatcctcccaccttagtcttcctagtcactgggaacacaggtgaacgccaccttgcccagctaatttttgtgtttttttgtagagacagggttttatcacgttgcctgggctggtctcaaactcctgggctcaagcaatttgcctgcctcagcctcccaaagtgctgagattacagggtgtgagccaccactcctggcctcatctttgtcatttggatgttgctatcagttgattgtctttttccagaattattgaacatttatggttctttgtatgatttctggttctttgtatgatgaatgtttcttggttgaagcctagacatataaatactattttattagactctggctcttatttaaacttttttggttttctctgacattgctctgcttaggcaagggaaggtgttatcttgtgtctgtttcctaaccactctctatacaggcctgtgaggggagaggctccgccttattgctggatgtcccaggtgtaagcatgatgtccactgacactatggtgagagtggcctcagaactgctaggtgatgttgaaaatattgactgtccactaagtcttctctaaaaccacctcagcagagagggaaggtatgccttgtttctgcagggaaagggaggaattcctggctttctatgtggtcttcctggctctgtgaggtatgaagctcactataggatggtggggcatgaaaatccagttcattatttgtcctttcctgacactatcttgagttaggtgtgatggtacctcaataccacctggtaagactggaagtctgggctccccatttgggctttgctgtcttaagggggattgcatttcttcctgtggtgttgggctggagtagagcagttgtctaaagcttttctgtcttgctaggcttcccctttcctaacctctagggaatattagatttgctagagaaattaggcttttgttgggactttgatttttgtctgtacctgctgatgttgccatgttgccagtttcttcatcttcaagtctaggatgtacgaagcaaaaggaaaattctgggaattcacctccacgttgttcctcaggttccaaggtacacagccagcctgtgcttatatccaccactgggcatctccctaagtttgttatacatactgtgtccaggttttttagttgtacttagcaggtagaatagaaaaaagtatgtctgttccatcttccccgaagtgagattcttgctatcttttgatatttagtggtggggcggggttgggggaggggtggacttttggtaatttttttaaaaggtgcaaaattatcttgcatagacctggaattcaccattaatttactcatccatatgggagtatagggcttattagtggtggaacctgaaatcttcctttgtgccatatgtagcagttaatcacttaagattatattagtacatattagttgtttctcagaattctgatgaaagggtcaattcacaatagagtgatgtcaccctgtcacttttagaaatcaataaatctatggaaaagaaatctgttctcatgaactaggtaaatgtgaaaagcagacataatgtattgggatgcagagatgaagagcagacatgggataaagcattatttataaaaccactttgcagaaaaaaacattttcaaaatcactaagctattaagattacattttagaatcctactattttatccctgatattgggcatatgaactccaaatcaaatacccccattcctgatgagaaggaaagtttacaaaagagaagataagagagagataaaacagaatgaattaattttaagcctaagacctcaatattaagcctaccttgataccttttaaaacatgatactggtgaaaaaagtatttaaatatttggctcttgctagaagtataacatattctccctcttctaagagacatgacatgaattctgttcttacgtcctgttcttcacaactaaactaaattagaaaaacaattatggaaaatttttaaataatcactattttagaagattttttcagatgtgacaaagatcatcaaatatatcatgtaagtagctatttactgactctacatttgtttcatatttaatgaactgccaaagttaagtgaatcctagagttcaactgtcaaaaatttttattagtgtttattgtttggtattaattattattcaatattgggttttttttaatgctatacacttttctgataagtcaataattaggaacataaatgtaaataaggtcttttccagggattgtgattaaggttttgtcatccattttcacataatacagtgattttttttcttccctgccttgttcaaagtttattaacaaatcatcactttgcagcatgttagaaaggatgaaacttgaacagttagggcaaaaatgcaaaagaatgaccagagaagctcaaggatatttttaaaaaacaacacatatacctgaaaaataatctatgtagaatgtatctcagatgagaaacctaaacatttcttaacctgtaaatatttaaagaagacatatatacataaaagtattatcacaatgcatgattcagctgcctttcactttgcctttaagattcctgacaacctggctgatattaagaatcaccagggacatttgtttaaaaagtggatttccaagaattacttatatagttcctgaatctggaacttgggtctgttattattgatcagacatatttgggaaacagtctattagaggaactgaagtgcaacaatgatagcacttgttcaaaaatgtcaaaactttcaccaaacaaaccaaccaacaatacaccatgatattctatttcactgaaatcggcaatttaagtccacgactcaccttattgaataaagaacatttccatttttgaaaattcttagcaatttgttgtctgtagtgacttcatgaaagttggcacccttttcattggcaaagaacaaatcaggtttccaaatggagtccaacatggaggggtcgaggtctaaagagtcgtcaggatattcactgtacgcgaggcggggatcattccatttctgacgaagaaagatattcactctgtaatcctatgataaaataatgaaagaaagaaaaaaaaaaaccctgctttaaaaagtttaaaatccatagtgtcagtgtggtgccaaggcaggctcatcaactgtagaaaatatacccctcttggggacggggtgtatagttaatggaggaggctatacaagtgttgggacagagggaggatggaaatctctgtaccttcttctcaattttgctgtaaacctaaaactcctctaaaaaataaagtcttataaaaaagagttttggatcttatatactgttctttgggtttttctgaattataacaggaaccaatggcatcctcgggtactcccatcccccaggatcctcactgattaccacgtaaaacagtcatcctagttctgaggttttggccatgtcttcagtgacctatatgcctccaaagaaaagaccacaatttatcatgtttaaaacttgctgttccattcaaattttactttcttgctttgtcagaataaaatgttggaatgctgttagacacttagagaaagatattttcttctttgcatttatttttagaataatttattttagtagatatccaataacatccagaatatatttagtgaacttttcttaaaagctctctgtgttacaaaaatgaccatatacactttttcacaatgaaagcccattttctcatgtttaatatagcatgtaagttctatgaaataagtaatttgagaaaaataaaagctgattttataataatgaaagaataataaaggacgattattgtccataatacttcaagaagatttggctaaagagatttcccaattagatctttcatagttaattttaaaaggagtcaatgatttcaactaaattattgctcacaattttggactaacgcgtagaatgacaaatgttgacagctgagtatatgtgtagtgtttgtatatacacagtatatgaaaataagtaccatatatgtctttataaatatttttttctagatttttgaaatgagccaataaattaaatatagacctcattgtaagcatgattaaagcaaacattataagaccacttcatttgcatgcaaaatagccaaggctgaagatactcacaagaactgaaaaccatttttcatctatttttctatttcttgaataccaaattatgagacatcagaatatagtaaccaaccaatcacaacggatgctttaataatatcagaacaggtagattgcttatgttattggtaggtcaaagtcagagtttgtactgaatgttacaaatctgtacatcctcttgatcaatatttgtgccctgagactatattctaactgcaactaaggttacacaccagaaaatattttttctgcttgctagctgccccatgtatcttccaaagtgacaatggagcagaattcacttcagctttttgccagaaagctcacgatattgtggaaatctcactcgccacaaggatctacagaacctgtaaatggggatatgtgaacaagcttctaccagcctagaataggtcatcttctcttagcctgtagtccagggcaccaggaagcacagctccatggttggtggccagttcttgtttccttcgccattctccagtgtgtgccctcaataccactaaaggaatcagtgattgaccaaatcagtttctctctgctttatagccaggagaagactgaacaaggtcaagttataatcatacctgccaggaaagataactgactagtaaagaatgtacatttgtactgatttataagatacataatcaagttgtttgaagcacttttgctgtaacatttcttgatttagaactctctgtagctgttcaccacacttaggctaaaataaaagtactctttaagttgcagtatatgtaataaaatttggtagaatctctttatccttatgttattagtactagtgataaactttacagatacattttcatttcttccgggaacactttttgctccaaatatgtgctagaaaagatgtttagtatctttcagcttctaagtaatacaaggaaaaagcaacagtcacctgtcaccaaggccaaatgttatcatatacccattgtaatgctctttctgaaatatctctatctcttaatacatttagtttagggaagtaagaaccacatgaggcccctggatgacaataatcctgtcattcatgacagcatggaaaatatgattttgtggtctattgtactgcatggtaagtacagttaataataatgtatatttcaaaatcgctaaaagaataaatttttgacattctcactcctaaactatattaagttagtgagatgatgaatatgttaattagcttgattaaatctttctatgctttggttcagggccagggttcaaagcaaaacaaaaataaccatgtcctgaaaaccttagaaactaagattttactgctccttacagttttggttttgctttgcctgcaaatgaacattgagatggaaagctattaaataaccaaattcagcatttcaaaaatgtttttttaaggctgattcttcatagccacagtatcccattatacccagcaaccaattatattaattatttttgaattttggccatttgtgaaaatgtgtaaagaaaggggcaagtaaacggacagtcaaaatagtaccaccctaagagaagtcctaataactagacttgaaataacttgcctgtaataaaattccctggagtgaagaagaaaaagggccttgtacaacacattttgtatatggcaaaaggttaaattacatctctacatgacgctactcaagaaggcaacttggagtgaattaaaagttcaaatatgatgggtaaaattttttaaaagaaaatttagcagagtatgtggccttgaggtaggacaaattatttaaaaagcacaataatattgatcataaaataaaggttaataaattctacgatgtcagaattaagaaattctgttcatccaaaggtcacttaaggttaatgaaaacataaattatactgcaagaaggtatttgccacatatacaactgacagttgattattaacatgctttaaaatatttcataccaataattgagaaaaagagaaacaactgagtagaaaaatggccaaaacaatcacaacattttactaggcaggcattgcaaatacccaagaagtatctgaaaaaatgttcaaccacataagtaaacaaagaagtgcaaattaagatactaatgagataccattttatatttactgggctgttaaaaatgagacttttgatgatatcagaatttgtcaaaaatacagggcaaaatgatcctttatacatcgccgcgaaaagtataaaaagatggaaaaaattggccaggtgcagtggcttatgcctttaatcccagcacttcgggaggccgaggtgggcggatcacgaggtcaagagacagagaccatcctggccaacatggtgaaaccccatctctactaaaaacacaaaaattagctgggtgtggtggcgtgcgcctgtagtcccagctacttgggaggctgaagcaggagagacgcttgaacccaggaggcggagcttgcagtgagccgagatcacgcctctgcactccagcctggcgacagagcgagactccgactcaaaaattaaaaaaaaaaaaaaaaggaaaaattaacattgtaacataaatttgatatatgcacactcaggatacaaacattttagttcaaaatacaaaacttaaatccttatgcttgtgcaacagaagacatatacaaaagtatttatagcaacactgttagctctaaggaaaaaccaagacaaaccaaaccaaaacctggaaccaattcaaatatccattggcagaaaaatgcgtaataaactgtgccacgtcaataaaatcaaatacctagtagtgaaaataaattaccaccatttccaatgatgaggatgaatcttacaaatgtaaaacagtaaaaacaaaaaaagcaaatgctggagatataatgtatggcaccatttttgtaaaattcaaaaccaagcaatttctctctctctctctctctatatatatatatatttatgtgtatgtatgtatgtgtgtatgtatgtgtatgtgtgtgtatatacatacatatacatattcatcaatatagaattataactaccaactttatgatagtgattagctagggaaatgctggggaatgagatagtgaattatacaggtatctttaatattggtaatgttttagctctaagtctaggtaaaggattcaatagtgtttatgttattaaattatacatcatcacatatatattatgtatgtaattatataccaaaagaaattgtgttatcataagaatccttatagctgaaagaggaggaagagagtcagtgccaaaatgaggtgatgtgaaactgactgggtctctggtagaggaaaaaggccaagaaagagccaaagaatgtgggcagcctctagaagctgtaaaagcaaaggaatggattttctcctagagcctccagaaggaacacagccctgtagacaccttgaatttagtctggcaaaacacactggacctctgacctcaagaagtgtaaggtaatacatttgtgttgtttaagccacttgcagaataaatatttttaaagttttctgtatgttgtgtttttttgacatcttaaaaaatccttctggctgtgaagagactacctctccccagtgccagtcaaatttcaaagatagcaaagggcccagcctggagcatgtcttgagtaaacaaactcataacctcagaaccttcccccctctatcagccagtgcacccagaagacagtgttcctgtgccttagtcatctcagggctaggtaccaggcaactagaaaccatctctatagcccaaagcctggcaaaattattcaaacgaggcaaccttaaataaacagttcaccttgccctgcctgcctttgcagaagaaacctcaataaaggctgtggcttaaactttcatgctcctaccttctgcttcctgaccaccatgatgtctttcccacatggccctgcatgggatgctgtgcctcttgtctctaggacccgtgagtataataaactgtgttttttcctgagtctccctgtttcttctgtggccacatcagactgaccatctcataaaagaataaaaacaccactcaatttgtggcaatgtgttacagtagcaataggaaactattatatctttttgaactgatttgcatacaatattattaccagttttcgaagacatctctaaaacaatagactttcttttttttttggccggtaattggagatggtagaaaacttaaggcaaataccactggattcatagccagatggaaaaaataatccagaattctttctgttttaaaaaatcctaatcagagatcttggcaaatttcaaaatgatcagaaaataattcacctttgtcaaataatcaagaatgaagctcagacttcttaccaatgtctcactggtttagctgcataagcttttacagttctgaagtgctgtacaatataggttcccatgcgtcaggaagcacagaataccgacacccaatggtgcaataattgcttctaacatcatctctgtaatatcccccatgttgcctataccatctgctctaagaaccccgccacagggagagttgtcgtctggggccactgattctgcagtaatggcccattgggaaagtgcctttcaattctcagttactaaagcaacagggaagaaagtcattttataagaactatttagaggcttaaaaggttatcttaaatctccctctgacttctccattatccatatgtacaattattctcctagaaaaaagaagattttaaaattccaaaatttttttaaaaagcaatctaattgtgtaccagttctggaaacatgcaattaagagggattgattagaacataaaatgtgctgaatcaattaaataacactcttcatatctcatttagtaacctctgcgtaaatataagattgaaaattaaaatactagcaaaaacaatacaaagctgtattccattaagaatactacccattctgtacactcgaatgcaataatttctggagaggtaaacttagttcatgggaacactctttcagaagttgaaataaattgatttcaattaatatagctcattcagtttgtgggcacctcgatttaggtgtaaacacctacaaagggccagtactcctagtagctgcttgctgtcaatgaaaaatagtaatttttgttgctcttggattgcaaggtaacaaattaatctcccgctaaggtgctgcacagctgtgctccacaagcccccattcatccaccagccccttctgtctttgatgctcacttaatatttctattcaattctcctttgtctgctaattgtatgactaattttcagccttaaaaaaaaaaggctagataaccaggtggacttcactctgtccttcacagcaagttgtgtcaacaagcctgtgggtaggagaaaaaaatggcagaagtttctacatcatttttctgcccacttctcagctcctaaactccaatttactccattttgtgtcaaacccactaggaagaggaagctcatctacttctcctggtttagacaacatggacatggaagtctactaatacttttgctcatgacctgaaatttgcatcacaaatccactcattccaacagaatattgtctctggattgattttattgctgcttgatgttaattacacaatttacatgttaaaataaacataatcgtttacacataagacattagtttgtattttgtatatttatttatttattttttgagatggagcatggctctgtctcccaggctggaatgcagtggtgccaactctgctcatggcaacctccacctctctggttcaagcgattctcctgcctcagcctcccaagtagctggggttacaggcacctgccactgcgtccatgtaatttttggattttttagcagagatggggttccgtcatgttcgccaggctggtctggaactcctgacctcaggtgatatgcccacgtcagcctcccaaagtgttgggattccaccacgcctggcctcattttgtatatttaatatgtgggcatctgcttactattatttttggaccttcactaaacaattgttctactactggaacatatgacgtggctcctaaaacagtgaaaatctctggggaaatgaagtatcatttggtctttggaacattctattatcaatcaacactacaaatgatcttcaaatcagatttctaagaatttcttcccagtaatgggaagaaaattttttgagaaaagttggagatacttcaaaattttgaggtggataagagtgtcatagaatcataatgattttgaagacattctaactactgtgtttccttaaatgtctgatataaactgtattctattttattaatgtgtgtttttaaaatttaaaaaattgtggtcaaatatacataacatttatcatcaaagatgataaatttaaatttaaaattttaaaaatttaaaaatttaaaaaatcgtgatcaaatatacgtaacatttatcatcagagacattttatacattaacagtattatgcagtattacagtattacgcagccatcaccaccaccacctagtttcacaacatttttttcaccccacaaggaaatcctgtatccagttagtgatctcctttcctcctcctctagtctctggcaagcactcatctgcttcccgtccccatagatttacctactctggatattttaaataaatagaatcacactatacgtgaccttttgcatctggcttcttccacttagcataagtttttacaaggttttatggtacatttaagaacacagaggtcatttgtttatagaagtgtgaagggcctttttgagagaattatgtatgtaaggtgatatgtaatatgtaatagtttcagagatatatttttggaagtgagtgttctatacacaatgatgtatatgtacatgtataagccatcacaatgcctgtatatatgtattatacataaaacccatgggaatccacaatcatcataaaatatgaaaacaatagctactattaataaaatgatactaactttcaggcataaaactagatgctttaaaaataatttggaattgaagaaataataagtaaaattgccctgtatataaagtttcaggatcatactgatgcttgtaaaggcctaacagcttcatcttgcatacaagtacttttcatgatagcgacatctgacactgtcagggtttatctatttacttcacactaatcagtgttttttttaaaatatcatatgtaatttgggactaatgttatagaactaacaaagaaaaaaagatttattttgggcctgtgtaagatcaaattttaccaaaataaataatgtgaaccaagtttgtttacctcaagtgtttccagtttaaagatatctagatttttagttatacacacacatatttaaaaatttcatctatttaaaggttcacacttcccttcacagttttattaaactattaacacgtagtagcttggcatttgataaaagatatggtttagtaaataagaacaaaggaatagacattattggcaaaaactttgttgtatttgacatttgtcctcagtaagaaaactgaacataaatataattattccaataattattttcaaatttttctgaatgctaaggcttttttttgtggttttttgttgttgttgttgttgagacagtctctctctgtcgcccaggctggagtgcagtggcacaatcttagctcactgtgacctctgccacctgggttcaagcaattttggtgcctcagctctaagaagccaggattataggtgcccaccaccatgtctggagaaattttgtatttttagtagagacggggtttctccaagttggccagactggtctcgaactcctgacctcatcagatccgcacgcctcgatctcccaaagtgctgggattacaggcgtgagccacggtgcccagccaatgctcatgcttgttatcacagttttacattttaactgatatttaaattttcagaaatttaaaccacttattttctttgggaatttttttaattcatgaggacttttatggcatacaactaactatgaaatgtgagaggttaaaaattaaaggaaaaatgttccactttggaagaattttagttaatgaaatattatgtcaaagaaaaaaaataaattgcatttgttttctttctgagcaattcagataattcttacatagttgtttattgatttggagattggccaaggaactctgtggaggttaagtgtactgtaaagctggagaggaattaacttcttttagaaactatcattgaatattgctgcctcatttaggacagctcttgacagtaacagatgaaatgtttgcttcttctgcaacaaataaaattttaaagtccacaattcactcttaactgaataagacatatataacctattaaaatcagaattaaaagaaaaatgtaatcaatcattagatattttctacttgggtagagaacaccactcattttaatatttctacatttacaggtatttgggtttatgcatacatatataaaggtatttgaatgtagggtatcacaggcaaaagataggttgcaaaattttggtgtgttcttgcattgcatacaaatatttggcaacctgtgagtattaccttctatttgagcatgtaaacttgaggaaattcatattttgttgaatgtaaatcctagtgtaggtttagcataatgttgcagctgaaacttttagaaatacttaagtatgattatttcatttccacattatagttttgatctgttcggaatcgattgatatttcttttctctgtaaaattagcttgctatttatactcgaatactttcatgacaaaaaaattatttgaagtgatgagaacacatgtactaaattaagcatctttaccagtggtgtattgtaggacaagaacaacaactgagatctcactgcttttcattcaggccttttgctatcaaaataactcagcatgccacataatatactgcttaccacaagtgacaccatctcataggcaaggtctcttttatggtggcagattattttctctcagggactatgcccatataccagctgaattccactgagcaacttctgttcaaaccatgtagaaaaggctcagtaaagccctgctcagatctctggcttacaaaatcatggcatgtaatgaaatgtttgttttgtataaaccacaaagttttgggatagtttgctatgcagcaacaactggaatagaactaggaaactagaagtgggtgctgctctaagaagaaaacttaaaacatgttcccttgactctgggagcaggtagcaagaagtaggttgcaaggatttgaagagattgttgtgatggttaaaggaatgagaaggaaattcttattagaggagagaaaagaaaatccacccctacattgtggggcagaaagcttgacaactcatttcagtaatgtagaaaacagaatatgcaactaatgaactgttgcatttggccaagaatattttctggtaaattcctgaaaaattccacttcacttttttgtgggctctgggtaaagatcttctcaaggatgtgactacgaccccttgcctatacttcagaaatattaaaaatgtgcctcataaatgttctcaattagattaaaaagtttctaagaatcataagagcattatctcaaagaatcttgattcccaacccaaggtagagaatcataggaagcccacaaaaatgttaagagaattagactagtagaagcaccattggcttcatttgaaatgggcagggacagttcaaaatgcaaagagcttgcaaggttcccacatttctatgagcaggaagcggtatgaaaaggctactttgtagcaaacatggctcatttttaccgaaaaggaaagatgactcagaaggcagaaacaagagccaacacggtaaagtcaagatccacattttctgggagcaggactgggccttaataatgtaactggaaggatatgctttcccaggctccagaattgctatgaaccagtgactacaatgtacttcccatcaccctttccctattgaatgggaacaccttatccctattgcagttttcctattctgtatcgcctctgtaggctgactttgtgtgggatagaaaacctgttcttaaattcacaggtcttttgatcgagaggaatcataagatccaccttttgggaacctcatttgcactcgcatctaatttagttgacacaattccagacttcaaaacaatgctatagtgggacaaaaaagctggggtctttaggaaggggtgtttatgttttgcatattggaagaatgtaaacaatgtcactagaaggccgactgtgtcagattaaagatgtcctatgggttgtaagaatcctcaaagcttttaccctgtctcttgaagcgctctgagacacagctggctgccatgtcagaagttagaaaccccagagaaactacactgaaggagccacatgtaagaactctggtcaacagtcccagctgggtccagatttccaggcttcctcaccaagacactaggcatatgaatgaaaccattttgaatgctgatcctccagctgaaaccagagattttatatcaatgacaagaggagcagaaaagttacccagcaaatccctgcctatattcctgatccacatacatgtgagacctaataaaattggtgttgttttaagccattttattgttgatgttcctgctttaatttgttttaaaattcagatagagcttacatacagatctgtaccaaatgcatagagatgtgtaatcaccatcacaggcaggttacagaatagagctctcacccacagatattccctgtgttgcccttttgtcttgaaaccatccctacacctattccctcaaagccagtgatgccttcttcatcctcattgttttgccttttctagaatgttgtataaatggaatcacacaatatttaacattttgagtctggctctttcttgacttaagttattgtgtgtatcagtttattcctcctaattgctgagttgcattcaattgtacgggcgtgccacagggcttattcacccattgatggacttctggtgtttttccagtattttgtgattatggataatgctgatgtatacacttgtgtatgggattttatgtaagcatacgtgtttgtttctcgtaagtaaatatctacgagtgagattactgggtcatattaagtgcatgtttacatttagaaaaaaagtgctaaactgttttctagaatggctgtactatttgcacttccgtcaattatatatgagagttacagtttctttgcactcttatcagtaattagtaaattcagatttgtttaaaaaattaatttcaccttttctaatatgtgtgtagttgttctcattgtggttttaatttgcattttgctaatggctaatgatgtcaagtagtgttttctacctatttgcaatgcgtatatctttttagtgaagtgtaacaaacatttaaattgctcattaaaagtattgtttttattttactattaagtttctagagttctttataactattctggatacatatcctttgccagacatgagattggcaaacttgttttttcacagcatgtagcttttttttccttctattaacagcatttttcacagaaataaaggtgtttaattatgataaagatccctttatccattatttatattttttaaattgtgcttttggtgttatatctaagagctcgttacctaacccaaagtcacaaagattttctatgtttttgttttcttctaatcattttataattttaaatttcatatttaggtttgcggtcaactacgagttaatttttgtatgaggtatgagtacgtattgcagcttatttttttcttctgcatagttgacaaattattccaacactatttgttgaaaagattagaatgctattttcttatggtgcagaacctaggaagagcagatttaaaactgtgtgaggcaagaggttatttgttcacacctgagttttgctcatctttgaatccaaatatataaaatgttttttcttttgctcagacacacagaataattggcattagctagaaattccctagcatggtttttgtgagagtaatgattaaaaaacaacaaaaaagtcaggtatgacaaaacacaatatatcacagcaattttgttgttaaaagaaagtaattttaaaaataatagttaaaattttaagaaatcttatttgttagaaagctgacaagctaaaattgaatctgtagttcaatatttaacatcagtagaagctgtgtgaatggatattgaccaaggactcacctaattaagttgagggtaagaaaatatattattcgaggtttttaataagctattttaagaaacataatttgaagagtaggaacactaaagcttgctttgagtattgttcagaatgaaatagttgtataacatattctgcaataactctggtactaaaattgtcaagagcaagcaatttagtcttaatataagtaataagaaagagaaactccagaaaggaaagagaattgcaaaaatatgttgcattctgaatcaaatagccactgggcttttacagggcaagacactgctaaactcatggggaaatttaaggaggaaaaatctctctctcctttgtttctgatgtttgctttttcttcagtgttttgagagtaaaaagaagatagatggaaattcagacttgcaatatgtgccattagaaaattacaaagcccttatgatctcagcagaaaaatgatagcttttaaagcctgttccctggtgcttcatcacctttcccagaaggatataaattactggaagataattgctatgaatacatcattctttttcttgagattccctggtccttgtgaaactcaatctatgtccctaggagcagagttggtggagaaggatgataccatagaagagagaggcaaaattattgaagatccattctgttggcttgttttgttttactttaccctccccatttaaaagaatcaagaaaggacaacctatttgattatataaaactctgtatctgttgtggaatatccatagctgttgtgggataaaaattatttcaaaaggaaattcagaattaagctatttcctctcttttaaatttagtcttacagaaaagttgcagaaaataagagtttctgtaaaccttttatacagcttctgctaatgttaatattttacatattcatagtagtttttgaaacctaaaaattaacattgatacaataccattaacttacctgcagacctattttgaatttcacgagattatgaaaaaagaattcaagattataaaattaaagaatctaatatcctctaatatccctttttttctcgtgtaggatctaatctaggatcccacattgcatttagcttttaacttagtctcttctaatctgtgacagccccatagtcttttttttcttttttcatttttttctgtctttcatatccttaacactttttgagatataccagccagttattttgttgaatgtccctcagtttgggtttgtctgatgttttctcataattagattggtattagtcctttttaacaaaaatgctgcagaaaggatactgtgcccttctcattgcatcattccaatagcacatgatgtagacctgtttcatgggtgatgtttagcttggtcacttgattaaagaagtacctgccaggatgattcatggtaaagatatagtgaagcttatttggtactatttgcatgatattttaggtttccttataacccttgcatcttggtggatttcaacaattcttatagatatttagtgcatttttgaaacattttgtaatttctaaagttgagatattacatacaataggtgttcaaattgaaaaaaaacacaaataatgtatcttagaagtgacagctctgtgcctgggtttatgagtacagaacaggaccccctctcttgatccatacaccactgcagctgcagctgttgctgctgccattgtaggctgggacaggcaagccagagggctgccggtctgtggctgtgagtggtgactatgtccccactagtagcatggcctttgtgcttgggctcacaagggaaggagagggttcttcccctactctgtatggtgctgtggtgctgcagccatcaaaagtagttaggcctgagagctatgtgtctggggctatggttggcaacccagcattgcagccactggcaacaccaccgtgcggtgcttgggacccagagggttgtagtgccactgccactgccattgcccacaccacactggctgctcagggacctaagaacgcaatcacctacgtggcctgtgactgccattactggcatcagagcaagccacttggaggaccaagaagaggcctgcctggtcctactgacacaggtgctggtgtatgctgccctgggagccgaagaacaggcacattcgaaaccctgctacccccactgggaccaggacctaaagactggcccacctggcgtccctgcccccagcaaaatttaaccataccctccactagttcctgtaccctaaaccactgaggaaatcacaaataccaccaatgctgtttatagtcaagtaaatcatacaaagattgcacgactgcatgcacccagaatcaaagccaaagggttctaaccaattgaaaccattgatacatattcaggaaaaagtcattccttgtgaattcaaagaattgtaagaaatgactattacaccagttacatatatatcaacataaggacaccagaaacatgataaagcaaagaaatatgacgccttcaagggaacacaataattccttagcaacagatcccaactgcaaagaaattaacaaaattatgaaaaaggaattcaaaattatgatattaaaaaagcttagtgagataaagagactttgaaaatacaatacacagaaatcagaaaaacaattcaggatatgaatgagaaatttacaaaagggatagctatcttagtgaagaaccaaacacaaattctgtaactgaagaactccccgaataaaatgcaaaatacactcaaaagcttcaacaatagactgaatctaacagaagaaagaaccacagaacttgaagacaggtcttttgaaataactcagggaaaaataaagaaaaaagaatgaacaaaatctttatgatatgtgggatagcataaagcaaccaaacatacaaattattggtattcctgaaggtgaagaaatgttaaaagggtttgaaagcctatttaatgaaataatagatgaatacttcccaagtctagcaggatatttagacatccatatacaggaggcccagtgtcccccaaagagatacaatgcaaaatggtctccgtgacactttataggcacactgtctgaagtcaatggcaaaggagaattctaaaaacagcaagagaaaagcatctagtcacccctaaagtagttaccgtcagactaacagtaagcacttactatgtattttcacagttttaggtcgtacatttaagtatacttactatgtattttcatagttttgggtctaacacttaagacccatttaagtgctgacttttccctataaaaaggacattggtcttggcaaagattttatggctaaaacctcaaaagcataggcacaaaaataaaaatagacaaatgagaccatattaaactaaaaagcccctacaaagcaaaataaacagtcaacaaaatgaggagataagctgcagaatgggagaaaatatttgcaagttactcatctgacaggtgactaatatttggaccatataaggaacttgaacaactcaataggaaaaaaaaaaaaagttccaaataatcccattaaaagatgggcaaaaaacatgagtatacatttctcgaaagaagacacagaagtggccaacacatatcttaaaaagtgctcaacatcactatcattaaggaaattcaaataaaaaacacaattagatattatcttatgccagttagaatggctattattaataagaaaaaataacagatgctggtgaggacgcagagaaaagagaactcatacactcttggcaggaatgtaaattagtacaaccactatgggaaacagaatggagatttctcagaaaactaaaagtagaactaccacacaatccagcaatcttactactgggtatctatccaaaggaaaataattcagtatatcaaggggatacctgcacttgtacgtttatcacagcactattcgcagtagcaaagatatggaataaacctaactgtctattaacaggtgaatgagtaaagaaaatgtgtcatatatacaccatgggatactgttcagcctaaaaaaagtttgaaataatttcattctcagcaacatggaaagagctgcaggtcattcttttaagtgaaataagtcaggtatggaaagacaaatattgcaccttcacactcatatgtgggagctaaaaaaactcatcacttcacggacatagagaatagaatgatagataccagggactggggagaccgggtagtgggaagagagggattaagagaggttggttatggttataaatatacaattagatagaagaaataaattctagagtttgatagaggacgagaatggctatacttagcaacaatatcatgtatatttcacagtaactggaagagttaccaatatagttaccagttaccaacacaattcctgagtcaccaataccaatatctgccaccaatatttctgataccaatacataaaaatggtaaacccatgtgaaaatgatgtatgccccaggtacgctgacttgaacactacacattctatgcatgaaacaaatactcacatgtacccaataaatatgtaaatcattatattaggttggtgcaaaagtaattgtcattacttttaatggtgaaaaccgcaattatttttgcaccaacctaatatatcaacaaaagagggaaaaatagtgacagaatcttagattgacatgtactcacaggaagaatgaagtcttacaattaaagaatatgggcttgtctgtgttacactcagaatttgtttgtttacataattataatcaaactacatatattatggatccttctattattggtcaccaattattctggcttctgcctttgtggctctttccttgaagaagaattatatatccctgctttgctgtactcaggagtggccatgtgacctaagaggtgaatatcaaagagttagacaacgaggacataagggcagtggtggaaagagtagtcgatgaaggaacagcaaatgcaaggaacagatgtgagataaaatattgctactctaaaaagtaagagttcaaagggcattctgaaatgcacagtgggttaggagatggggtggggcgagaattcagtctgatgacttaaggtgagacagattatacagggctagtataagccatggaaatttgaattttgctccaacaggaattatttgagagccaatgaaagagcagaaaaatgacaagatcttatttgagttttagaaagatccagggtagtgattgggtgggtagtaagggaggagcagagttagattctgtgacggttcctgtcacaacagtgagaggtgatccccaaagtggtgaaaaagtgacatatctgggaaatatttgcggggtagaattgctgtgcctttgtgattcattagatattgagcttaaggcaggaagaaataggtcctcaattttctggctgactcaatgagatagcaaacaggtgaagcagatttggatatgatgagctccaggaatttgtacaattgagggagataatcagttcagatatttgagaaaccaacttactgattagactactgtgtcagtgtacagttaatcttgcctttaacattatagcatatatatatgctgttccaataacattatagcatatatatatgctgttccaaatactatgttttaatgttattttggtttgttttatacttccccatgcctttcacatggagacacttgggctatagctattgactggacaattaccactatacatgtggatggccataaagccaaggacaaggataaatgtacatacagagcatatgtgtagcaaaggcagtgcctctgattgaaccttaataatggctggcattcaagaaatagaaagaagataatagtgcaaatagatttgggaaggagtggccagagagtcagaaaaccagagatggttgaattagaaaagccaaagtaagacagttttcaagagcataatcaacagtggcagattctgcaaagatgtcaagaaagtttaagcttaagtggttcattgttgttattgaatactttggaaatagcaattttagtgaagcgattggtgaaaaaccaggaattgaggaatagcatcaggtacaaccatttaaagtaatttggctgtgaatagaaagagaaatatgggaataactagaaataaacaaatccagggaaagctttcattttaggagggcagttagcaaatcaaaacattaaagggagaagacacataaagaagagttgaaatacattgagtgtggtcctggagtaaaaaggacttcaggatttgatgtagaaaaaattgggaactaatcttatataaaaggagggaaatatgcctcaatgtatcagcaggaacattatacccaggttaaattttaggtttggtggcaggttgctaaaaggtttcttgtgttccggtctctacgttttctgtgaagacaaaggtaaggtcatctgttgagaatcagaagacaggtttggaggttaagggtaggtttgtgtgaaagactagcactcaccctccatttgacctgtcttgtaacctgtcagctagtattgcagaaattagaaagatagaaagatattaaagctagggaccttgatgtgatttctgtttagtcaattacatgcacttgtgggagattgagacaaagccatgatctgctcattctgagtttctacttgcaagtggatttatgggattatagtatcattgagtttttccacagtagtgtcaatggagattccctgtcatgtcactagtttcatgattgttgaaagaacaaataaatgtaaattatctagtaataattataattgcggctcagtgactgctattgtttctcgattcgtagatttcagcagtgtgttcctggagccaactgttccagtagcagccttcccacttcctgattcaggcaagggtagcagctttgcttacaagccaaatctgtggtataatcctcctcccccagctttccagtacttttataaacatctgattcccagaaataaattcctttctgtgaggtggctggcatggtttctgttacaaccactgaatgcaactggagcaatctttgccatcagaggagttgtgggaataggcactttgtactgttcagttggcctatttgtgtttgaaggccaggcatatctgaatccattaaatgataggatactagaagtacacagaaaccagtggcaaaatcagttaaattttttacctatggccacctgaattgaagtacatgattttgcaaaccaagtattgaaagccatagcaaagaataatgtcacaggcatgagggagtcagggactgagaaatgggttgcctgcttctgattgcattggggagctaaaagaaaaaataaaatctggtgcagaaaattaaattctcatattaaggcatggtcagagaaccagggatttttcatgactctcctgaatgtgtatcttatctcttgtaccttcatggatgaagatggtagggctgaaaactaaacacaaaggattaatctgtggactactaaactaaaaggtacattatattcactctcttgcagagtgacatatatgagtgttagctccttggttgggaaagagtaaaagttcaaatattagaaaaataaaattgggaagatttagaaaattctaacaaaatctaaggctcttgtgttagcagaagcagctcctcctcccatgtatgatgaaggaggggtatacctatttttcttatatcccacctcaaccttccatcactgccctcatggagtagatctctgaaagcagctagaaagccaattatactcaatccaaggaagagaagttttgtatcctaaggaagtgctagattttaccattttttgtgcataaattgttatatgtggaatagattctgagagtgctagaccatggattatgaaacaaaattttagaattggctaaactgattgctataggtgtgtttacagagattctagatgctgtgtattagctcagatagccaggaatggctcctatgggttatttggctgactgaaagctgggcctagcaggggactatgctgaatgatgtttatatattacaaatttcttagtctgtcatatatgagacatccaaagacatagaaaataagagacatagaaacggatttaatatgtatcctcatttaattctcttttcccagctatgtaccctaagagggcccatttaccaagggattaagattatattagtaaatgaaaggccagcatctttaaaaaaaaatgcattgtgatggctgtcctctgtaagctgaacatattgctcctgaaatgagctcccagatttcaatagtgataattgccaaggtgacagataaaaacttagcagtacttaatccaagtagcaaaatggatcctgttatcataaatggagcagctttggagtggtattcataacatgtaaaccttagtgatctttgactgcagatggttgctcaggaggttaatagacttgaaataaatgggtagctcattaaggaagatcccacttgttttgaataatcaaaataacactgggaaataaagggcccaggacatctctaggctggaagctttactgatagatgaattaatgatcttcaaattcttaggggaagttttcagacaaaacttaagaatgtctcatgaagaacttttacatagggatctatctaggacagtttcaaaacaaagtttacccttatatcagctaacccagaaaaaagagaagcctgtctgtctgtctatctatctatctatctatctatctatctatctatctatctatcaatcatctatctacctacctaccttcctgctacctacctatctatctacattttttagtaagtcacacctttatagaagctttttctggttaaagcatgatagaaacatcataagtgtggtgtaaatttcacaaagaatttgttgccatcgaaggagacatcaagaatgaactccatgtaaatattttgagaacaattttatcaaataatgaaagacaggatgcaacaatcattttatgagtgaaataaatagataaatataatcacagcagaaaaagaaagtaatatggcccttgcatcagatgtggaagataaatgtgaaacaagtctgaatgtatttataattagtacacgtgtttgtgtgcaggcacacaaagaaagtttaaaaaataacatcaaagaataaattcatacaaaaataaaagagaatatagtttgatctccagtttataagtattactaattttgcaaataggtaggggcataatcatgaatcccttcctcgtcagaatacccagtgctcttcccattatatgacagcattgctgttacgtagcccactgagtaatgagtacagaaatattactcttgggcaagtttactcattagtatccttataaatatacactttagagcacacattattttcaaagaggacagtatggttcctgagggagcaaaaattggttcttggtgggtgaaagaatgcttaccctttttatgtataattcagagatatgtacagagcatataaataaatttacagttcatctgaagtactaaaatttcacggggagggcaattagggaaaagatgtctaaaaagtgtctttagggaggcataatgaaaaaaagtgttgagaaacactgctttaggagaaactaaacagaaaagggatgcaaagcatagtcatttctttttatgtctgctgtcaaattttgattaatcatcttaatcttatagtgcatggatgaggaatagcaattatctttatagctagttataatatgaaaagaagtaaagtatatttagaatcagaatttttagcctttttagtagctgcttcttgagatgcatatataacaagcatacgatgtagggtatattagcacagtgagtgatcattgaaagacggagtgagcagaaaaacacaagagaagctgatgcaatgtatgaaatgatgctcatagggagaaacagtgaaataacaacctgaagcaaacaaagtgacttccatcagggaaagaggttaaatttcatctcataagctcaaagaggcacctggctattctcttattacctctggtagaaagtcttgtgccagttccgaggcttcctgagagactggaagtgaaacaatgtcacagcttagcatcattaaggagtggaggcaactccattggagagagagagaatgagagaaaggggtgggtatgagtccttataggaaaaggtagagagtaattcttcactattccgaaagtttgacgatagaaaagagtcccagaagcgctggaagacttaatggagaaggaagcactcccaaatgtcttccttaccgtaggaggaaattaatacttcattaatatccatagtaaagtgaatgggttttgcgggtgaaggttgcccaggatttatcagtgaatattttcagtttatcttcttaatgttaatatatgttataagctcatttttgttaattatacctcttaatataatcttgtgacaagattatttgtcttatgctttatctagcctctggagtgttggcaatattccaagaaactactaaaatttttgaaaagatgctgcagattatagtactacctttgtgacagtaaatccatgtttcttcatgttctccatagaacaaatggcttatgttatcaagcctccttgatgagattgagaataacttcccttttgttttaaaaccaaatttttaagaactaaattcattttgatatacatatgtcattgttgagaaggaatctttcagtttctcattgacttcctaagtaacaaggaaggcttaactcttgcgtgcatctgttctacttgacaggacacttgtggcacagccccaggttcttgtcagtctggcatgtttgaatccttctgaagcatttagttggcttgttgttttgtgggtaacctggaagtctcatcgcagcaacagaaatatgccgtttgaacggtccagagagctacagtgttaatattaactcacacatctgtcagagattcagcctaagagctgaagagctatctgcaatttaaattgattgccaagaacttaacactaattgacatgctagattcataactaagtaacacattatgactagtgccagtcatcttagagaacacaattcccaatcttgctgcccattttatctttagaggctgaaatgacattttggagaggattctttcagaaaatcaaattctcttagaaaaatgtgatgatgatgaatataatgaagaggaatagcattgctgtgatctgttcatgataatctgatcatttctatgttatgagaggtggccaagagaagtgtttaattgatctctacgataccttcctctagagagatccttgaccaggtaatggtcattttccattgcaaattaagaggaggcagaaaagagaagagttgaatttgacacatatctttgccattacatttaactctacaatctttatttctctttcccagcccaaatatttcaaatgccttaaaaatgcaatttttaaatttacttgtcgaaaggaaactctacaatgatatacagtctgataaaggagatagcttatagaggtctgtgcctgacgactctctctcaggatacagattttttttttccgttgtcattagcaccagtttctccttgacatttccctccacagaactggaaatgtgccttttaacattgttttaacaacattatagcactaataaacaattgtattctctatgatattctgtatgagatttttacctttgtgaacaggatctgtagacagtccctttctgagcatgatgattataaggatgacttggtggatgaattcattaagcagagatttattcatatgcctcatggggtcaccaaagtgtataacattcatgcatacttatcttttgcaagcatccccataaataagcccatttctgattgatgcttatatgtgatagatcagagcacaatcattctgccaatcactggttactcatgcatggaattaaaaatcttccagatccatgccatttctatatttggtttggctttacctattactcaaagtaagaaaaaaaagagaaggaggataagatgtaaacagatataattttaacattaaaaggatagcaggatactttcaggctgttccaaaagaactgaaatagcatcaatctaataatatcctacatgaacattgttgaatttataaatatgaatgacatcggaatagccactgaatgctattatggtacttacaaatagtgaataaatgtacctttgtaagaatttaacccattggcattagataaaaaggaccaatggcacattttaggggaagtttacaaaagaacagaaaaaaatggacttttcttcaaattacacacattttatttcagttgtgataaaaattactgtaaaacctagcctgtttatgaaatagttgcaccctaatatttttgatttttgaaaattattcttggatcactatataaataggagctctaatttcttatcatggagaactctccataaaaatttcagcatttttcacaaaattatctttctataaacatgcgtgaaagagcaaatgcttttagaagaaagattatagaattacactgaaagatttgaataaaaaagccaagttcattaaggctatattatccaacattaacttgattgtacaattagctgcttaattcatattttagagactgtagcattgatttatgacaatgatcaggactcagaattcagaaacagatcatattgcaaagcagtaaaaatagcagtttatccacttgtgtcaagaacacataatgaagttctctttttggaaaaaaatagtcttttttggccagaataaatacatgcttacatatatttgacaatataaacttaagagctactttatgctgagcatgtcgctagctgttaatgatacaatgatgagcaaatcacagagaactgctgccctatggacactgcattacaaaattttaaataaatattcatggctttaaacaaaatattaaaaaaagaaaaaggatacttaaaagtaaattggatgaaataatagtatgtcattgaagtatgacaaattagcataaggagaaaaggcaattccaacaaagccaaataaagtagcacaggaaaatatcatcatagactgtgaataaattgcctttatgtaagtcattaaattgttttcagtgaaggaatctaaaatggattgatatgaattataagttatttgggatgtttatgaatttccaataagttatttaccagaggcaattcttaaatatagaagtataagagatagaaacacagaaatataaagagatattatagaaactctgacagagagattaagatatagagaaagcaatcagaatatacagtatagtaatttctgcagaaagaacaaatgaagagacaaaaacgaactattattattcatagaagataaacattaattataaattcagaaagcagcaaaaatatctatcagaacgaataaaaatacacccatatataaactaatttaaaaaatgagtgaaaaccaaattacccgtaagaataataaaattggaaacattacaaagacttctcatcttgcaagataagatgtggtaagtgtatgtaaataatttgacaaggaaaggaaaaattcattgaaaaacaaaactattacaaaactgatgctatgaaaaaccgaatagttttatatctaaggaatggaacttggaacttaaaacctttacacaaataaaatgactggcttggatggcattactggtgaattttaataaacactcatggaagaaataacagttcatcaattttacatgaaccattttaaagagtagaagaaaaaggaacactttcaacatagttttaggaaaccagcataatactgataccacacgccactcttgacattgtaagaaaataatagttcaacatccaaagttaacacagtagcaaatatcctaaaccaaatattagaaatttaaatctagcaatatataaaaagaataataaattatggtcaaatgagatttatacaaggaacgcaagaaggatttactacttggaaataaatcaatataattaataatattaacagagtgaaggagaaaaacataatcatttaaatgaatgttcagacagcattgaataaaattgaattccttttcataataaaacatctcagcaaacaacagtggaagtaaactcaatctaataaggaggatttatgggaaacctacagttaatgccattcttttttttctttttttttttttgagacagagtctcgctcttttgcccaggctggagtgcagtggcgcgatctcagctcactgcaagctccgcctcccgggttcacgccattctcctgcctcagcctcccgagtagctggaactacaggcacccgtcacctcccctggctaatattttgtattttttttagtagagacggggtttccccatgttagccaggatggtctcgtctcctgacctcgtgatccacccgccacggcctcccaaagtgccgggattacaggcgtgagcccccgcgcccggccaaatgccattcttaattgtgaaatgctgtgcgcttttcaactgatgtcaaacaacaaaaagacaaaggtagccattctccattgttatttagcattgtacaggagttctgaaccagtgcaataaggtaagagggattggaaaggaaaaagtacaactgtcttaacagtttgcattaacatattcatagaaaatacaaaaaattggaaaagtactagaactattgaattaagttatcaagttgagaatatgtcaatattgcaaaatttattgtttgcccatatattaattagaaacaattggtaaataaaatttaaaatacaacatttacacacacacacacacacacacacacttccaagctctgtctgctgtgaagcctagacgcaatgaaacctctgtagcaatgaacacatctggtgatcagatctgggtttctactaccattctccaattaaaagaaaaagaattcttgcagaaatgactgatctatggttggggtgggaaaaatacaagatgagtctggaacatcttatatttacagaacacaaatgctcaaaaaccaaagtggtaggaatgtgtcagagacacagaagctaagggaataaactcccagtggccaaactgaacaatttgagcagcaaattaaataacatagcttagaattttaactcaaagcataaaataaatgtgcaagagtctatattgatatgaataaattattgtataaataaaaaatgggaaggaataaatctctatcaaagaatctcaaataatatgcagaaatggttccctcaggtaggtggaacataatctctttatccccttaagttgggctacatgcagtgacttactttcaaagagtgctgatacagtttggatatttgccccttccaaatctcgtgttgaaatttgatccccagtgttgcaggtggggcctggtgggagatgtttgggtcacgggggtggatccctcatgaatggctttgtgctgtccccatggtaaccaatgagttgtcactatataagttcccgcaagaactgcttgttaaaaagagtctggcacctttccctctctcttttcctgtactctcgtcctgtaatctcctcatgctggctcctgttcccttcctacttctgccatgagtggaagtagatgctggtgccatgcttcttgaacagcctacagaactatgggccaaaaaactgttttctttataaattacccagcctgaggtattcctttatagcaatgcaaaacagactatgacaagaacagcacagtgaaggttaaaaaaaggagttactttacaatggaaaaatcagacagataccacctcagggctgtaatcaagcttaacatattcaataataagtcatattgatagtatatactcttgataaaaagtaatgagagtggtactttacttctgtgggcttccttccaaaaatctcataatctaatctattcataagaaaaatatctatgaacccaattgagagacattctacaaaatacctgactaatactcaggttgaggttataaaaataatgtaaaaaattttcacaatctagaggatcctgtggaaacatggcaactaaatataatgtagtatcctggataggataacgggacagaaaaataacattagtaaaaactaaagaaatccaaaaagcacagaccttaattaataataatgcatcaatatttgttcacaaatgttaacaaatatatcatcctaactaatgtaacatggtaataatagaggaaactgggcatgggatctaggaaaattctctgtactgcctttgcaaatttcttgtagacctaaactattctaaaataaaaaggttatttttaaaatataacatgtacaagcatgcatccatacttaggaataaactaagagatatgacaacccctgaaaaacatagttctgagtaactgagtaactgaagaaggcaaataaattgatatactatgttcatggattagagcacttaatacctattttatgtttgttttgtatttaatgcttttcatattcttcagaaagtatggtagagagaactttgaattttgataaaggatatttatagcaaactcaagcaaacaccatatttattttggaaacattagaaatattctctttaaagccaggaataaactcaatttcatttaacattgcttttgttgaaacatcaagacaagaaaaagtggcagagtgtgtaagtactgacaggaagaaattaacatgttactattcctaggtggtgtaattatatgaagaaattataaagcatgaggactaaaatgagagtattttgggcaatgtaaaaaataatcatgttcttatgtattgacaatgaagtgttaaaaaataactaaaaggttataattttaaaagcctattttaataatgaagtataaataattaaatctaaaagatatgcaagaatttatgaggcatatgcctttgttaaatgatattaataatatttaaataaagagagtgatgcatcgtattcatggacagaaagactcagtagtttgagatgacagtttccccagtgctcatctttatattcaactcaagtttattttgtggaatttgacaagataattctaaactttatgaaaagccaattcccaagaatactaattaatactttaaacagaatttttaaactgtgtgtttggtaagttgtcctattaaatatcaagtctaatataaactgtactaaacaagacaacgtgatatcagtgcaggcatagacaaatagatcattagcatagaacttgaaaccgacccattaaatttcattacaaattattggaagtaattattcaattgtgaaatgaaaataaatgcctaccttacaaattacatgtacgtatacatatacaactgtacaaaactccaaggggactaaaacctaaacaagaaagcaaaactcttttatcagatagtataagaaaatatctttatgcacttgggtgagagaagaatttcttatggcaaagaagcatagagtattaagcaaacaaggttaaattttgtgaattaaaattatttatacatcaaaaagaatgccttgaagagtagaataaatgtttaaaatgcatatagctgacaaagtattcatcttcagaatattgtgtgtgtatgtgttaattgtgtgtgtataataaaaacaagcaaccttaaatggagaaaatatattaagaagcattttgcataaagaacatctgaatcatttattaaaatgcttaacctcactgtttatcaaggaagtacatgataagcaggaattaagtccaactttacaaccattatgtaagttaaaaaattagaagtgggtaaatactaagtgttggagaacatgtaaaacaataggaaatctcataaaattgctaataggtgcttcaaacagaatgaccacattggagagcaatttagtaatttgaatggggagcaatttagtaatttccaagtaattaccaagttatctcactcctaggaatataccctgtagaatagcttgcatatatatactatattagaaggtaatacacaatgattttttttttttgagagggagtctggctctgtagcctaggctggagtgcagtggcaccatttcagctggctgcaaactccgcctcctgggttcaagcaattctcctgcctcagcctcccgagtagccggaattaccggctcctgccaccctgccggctaattcttgtttttttagtagagatggggtttcaccatgttggccaggctggtcttgaactcctgacctcaggtgatccgccctatgcaatgattttcaatgcagagatgatctgtagtattgaaaacattagaaacaacctacatgtctagcaaagtagaatggataaatatattatgaaatactgaaatgaaaatgaaaaaaaccttgtctacatatacaagcatggagtatctcaaaaaaaacataaatttatacctgaaaaatgaagccaaactaagctacatgtgtatacttcaatatggtcattttgattatattttcatacatacagaatgaacatttatatcttaatatcaaactcaggaataaagcttaccttaagaaaggaagtttcatgtatttgtactgtttaatttcttaagatggtgatagttttttttagtgttacttataatccatgcatcttggtatgcctgtaacttttttttaataaaaaatacttcaaaaagaatgtctagtagtttaaagattcccttaacatatatatagatatatggagagatagatagataatatcattttttatgctgtattggcttaggtatctctcgagaatctaacgactcaataatttaaagtagcatttatatataagtgcttactgttgcaagtaaaatgtgagcctatcatttgtatgaaaattgaaaaactgtaggtttggacacttctgtgagatcacactggaccctcagatccttccttccaatgtgccatgcatctatgtacaccgacacctgaaaaactattaacccaaaatgtctcatcttttttgttctcattttataaaaatggtttattttatgggcactggtgaaaagtaatggttcaatgtataaatattgatttaaatcacatagcagcacaattctctaactttctaacatatgtgtaacaagatggagagtcatctgttttttgaagatagataaaaccaatatgttcatttaaaaatactgtactactgtatatacatgcccaaactactatggagactgtgaggggtaggatttaaaaggggtataagcaggctctgggatgctacttttgacttgagtgtggttacatgaatgtgtgcactttgtattaattcactgtacttcactcctataatttgtgcacttttttgcatatgtattgaataaaaagttaggaaaaggaggctcattattttatctttataatggaaaaaagtttatgattcagtaataagtaaagaagtgatttgtcagaataaaatgattacatcatcctttgtgcttagcaaaatgtttggttcattatatgctcccacaaaaagattcactgaatgaatgaatgcataaaccatgtaaaaaatatgtgcagtcaaaacatttagaagtaaatataaatgtagctaactgctaatagtgctgggtttgtgtgggggcgttatgggtggttgttttctctctttttcaaattttaaaataaataatggacttttaatgtcatcgtgggtgtagccagtcccataaggtgcttctatgatggaaatttctttcttgcttctgtcatagttatgcttcatagtgtgtgtatatatatacatatttctattttggagtttttcttaaaagtttgacagttagctgagaacatctggaccacctatagccagcccccatccccagatcagatcaaatggaattcccttttacctatatcatggaagctgcttatcatctcagtgatttttttcttcaagattattcatttttggttcttataactaggtattttaagtactggaaggcatagggttagagaaatcacatattaatgctgtagacattcatagtcctgcagactttttctgatgaaaaataaaagctttcatttaaagctttttgtctaacttctaacgttctcacctgtgatcaccaaatagatatgctctgcctgacacacttggcgtgttaaattttaaatttgtgaaggtttttgtttacttttaaataatcttttgaattaagatataacagccattcataacatacacaagtctgcagtgtccattaaaagattctgacatatgcatatacctgtgttactactacccagatcaaaaaatagaacaattttggtacccagaaggctccgtggtacctcctcacaatcagttaccaaccacctcccacccctgaccaaagatagtctatcagaattcagaagtcttttatcatcagaattgattttttcatgttattgaacttcatacaaacggaagtaattggtacatgttctattgtgtttgttttctttagctcataattatgtttatgagaaatatccatgttgttgctatgtaatattccattgtctcaattgtgaaaattaatgatgtgacttggggttattacagtcatacccaactagatgggagttaaggaccatggggaaaaagcactcaggtcacaaagctcctgctccaggaactgtctggcaagccaggctgcagaaataacttgctatatcttaaaacccattttacctagtaactgcttccatgtaactgctaccttccatgcctcaaagattagtttaccttccaccaagattagttttacctaccaccatcactcaacaattacagcttgccaaagctggaagaacttgtctaggccaatgaactttctttcaaaacattttacaaaacttttctcttaaccaataaaaccccaatcttttcttttgttctgtggacaccctgaagaccagccaggtctgtgtgtatgcaccaaattacaatttggtttttgcgtatatttccaaagaaaacctttctttgcatttgcatttctttgcattgttagacccaacttaacaaatgctttcatcctggcacataagccttatccacaactcatcataggtttgcaggagcacacttcatataaaagccacttaatgtggagatcttaagcttcccctcattgaaataatcacgtgcttcttttatcatcacagtttaaaaggcaggacagatgtgcctctctcgccaagaccatgttcccaaacagtaatgatggtaaactagttttatttttaatttaatatttttaagaacgggaatttccagtagttgttaaatcattatctgtttaagaagaatgtgaacttgaaataattgaggtggaacaagtccttaaagaatctcattatgactcatatatgagggtaataaggaagttaaaatgctcataatatttgtagaaaaaagtttggtgactatgtgtaaaataatgaaactgtactcaagtgagaatggttggtactacatgaaattaatcagattaacaatattgggaaaggagtttaacagctaaaaagagatttgagtttatattgttaaactgcacacgcatttttttaaatttgtgcaagaaaaatatgaaaaatacattgtttgaattaacttaattaacaaaaagtggcctaaaaagtagactaatagagaaattttcccaaggattaaagaataacctcaaatgggagagctgtatttaaaagtgagacataccagttatagactagaccagcagagggagctcaatatatttagccagtaaagacattgaagacagttaagattcttgttaagcagacacatatggaagaggataattacgtagttttattttaaatatgaattctcagacataaatatattcattaatgattacagataatttgagattccatcctctcaattttaattgactgccttagttgaattcaattattcgtattataagaacagaagtcagcctgtgcgacagactccgtctcaaaaaaaaaaagaacagaagtaaactatattcagcgtaagaagtgtgaataagtttaaaaaatacattaacacatatattagcatttttactgaattaaaaaaatacagcaatagaataatgagataaagttttgttgtagagtcgtgatagtggaccctgtgaataaaatacaacaacttaaccaagtgggagcaaaacattttatgattcttatgatagaaatatactaacaagttctaattttctttgtgcctatatagatgaacatcaaaatcacagctattttagctgataccattaaaaattaataaatattgaatctgatcattttaatggaaatgatatatgtttagaaatttggaagaataaaaagaaaaataccaaggtggacatgattaggtttgtaatacttaacttctgggatatttgaacaatgttcattgacactgcttgagactgtgaagaagtgagtgatagatgctcaaagtgatttcaaaaggaatacataatgatggagtatgtaggtaaggaaaggcttgcatgctgaaggagagaaataaaacttatggtgagagtgtgtttgcaatatcctgcaagcttttgcagaatgctattctataaagtctggctaaattgttaaggtaagaaatttaactggtgtagccatcttatagattgtgttataacagttttagtggtagactgatgaattatgtcataaaaaaggcactttcagaaaactggcaatctttaagtcttaatgggaaggaaatctgcctatgccctctcttttttccaagtcccttccctccctaccccataaagatgggtaagactttaaatctttccagctattgctgtgggaagtatttcatggacgcaatcatgtaaaagaaaaatatagagaagtatatttccaggtttttaggattacacatgtatagaaacaaaatgagaaaattgccagggctggaaatacaatttgagaagcctaaatagaacaaagccaatagtgattccttcaactgtggattttatggactgaatatgtacaaatgttgggtataaatcagggccaatttttccacaagaatctagaatatatcaaagtctaaaacaggattatagccactttagagaagaaattgcaccagaaccagactgtttctaaccaaatgacatacgtcttctctgcgtttacattcatatacacacattcatgttaacttagattgtatcatattgaagataattctatataatgcctccaaatttaaattcagttcttttccacaaatgcttattgtagttaagctatactaactttgaatagaatcacagagatgctggtaaatgacttatattgcatacatgagggaaacagctttttttttttaaatgatgcctgtataaagcctcttcctgttgagatagattccaacacacactcacacacacctctacacacacttacaccctcatatatgtaaaaatttgcatattagattgtttttcctagaaaatttactacctatttactattctaagtaaatagaacataattctctaatattggttttttaaactaataaatccttaagtattttatatcatcttttagttaatattaactttgagaagtatcacaaaccatacttactaaatttacaaagacaattctagctaatttaagaatcatcatctatacagtttcaaaaaaaataaaattggctgctagacaattttatagatgttcagtggttcatgtgtctatttctgcattttattacagttaaattgcccaataaaagctaaagggcaaagcagagataccatgtgctctttagaaaaagctataaaatttaagacagaagaaatttggtctgtaatgacaatttttatgtttttctggctttaataacttgattatataaaatgttttcaaatacagttgataaaatctataagtataatgttttggcaaataccatattcatttgaaaaagtaatcgaattgaatatttaaaataacattataaacaaatttgtaagtggggtacagagtaaacatgtaagtatttactactctgcttatgtctggatattaaagattattggaaaaaaataattgctatggtgacattttagcttttaatttgaagtttaatattagattgttgaatggagaaaatcaatgttgttttcacttatatttatatactctaatataccatctctaactgaaatgttattacctgcaggtgactgtaatttaattatactattaattttacattttaaaatcttgttatactaatttgggttttaaattacataaaatgttgccattaatgtaattacagattactctagtgtgaaacttgttgcaaagtaaaatgcctaccatggtcgtctctgcgatagagccaaagctgttgatgaatatgttgcatgtgacattaactggagggcctgaaaaagagatgaaaacataagggctgtttagagacttatctaaaacattttcaaataattccttgcattccattattattattccattttacacacacacacacacacacacacacacacacagatgcttaaaattgaagcaataattccacacaacaatatgtactgagaatcacaaggttcacaaggaacactgatgctgatcatttttttacctctcttggtcttagtttttaaaatctagatgtctctaatggctctgtaatgcctgatgctgtaagtccagtttctaagctcattcagggatagtttctattgatcttttccccgctgcatgggctatacttttctatttctttgcatgtcttatatttttttttgttgaaaattgaatactttaggtaacataaagtggcaactctggaaaccaggccttcccacctccaatccaaagtttgttgttgctggtttttcttgcagttgttgtttgttctttagtgacttacctggaccaatatggtaaagttttcatttccctagagtgcacagccagtgaaatctccatttagtgagcttagtggtaaactaatatttgattagagatttctttaaagccttgagccaataaatcttccactcttgccaagggtcttccatgggtttggggacatgtcttcagtgctcaggcagtttacaactctaccttacccttcacttcctgcttgcacagagcctgatgtccaccagaagtgagatactgggactctctgaggacttccctggacaggcacacagccctatgtgcatatgtaaactccagattgcaaggatatgttagagcttttcagagctgcctaagaacatagaattttccaggtcctttataatttttgttcaggctcttacttgtcccaactagtgtcacagccttaggcagctacaatgttaaacaatcttctaattattttccacaaatgccctagagatagaaatttttcccaccaagtgagttcttagtgaagtcaaataatggaaagctctttgagtgaggctcttccagggagctaccagacaggcagaatactgacaaagctctggggatggaccttctgaggaattccaaacttggtcagccagctctggtggttttacaacttctattgtttaggggtggctggattgcaaggctgctgtggaactgggaaggtcggtgaaattaatatcccttctgttcttacagaaattcatcagtttttcttgaataaacactcttcaggttgttgtaagctttttatcaattttaaaagttctaacggttaatcttgacaattttgccaatgtttttgttgcttttttggagaagtgaacttattgagtttctcactcctccattctggaaatttcttattaatgcccgacttagtattcatcataaatccaaggatttttatttttataaggcccatttattcattcctttactaaatatccaaagcctttgcacacaaaactgaagaagacacaaaaagattatcatctagcagagaaggaggagcagaaattggtaaattgttgtaagtttcttgctgccaggcactaccttagctgattcatagatatttaatccatagtaactctgaaagagggaaatattccatcattaacattttagggaattaaagcacagtgaccctacgtaagatgccagtaggtagcacatttagaacgtgaaccattgctctgattctagaaatcattcttttcccaccaccttgtttatatgaccttcaaaacatttcattatctggccacaaactttgttattaggcagatacctgtataaatagaaacgtaaaaatattttgtgctaggggctaaaatagctctgagttacactctatgtaagttagtcggagaacaccacatacagaaactaatatctaagactaatttctttgtttttttttaaactgagcgtaatttttgagtaaattgatcttacaaggtttgctacaaaaatgcctagtagccccttgacttatttctgtttccctctttttcagagataattacttcaattcatttaatcatcaattcttcggatatttacctcaatttctctacataatatgttttttcttttagacacatcttctgatgcccacaaagaagataaagatttagccttttttcatacatcatccctatctctactaacataagccttttttctgtcttcctgttatccaatatttttgtatgaaaaaaggcttggtcttttttgttagatcaatattcactttttacattaatatgacaaggtagatatttaccccagccaaacaatagaatatgttatgcttactttttcctttcctgcagaacattttcctgatattggcaattgcttcatatataatatttcacatagctttctccacatgaatcgttaacttatccacaagccctgaaatgtctaagttttgattcaatatgtacagatccatcaggttctctatgaactttaccttcctctggatttacagaggaatgtaatgagaatgttttgctctggttcaaagcaatcgttctatgacctcccaatcatgctaggaattacttccatagctttctgttgtgggatcctcgttcatggtcccatacttctttcttggtttatttcttcattttagtggaacatatgctccagtaatgttttgacaaatgctgcataaggctatgaagcttttgagagagtccttgttcatcaatgtctgtttttttgcattcacacttaatgtatagctagagttggtagaaacttttaggctggaaatgttttcttcttatgaattttgaagatactttttcactattttctatttttcagcattgccattgaaaagcccaaagccattttgtagatgacctgtttttctttctgaaaataaataggatgtttcatttgttccaatattttttaaaaactatttcattagttagaatggtctaaaatatcatttgaagttgcaatttacatttatttgattactggttcatgattttcatcttaatttgcttttcaacctattctctagatggctatttatcttgctgaattaaggtagaggaaaaatcaataaaattatttaaaaataaagtttaggtttcaaaggcctttaaatcctatactacacattgaaatcacctggcaatctttacaaaccatagatgcttaattctcacctatgttacttggtatggcatgcaaccaaggcatcagtatttttaaaagcttcctaggtcattataatgtgcaagaatgcttggaaaccactatcctaaggaattacagactagaaaatatctggggccattatactacagggttatcagagattttcttagaaatagaaaaatacagagagaggagtcagggcttgggagcattgaaaattccaggctattaatttcattaaaagcgttgcctattataaattcggtgaacactgttaataaaacagagtagatgctatgtactttgaaagggcctaaagtttactaaacataggaatgtctagaacacataattcaaacatgtatagaagttaaattgttttaaatatgaaggatgaacatgtaataataagaaccttataaaagacctgcatcctaggggcgctgtatttagttactaatgaacattttaaaatatcttcattgcttatttctgaacatttacaaatttctaaaatttgtaagatgagagcagtgtgttatgtgccactatgtgggagaggagtaaacttagtttactccatgattaaaacaaaattccatatatacaccatggaatactatgcagccataaaaaatgaaagagttcatgtcctttgtagggacatggatgaaactggaaaccatcattctcagcaaactatcgcaaggacaaaaaaccaaaaaccacatgttctcactcataggtgggaactgaacaatgagaacacatggacacaggaaagagaacattacactctgggaactgttgtggggtggggggaggggggatggatagcattaggagatatacctaatgctaaatgacgagttaatgggtgcagcacaccaacatggcacatgtatacatatgtaacaaacctgcacattgtgcacatgtaacttaaaacttaaagtataataatgataaaataaaaaaataaataaatgaaatttccgtcctaaaaaaggatgaggttacaactgtcagaagataattttttcttaatgtgagtctaatatgaactctgaaaagtatctgtaggctgactggcatccttgaaaagctaaaaccaatctttcatattttctaggttattctctttttccaccagataatactagactcctactattttctttttttttttcttggaatagcaatatgaatctgagaaacattatttggcttgagataaattctgtcatgctctattgactcatatcctctggaaaaaggaaaacataagaacatcagtattgggttaattcacctgtaaataaaatgctgatggggtacagccatgttgggggaacatggcccaggaggaagctactattagaccactgctagctgcacctgattgggatctttttggctgaaacggaaataaataaaagagtggggagataatttttcttattttagtttagaaagggaaggggtctttatttcttggattttagtttgtcacaggcattgaataaaggatgaggcattctctataatacattttgtctcgtcttttaaatttaattagtttctatatatttatggacaattgtggtgaaagaggcaaaatggaggcaaaaattcagcataggcttcaaggttctgaagttagtgaaatctgtgctggcacatttcagtgtcccttgggagcaagtgttatgtggcacatcctaatgagtccattaaggttctgaaaggagcagtgttaggtaccgtctttggaggagcaaacttctgatatatttgttttctttctaaaatatggtgctgacatccctggttgaccagaggctcaaatagtaaggccgatggatgaaatacagaaaataacatcatttccacagaagaataatggtcaaagaattgactaatttaggctttcactaataggtgggatcataatgcctcattgtatttgaaacagacttcagcctcagcctccataacattcctccaataagaagcagaaagctcttcctaaaggtgaaaagttgcctggcttcaaaacctaaatttcacgtgcaagtaaagtaactcacaatggtctcaggcctaaactttattctccacctggttataacatgttccttgattggatgttagaacataaaaaagtgtgatttggttcccatttgactatttacttgtgtatatattttcttcttcagcagaaagaagggtgaatgaatttggacatcaaatcctaattccaaatttcaaaactatggtagacacttacttgaaaggcagatagatagacacatatgcataaataagaataacttaaaattttaaaatattcaaataaaaaacagtttggaaataaaaatcatttcagatcatagagtctcctcaatgtaataacaaggtatttgggatttactttaggaaagctttggagccataacagattcttaaccttggaagtgtaggaactaacatgactcgtgaatgtttgcatgaacaggcaaaagcatagagacagaaaaaacagaaatttatgataatagtctgggatggggacagaatggacctgaccccgaaggacaatgacagtccttggagatagattacaaagaatgaaatggatacagcatcataatattttaaaggtatcacgttctaccccttcggtttctggtgcacatgagattagtgcagcaatcttggagtagtctttctatcctagctttgaaatagacattcaaaaattgtgtagagaacgaagctcagagaagattatgaatcttctattgccattacagagagcacctgtttagtagctcttggccaatctgctacttctctgtgccaatgcaaaagctgttatatctatccaatacactcctatgttaagcaacagagcaaataactgctatagcatccatatggcaaattgtgcttttaaattgttcacgactttaggcatagtccttaaaagcaaatgacagtagttgcagatgttttcagcagtaagttttcgtttagatgttttttttttttaaagaaatagaagatggcccttaagtttaagaaatgaagtgatggcagaatagcaaagtacaatgcaaaatcttggcaacgatattattgttattcatattggggaaaaattgttcactaggcagacctagagcaagtaagaaaacaaacaaacaactcatatgttcataaaaatgactaaggaagttttcagggagtgttgtattaaagttttatctttttaaagacacagaatgcaactaaaagattaaatttcaaaataattccaactagagacttgttttattttagataaatgcacacacatgtcacaaggagagacgttattttattttttattcacaaagcatatttgatgacttaaaatccagattttaaattatctgttaggtgctttaaaaaggtttgtaaattatggcatagaagcagaatcctgtttgttcttcccctttctctttcccttcccttctcttcccttcccccaaatgctgcactaaagtcatttgtttgggcagtgcaaaataggcttaagtgctgggatggctgagggggtcgtagtaacctaaggcaggagagaaggacattgtggaaaagctccacatgcaggaaatgttggaggtccggtgagagaggaaaatgtacacccacaatagggaagcctgttgttgggtgttagaaccatagatgggcaaggtgtgtgtctccatggggccatcctggcttgcagagttggagtctgaacaggcatctacacaaggagatgaacctgaggaaggcttcagagtcccaccaggccaaggaaggtacttgtgtaaaagaagaagtagcagcaaacaagggagattcattacatattgattaaataagtaattatattgaggataatgggagcctggtttcttgctgttggaagaggaagttaaaatatggaaacttagaaactagactaaacatatggtattgacagtgtgaattcatggttttcaatagatacagaagtatagaagaaaatcgatgtgtaaatgtatgtgtgtgtgtatgtgtgtgtgtgtgtatgtgtgtgtgtgcatgcatatgtgtgtgtttatttatgcttatatgtgtgggtatatatagatatatcctggcaggcaccaacttaatcaggtaatcataacctgtaatggcaaaatctgacatggtccaccatcaaatagaatgcagtcaaaacacatcatcattcctgtaatatccctgctaaatgcactacctaatttgaatcatgaggaagaatcagacaaatgcaaagtgaagtatattcttctaaataactgaataagaatatttttaaatgtcaacatcatgacagtcacagaaagaataaagtgctggttcagactgaaaaagacaatgagaaatgacaaataaaatatgatgtgattctaaactgaatacttttataataaattatcagagagtggatgaaatttgaataaagatcagcaaattagaaggtagcaatctattcaactacttttcttgttataatggttagattgtgattatcaaggagaatgtttttatttgtagtaaatactcaagtattggggcatcaggtcaacaacttacattgaagtggttcagaaaaaaagcttttgcacttgtaacacttctgttagtttgagattattgtaaaatacaaaaaagagaaataattactacagaaataattaattaaaaacaaaaagcaaatacaaacaaaaaatacagggtttagaatctaaccccatcaacatttcaaatgaacatgtatagttttagaagagcttattattcaagagatacttcttgttaaagtgacctcgtactaagtaaaaatgcaaacagaaatgtaccattttcaaaaataattgtaaatgttattcaagaacaatagtgtcttggtggataggaatagtaaaaatgggtaaaggagacctttaaaatgctaacatttaccctaataaaaatgcatgtagaaaatgagtttgggtacacatgccacccttggcatggatgttgttgtagaatagagtactagaaagagtcaatttgtgatgaagggagaaaaggattagtgaaatatttaagggtaaaagacagaaaccacaaatacatcgtgagggcaaacaaaagttatatctacatacaaagagagtggccattggagataacataagaaaacaaaaatgcaataaatacttgggaggaagacagaattgggtgattactgaaggaatactttctgaagttgcacttatgagtcataagagggaccccaagattaggatcaaaagaaagaagtaaaatccagcagtggtgggtaaaatattctagtgaaataatgttttgttgtcttataaacatacttttacttgcaattcaattgttttatgttaaacatgcttctagtttcagatgacaccttgaagcttctatttcaagacagagaattgaacgtcattttctttctttctgaagacataaaaatgacattacataataaaattttagtgagaataaatgtatcataccaaaaataatggaaaaaaaataataattagtttaatgacataaaatatagagccagataaaaatggttgacaaatgaaacagaggtaagcctaaaataaaagcaagcagggactgcatggagaggggaaggaggtggagagtgagaaggggaccccagggatagggcctggcatctgtcttgagagctttctgcttcccctctgtatttctgttgagcaacggttgcctggtatttagccctatggaatttttgaggaaatggaaataacttctttgatgattagggcaaacacagtacctgaaaatacctcaaaccttaagcctgctctatttcaccatctgcaggacccaagaataatgcctagtcgaagctcaacactcacctaaagcaaagctctggccagggcaatgcagcctgtgtcagagttccctttcgaagtagagaaataacagaaaaatggccctcctatagcacccaagctaatcacccctcaattcttcctgaatcacagacattctatcacacataagaaaactagtggtttaaagagaatgaacaatataaataaacataatttatcctgcaggaagaagcaacaaatcattgggcagagaagaaaaacaaaaggggcagaatgcaataaaagacgcattaaattagcagtctacttagtgcaaaggaatctcgtaatgcctgtgttgtgaaaggcctagaaagcaatcaaacaaattagaacagacaatcaacagaaataaccaatttttttggagtgtttgcctcaaagaagtagaactgtgcatcgttagtgttgagggtgaaccgctgcttttcatcattgacacttgtagacatttttttagcagcttcagggacatgattgttactattgtcataaataaaactgacaagcaaataaacatacaaaatagcacctgcgtagcagcttgtaacacaacgtccacaacttcgcattcaaggaaaatggtttaagataaagaggattgtgaagagaccaaaacacaattacagagttaaaatctccctaaacattcacaaattggataaatggcaccatgtaactgaggacaaatctgaacaattctgtttataatgtagagggaaaggagaaaggagagaaggggatgagggcaatgtgttagacacagatgactggggaagatagcagattttttaaaaataaagaatattgttttacagaaatgacacaaaacagtgccagcataagcaaaaatcctcctactgaaaaatgtccagagataggcagaaaaaaatagcctatatataaaggagcagaaatcaaaatgagatttgacttctttatgatattaaatgtcagtaggcaatgaatcaacatctgcaaacttctgagctagaattctggagctcgataattgtataaagtttctttaatgtcaaatgcatacaaaacagattatcctggaatattattcaatgatgaaaagaaatgagctatcaagccacgaaaagacacagaggaacctgaaaagcatattgctacctgaaagaagccaatttgaaaaagtctacatactctatgattctaattatatgacatcctggaaaaggcaaaactctagagacagtgaaaagatcattgattgccagagactgggggtagatgaggggaagtgggagagagatatactcataccacaagcacaggagattttagggcagtgaaattattctgtatgatacagtaatgacaaacacacgttgttatgaatttgtcaaaacccataaaaaatgtacagcacaaaaatgaactctaatgtaaattatggatttcagttcataacgtactaatcttggttcatcaataataataaatataccacatgaatatgaagatgccaataacagggtacactgttggggaggagagggcagatatgcactttccaatcaattattctgtaaacctaaaactgctctttaaaacaagtctattaatttaaaaaagtcagaaaaaccagaactcagaaaatatataagcattactcctgtcttgaaaatgaaaacctattttattttattttattttgtttttcagcaaatggagacaaagctagaatatcctactgtttagtcttcaagttataatttatatgtgtgtgtatgtatgtatatatatatataaagaaactaccagtttcaaggattattaagtcttcccttaattcttaacctggccctccaactctgtaacatcgttaggcagtgcctcccagtgagcgccaaggcctgtggtctgcgcctggggatgtggtgctttctctcactgggccggttctgtttctgctcttttccctaaccagaaaggcttctaaagagaaaagatttccaattctgagaaagaaatggtggaatctacctattattttcattttcaaaataaaaataactatttcttttcttttctttttttttctttttttgcttttaccatgtctcatatatttttctcagccacatcatgggataaaacaataacaagctaaccagatctgatgtgaggttggtaaaagaaaaaaaacacaggggggatgagccaagatggccgaataggaacagctcctgtctacagctcccagcgtgaccgatgcagaagacgggtgatttctgcatttccacctgaggtaccgggttcatctcactggggagtgccagacagtgggcgcaggtcagtgggtgcacgcaccgtgcgcgagccgaagcagggcgaggcattgcctcacttgggaagtgcaaggggtcagggagttccctttccgagtcaaagaaaggggtgacgcacctggaaaatcgggtcactcccacccgaatactgcgcttttccgacaggcttaaaaaacggcgcaccacgaggttataccccgcacctggcttggagggtcctaccccacggagtctcgctgattgctagcacagcagtctgagatcaaactgcaaggcggcagtgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagacaaacaaaaagacagcagtaacttctgcagacttaaatgtccctgtctgacagctttgaagagagcagtggttctcccagcacgcagctggagatctgagaacgggcagactgcttcctcaagtgggtccctgacccccaagcagcctaactgggaggcaccccccagcaggggcacactgacacctcacacggcagggtactccaacagacctgcagctgagggtcctgtctgttagaaggaaaactaacaaacagaaagaacatccacaccaaaaacccatctgtacatcaccatcatcaaagaccaaaagtagataaaaccacaaagatggggaaaaaacagaacagaaaaactcgaaactctaaaaagcagagtgactctcctcttccaaaggaacacagttcctaccagcaacggaacaaagctggacggagaatgactttgacgagctgagagaaggcggcttcagatgatcaaattactctgagctaagggaggacattcaaaccaaaggcaaagaagttgaaaactttgaaaaaaatttagaagaatgtataactagaataaccaatacagagaagtgcttaaaggagctgacggagctgaaaaccaaggctcgagaactacatgaagaatgcagaagcctcaggagccgatgcgatcaactggaagaaagggtatcagagatggaagatgaaatgaatgaaatgaagcaagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaagatatcatccaggagaacttccccaatctagcaaggcaggccaacgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagtggatctctcagcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagctgctgcaaaatcatgccaaaatgtaaagaccatcgagactaggaagaaactgcatcaactaaccagcaaaagaaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagcaaatggaaaacaaaaaaagtcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccacattcataaagcaagtcctgagtgacctacaaagagacgtagacacccacacaataatgatgggagactttaacaccccactgtcaacattagacggatcaacgagacagaaagtcaaaaaggatacccaggaattgaactcagctctgcaccaagtggacctaatagacatctatagaactctccaccccaaatcaacagaatatacatttttttcagcaccgtaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatagaaactgaacaacctgctcctgaatgactactgggtacataacgaaatgaaggcagaaataaagatgttctttgaaaccaatgagaacaaagacacaacataccagaatctctgggatgcattcaaagcagtgtgtagagggaaatttatagcactaaatgcccacaagagaaagcaggaaagatccaaaattgacaccctaacatcactattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgagaaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacatgctctgcaattgtggcaataatcaatagcttaccaaccaaaaagagtccaggaccaaaaatggattcacagccgaattctaccagaggtataaggaggagctggtaccattccttctgaaactattccaatcaatagaaaaagagggaatccttcctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctctataaattaggtattcatgggacgtatttcaaaataataagagctatctatgacaaacccacagccaatatcatactgaatggggaaaaactggaagcattccctttgaaaactggcacaagacagggatgccctctctcaccactcctattcaacatagtgttggaagttctggccagggaaattaggcaggagaaggaaataaagggtattcaattaggaaaagaggaagtcaaattgtccctgtttgcaggcgacatgattgtatatctagaaaaccccattgtctcagcccaaaatctccttaagctgataagcaacttcagcaaagtctcaggatacaatatcaatgtacaaaaatcacaagcattcttatacaccaacaacagacaaaaagagagccaaatcatgagtgaaatcccattcacaattgtttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcctgaaaatggccatactgcccaaggtaatttacagattcaatgccatccccatcaagctaccaatgactttcttcacagaattggaaaaaactactttaaagttcacatggaaccaaaaaagagcctgcatcaccaactcaatcctaagccaaaagaacaaagctggaagcatcacacgacctgacttccaactatactacaaggctacagtaaacaaaacagcatggtactggtaccaaaacagagatatagatcaatggaacagaacagagccctcagaaataacgccgcgtatctacaactatctgatctttgacaaacctgagaaaaacaaacaatggggaaaggattccctatttaataagtggtgctgggaaaactggctagccatatgtagaaagctgaaactggaacccttccttacaccttatacaaaaatcaattcaggatggattaaagacttacatgttagacctaaaaccataaaaaccctagaagaaaacctaggcattaccattcaggacataggcatgggcaaggacttcatgtctaaaacaccaaaagcaacggcaacaaaagccaaaattgacaaatgggacctaattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagagtggcaatcattaaaaagtcaggaatcaacaggtgctggagaggatgtggaggaataggaacacttttacactgttggtggtactgtaaactagttcaaccattgtggaagtcagtgtggcgattcctcagggatctagaactagaaataccatttgatccagccatcccattactgggtatatacccaaaggactataaatcatgctgctataaagacacatgcacacgtatgtttattgcggcattattcacatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaccaaacaccgcatattctcactcataggtgggaattgaacaatgagatcacatggacacaggaaggggaatatcacactctggggactgttgtggggtgcggggaggggggagggatagcattgggagatatacctaatgctagatgacgagttagtgggtgcagcacaccagcatggcacatgtatacatatgtaactaacctgcacaatgtgcacatgtaccctaaaacttaaagtataattaaaaaaaaaatacaaaaaaaaaaccaaaaacacaaagaacccctaataacatcaaaacttagatgcaaattcactattcttaccaatgacctgtgcctaagtgaacataaaatcaaccatttctatacataacatttctcttccttaagaccaaatttttgaaataatgacttggacaaaattctaatttctattgcatgatcaactggttgagtgatattttcagctttactttctaattctttttagcagctctcagaacatttctaaacccatatatcattattaaatgccttttaaataatagtttttaaaatcattatatttaataggactaagatataatagaaatttgaagtagtttttatacttatgtcaaattatcctaaaggcacaggatcattagtggagaaatctgattctcaaaaatgtttcagataaattaatactattctggaggggaagagaacagattaatcagtgaaaaggaaagataatgttaatgagttaagcacctaattattttaacttatttcagtattgatttaaataatgttcgatggaagaggctgtcttatccatggtcaataccaatttaaattgctttaagagaattatttatttatacttttctgtggtacattttaataacattaaactacttagtcttcaagaggtgagatttttttaaagtgtactttttaaagagaaatgacaaaacaataaaaacaaacaccataattttggttaagtaaaaaaatctacttctaaatttttgtaaatgttagaagtagaaagcagcaaaatcaaagttgcatttttacaaagtcgtttgtattttttaatagttgttttcccactatggccttcaaaataaattttctttcaatataaagatacttgtgaaaacaatcacaaattttatactattactccagaaataaattcataattatgtatataatgctggaacatttcttatttttaaatatttgaaaggcaaaaatgttatattactgttatacactttgcttttggctaatgagattaaacatttccatttcgtttctgttaattgtctgataatgtccatactgaaattttatgtttgccttttacaaaactttgaagtccagagagggcaaacagataggtattttccaatgctttcatattttataagcacctttctatcagctgattacttatctaggtaagttatgtttctgtgtgtttaggaagaagtgaggatcaaatcatttaggttatagtaatatatttttacatatatcacaattcccattcttcttcttttttaagagatagagtcttactgtgttgcccaggctggagtgcagtggcacaaccatagctcactgtaacctcaaacaactgggctcaagtaatcctcctgcctcagcctcccaagaagccaggactaaaggtgtgtgccaccatgcctggctagtttttttttttttttttttttttggatagatgggtgtctcagagctggtctcaaactcctagcctcaatcaatcctcctgcctcagcctcccaaagtgctgggattagaggcatgagacccattcttcttttaaaattattttagctaattatgctcatttttaaaattttaatatatattactgatattcatgtctctaaacttgcttactattaattcattgtctttgacaattggataggaaagcatacataacaccaattttaaattagttcatttgatgagctaactagattccttccaaaaacattgatgtggggaaaggcacaaaatcaacaaggcaagggattgtatttttagtcatgtgaactaccacagagaaaaaatgagtgcaatattatcaggagaacaggttcttcattttctacatctatgtttgatgagcttatttttgcctgaggtgaggtgggcccctaggtacatgacgacacaagggctgatcattctcacctccttttgtgtaaatgtcttctgttaggtattggattcagtttgttagcacctaaatatcctcctgatagccgtaaggaagaaatagcatgtaaatactattttatttatatttcaatattgggtaatgaaatgatggtcaaaagatgatgatgttattttatccaatgaaatgacacggtgttgaatatacttaattagggagtagagttataagtatgtttgctgaagtcaataatgtttgacctttgcaaaagatgacaaagcaaaagtgttagctaaaaactaatccattaaattattactttttataattgatattatttttggctatcaaatgcagcctgaattttttttctaatgttcagagcacaagatattttgaaaaacaatgagagaaaatcttcctttttctttttcttcctttagtgacactggggtgtaagaatgaattttagtctcccccaaaatctaatcacctctgaactggcttggtgatcagcttgtttttaggaatacatttttacttagaaaagaatcagtatttgttttaagcaacaccaaatccttgggggtcctttcctgatcttacatataaatagtaataatcacatttttaaatagtttaatgtttctgttatcttttaaactattaaaaaaataaactaacactaaactttccaagagaatggcaaaagcactgaggccactcttgtgtggttggtaacttatctgcagttttattaaaataactgctgagactgtttatatgctttttaaatattcacagacatttaaaaatagaatgcattttcttctttaattttcagttaaaagaaagaaatacttctgaatcactgaatatggactcaccataatgaatctgctaattcccgattatgtgtcttgtggtttagttaaatgacaactgcatatttttgaagatcaactactaattagttctcagcggattcacaggaatactgctttccctcaatttggaaaagatcattataatactgaaatttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtactatttttgtttctcattttcatttgtatattgtaccctgtaagctgtgctatttttgcacaacttgtactcagtgctttcctcctgaagttgaaaatatttatggttgaaagcttaaaaacaaatcaagacatgtgatccacaatttaaatattaaactcattttaaaattgaagccattcataattttccactcagacattatcagtgagttttacttcttttgttcctgctacccaatcttgatatttttttactccattctagttatttcacccactgctaagcatttctttttttcttccataaggacaaattcaaggaaaaatggtagttatagacaacacttttttaaactttagcaatgaaacagcttaactgaatcccatgaaaaaagtgtatgttctttaactttgtttattttctttattgggtaaagtaatattcaagaacatgttaaataagttgggatctggaagcagctttctaatattttaccattaaagtgaaattacaggatatattgtggttctggataagttacatatccttatataaacatgttacttacaactatattaaacagaagaataaaaagtggtactcttaaataattgacaattacactctttcctagaaatttgggtaaaacatttggtaggtgcaataatgtcttatacatttcaaaggctgtcagttagcaatccagactgtttcccaataggtaaattcaacaacggttagattccccacaatatagacagtagtaaagtggctgattaaaaagatgggaaagtttatcactagcaattaaagaagcttccattccagttagataactgatagaataattaaataaaggatacgtacatatatgtatattcctaaaatcaatggtcaagacaagaagtattataacagttagagaagtaaaaaaaaaaaaaaaaaaaaaagacatagctgggccaaagaaggcaaattatgataattgagaacatgggaatggatttctttttcaagacaccttggtgactaatgcaatatttggaagattgttgaaaataagcattagaatttctggtggaattaatttaaaactgtaccttgttgaagtatatttaaaacacacatataaagtagcaaacagaacaattacctttaaaattgggtctgattcttgcatcatatcctgatgtcctgcccattaatttatccagaaaatcagaaggtgacattggagcacttcgagatcttgcactgtctgtttcctttgtggcaaccaaactacaaataagaacaaaaatatagactttacaaaaagaagtatttctaataattgttacctacaaatataaaatagaaatgctgagctaaatatctttggcaacaaaacataaacctttagatatcatacagtgaagattataataagatagacatttatagatttatagtcaatacttgtaaggtttcatatctattcagtccaattgtcagaggtggcattcttttgtattagacctgaaaacaaaggccacttccaaaatattaagctttcaaatctgtgtttacaaaagccttatttctgatagcaatttttaaccaaatgtatccttattgctttaggtgtaagaaaacattaaaattcaactgtgaactacaatcttattgcttttattgagggaaaacatctcttttcaggttttgtgaattattcttagcagtaaaaaacttctgtctaataaattaaacaatgtttttttcttcaattagagtgcttcctgaattagcaacacacaaagttaaattcattctgcttttacctacatgtcattagtctacaatacctttcgttcagatctaaaatttgtgtgtcaagattgagaaattgccataaatgtaccatgtgcacctggatattatattagtagaacctgtgtccaggaaaggtagtgtgttcctatattcttttcattcaattttttcctttgtgtccagccacttatcctagaaacccatagtgtaggctgcttctcctgtccagctcttcacttacatagccttctccaacagaagctggggcctgcttgttaagatcaaatgattctttttatccacagagttttgctcaggaaagtgacactgactttctggaactgatgtgttcaagctgatgtcacttcctgaagatcatcaatcatcacatgctcccagctctgtcattcaactcaggacattgccaaatcaaaccatttgggtcaccacatgatcataacaagatcagttattaaattccttagatttctcctgccagaattttagtgagaagtacaactggggcttagagccatcatcattaagttgtttaccacagggatatatgcagtgattcatgggcacagttttaaaatctcatcaatcttggtgataatatgagaatgagatttctgtaagcacagaatcacaaataacactatctattagctgttgccctgttctagaggttctgtctggttctgggcactctgagtcacttgtttccccagtgactctcattctgtcattctcgctttcttccagaatggaagcgttttttctccctattctgttggctccatgtgacttcgtgatcctttatctctgattattattgctcaaccaaactgtcattgtgatcattgggaagtttattctaatacaaaaatcattataataataaatatatttttttaaaaaaacctatcttctcaatgactctagagctttattctaccatctggttttaagtaactttttcctctcctatcaagaagcatttgtttatattccatggttcaagaatagtgtggaaaagcatcgttggattttgtagctacatgctgctgcttttaaaccattctctttatttcccttgcaaaatctctcctttcaattatcagaaaataaacttctacctcctcctaccaacaaatataccaatttatcttgacctgaaccaataatactctgcctccttctcttttaaaaatactagacgatggccgggtgcggtggctcacgcctgtaatcccagcactttgggaggccgaagcgggtggatcacgaggtaaggagatcgagaccattctggctaacatggtgaaaccgggtctctactaaaaaatacaaaaaaaaaaaaaaaaaaaaagaaagaaattagccgggcgtagtggcgggctcctgtagtcccagctactgggaaggctgaggcaggagaatggcgtgaacctgggaggtggggcttgcagtgagccgagatcacgcgacggcactgcagcctggaccacacagcgagactccatctcaaaaaaaaaaaaaaaatactagatgactatgtatactgaaccacaatccttcacattgtgcacagaatgtgggaacgttatcctagattatcaagggcagttctatatgcaacaacatgtaaggatatatgtatgtataaagatacatgaaacagtatccttataaggatatttatccttataaaaaggaggcagaattatatttgatgacagacagaagagggaaggcaatgtgaccatggagacaggaattggggtgacgcggccacagcaaaggaatgctggcagccaccagaagctggaagagaaaaggaatggattcttccccagagtttctggaggtagcacggacctactcacaccttgattttgacccagtgaactgattccagacttctggcctgcagaactgttagagaatagatttctgttctttgtggtaatttgctacagttgccattggaaacgaataccaaccttctattgaatttttcatgtctgtcatgctgcttttcaaccccagaattactctttggttctttttttataatctctatctcattatttcctttttggtgggacactatcatactttctttttagctctttgtacatggtttcctttaatttttaaaatgtgcttaaaatagttgatttgaagtctttgtcttgtaattgcaatgtctttgcctccctaagcatgcttctattgattgcatttttcctgtgtttggtccatatattttcgtttctttgagaaacttgtaacttttattgaaaactggacattttaagtaatatactgtggcgactatggaaatcatattgtcttttctccccagagtttggtgttgttgctcttttttaaatggacttttttgaactaattctgtaaagtctactttctttataatatgtgacaattagaatatctacttggttagcttagaggtcagctactaattgaacatggattttattaatttctagaaccaataagtgactcagtatttgctgggggttctgtgtcatggggtcataccttcaacactatgtcaggcagttgattactctggactttactttcacttgtgtgaggcctaaaagtcagccagagttgagcactaagggtgttttcaggtctttcctgagcatgcacacaaccctgggtgtactactttgctagtgctgccatgacatagtatcaagaacaggtggctaatgcaacagaaattaactttcccacaattctaaaagtccaagatcaagttgtcagcagggttggtttcctccgaggccctcccttgttggcttgtagatgtccattttctgtttttttttaatgatcttttcttcacgtgtgtctgttctaacttcttcttataagcacacaaggcatattggattagggcatattgttttacatcaattacctcttggtaaggtaacagaccttacctccaaataaagtcatgtctggaggtactggcaggtaggacttcaacataggagtgttgggagaaaaaaattcagcccatacgtgtggccttccagataaccaggaatatatgcagtttttccaaacccatatggacatatcattccaatgctttccgtttaacatttttgttaagtatattgtgtgcccacactattactgattgccttaggcacctgtgaagttaaaaaaatgactctaaatgttttaaacaaacttcttcaggaaaaaggcttttggcggtgggtgaactccaagttaggtcacagaaaaatagatttgcaaatggggtcttccagaaaacctgcagacaagttaaataatgatcattcttaaagaataaggccttaaaggagttcagactccatgctgtcccctctggtggctgccaggttgtggacttttcctgtaatttggggctattggtttacgttgtcaccacggagctgaagagagggggtgggaagttgagcaaattataatgccacaaatcccactgtttttactaagagaaaaatgtttttcttcaatatacaacttcaggaatcactacaagcctctgattaattgtcagacttttgaaaaagttgattctcacaattatttttttgccagttttcttgttgctttcataaagaagagaatttatggaggtccttactctactatgtgtttcttactgtattatttttgctgatgtcactctctaataatgccttcctagacttctttttatatttgttttactatatctttgctttaaataaccatgtccctcacagctccattctggagctcttccattgctctctttgtgagtaattttatttactcccatggtatcaactgcataccatgataccattttgcaggcctttcaaaaaaatacctgttttcttaagtaatgtcaaaatttacattcatttatttatttatttatttatttatttatttatttatttatatttagagacagggtcttgctctgttgcctaggctggagtgcagcagcacaatcacagctccccgcaacgttgaacttctgggcttaagcgatcctcctgtgtcagccgcctaatggggtctcactatgttgtacaggctggtctccagctcctggactcaaacaatcctcctaccttggcctgccaaagcactggaattagaggcatgagccactgcacctggccacgatttgcttttaaaagaaaggatgcaaagtctgtttttaggattttcctataatatatgtccaaaaactgtagagtaaatattctaagtgactgttattcttgtggcaataataaaggaataattctatctatcatctatcttttcatatatattttcagatatggcaagtattagtcagcacaataaagaaaaaataaaagactaagattaattaagattaaatcttaattaattttagatttaagattttcactatctaccaacaactttgacaaaaaagtaattttatttatctaggcagaccaatgctaaattttaatgataataatccctttcattcatgcaaatcatatcttgcaaaagtctgtctttttctagttttcattaactcatttctaaaatatttttccaaatgttacaattgaacattaatcttaaaatagaataagaaaataaaaaaatcacatttttctcatctcatactaagcaatcacttatccattgaaacccacctattataatagtttgatatttgaaccaatatgagaaataaggtattaaaaattctccagtagtggatgtagagatgtcatctctgtgcactttttaaaaaaatattactccaaatacaagtagtggtagggactggcatgttaagtgccacgtgatgcttgcattttctgtagtatatgatcatgttgcttaagaactcctagaattctggacatttataggaaggcaacagcgttaaacaatcaaaatacaacacaattttatgcacacacgcacacacacacatacacaccacacactatgctcactataattgtattgtcccaaattcctggttgaatatttcaaaccctattaacaagcactctcagcacccaattatccctttcgaataactaaatttaaaaagcaagatagttattgtttaaatatgacaaactcattcttaatctttttgaaggttaaaaattgttattaatattttaagtcttatctcatttcttttgatgtattcaaaaaacaataattgagctactgcaataactgctttcctgaaatttgatctgatattggttctgtaaaaattctatttgaaatatactttcattgccaaaaatatttgcttccaagtatattacgtaaaaatcatgactaattcaccaggggtgggaatatataaaaatccatttaatagaggacaagagttttatgagtagtggctcattcatttatttatttaacagccgttattgacatgttccaaagagcctggcatcatgcctagaatagtctcaaagagaaaaaagttagaaataaataaataattatatatatttatattgtatatatatataacctcagtgcttaacctttttaaagatcaacatgttgttaaaatagcttctgctaatatataaattttccttgtttatgcaattaataattaaattaaactggaggaagaaaaacatactaccttttatcactaacatagaccaagacggaagatatatctttggtaaatacctttagaaagatgtgaagtatttcatctggtagcagaaaatctactaaaattatctgctttctctgaaaacagttatatattttatagtcaaatgtcccattatttttttctattctttaatactggaaattaaaaatatattttaccataaatgtgaattaaacacaaaattatggttcttttgacatggcacttaaaattaataaatgcacaaatataatttgataaatgtattgagagctatacatgaaatatacattggtctgggatggaggaggaatatgtaagaggtgataaactgtttttaaagtacaatacacaaacttttataagccttttataaatggagaaaagtttactactaataaaattaaagtgcatttatttattatgtaaaagtatcctttcttataccataatgtaatcaaatatatggtatatattgcaaaaatgatttttgagttcttatgtaatttgttcgatgcaaagcactgtgctacaaacagtaaagtatataaaacacaaatctgaatctttaaagtgttcacagttcagtcgattactctgtgtggtctccttatgaagtgagcaggagctgaaaaatgagaagataatgaagtaaatgatccgttggttcccttcttaatacggtgtgagcaaaatccttatgttttgtaacaggaatcaaaaccaaactctacagattgatgcctataaaatgagaaaattctgaaaagattaatatttaaattttctttatgacttgctatggtctcaatgtcatatggtctcaatgccatgaattttggactccccaaaagtcatatgttaaaattctaaaccctaagttgatggtaataggagtggggacctttgggaggagattcggtcataagggctccaaatgagattagtgcctttatgaaagaggccccagagattttccttgccccttccaccatgtgaggttacagtgaaaagagagtggtcaatgtaccaggaagcaggcccaaaaccagacaatttgctggtgctctgatcttagacttcccagcctcaagaaccaggagaaataaattgtgttgtgtataagccatccagtttatagtattttgtttttgcagcctgaaaggactcaagtactactgatgtttccttcaatgatacagactcattcaattgcttatgggcaattgattttacttttaaagattcacattttttacacaaaagaatttattgttggcaaatttacattgagttattggctaaaaagcatttttacatagtctatccctttctttctttcttttttttttttagacggagtctcgctctgtcaccaggctggagtgcagaggcgcgatcttggctgactgaaacctccgcctcctgggttcaagcgattctcctgcctcagccccccgagtagctgggactacaggcatatgccaccacgcccagctaatttttgtactttcagcagagacagggtttctccatgttggccaagatggtctggatctcttgatttcgtgatccacccttctcagcctcccaaattgctgggattacaagcataagccaccgcgcctggccccttcctcttctgaaaggggtggaggctttgcttacagaaagacttcctatcagctaaactcttactttaatatatttctcctaaaactttcttcttattacagtaatatctgagccttgtaccatgtgaacattagcagacagcccttagaaaactagtcatttaagggaactcacagtaataaatacatagtatgaggctccatataaccaatttggcagcctactctaaatttgaaatagcccacatcatttgtacacacatattcaaaaactttttttaagttttttaaaactcagggtaggaagaggcagtgaaaagaaacccaatattaatttagaatgaattttggataagaaactttaccatcaaagccatttctattttgtctaaacctcctagtttcaacagagctgacgtatttatagcaagttactaagattgttagcaaattagctatgatcggtactttggaaggaagcagctttgactttttcgaatagtcttttatttatgaatctcctcaaaatctgtggtaattagcttgcctcccacacttcactcttcttttctgtgctgcaccaagtatttcatttactattaacttttcttgggaactctgtgtgggctcatacacattcccatcaatgaattttttttaacttaggtattttatatattcttatttatataaagacatgctacttgaaagttcagaaactttaatttcataaatgttggcagaaaccaattcattcaagtattgaaacagaacatcaaaatctaacaataatatccaataagataagagagtaatagctgggtgcattggctcacacctgtaatcccagcaccgggcggccaaggtgggaggatgactgagtccaggagtttgagaccagcctgagcaacatagcaagacctcttctctacaaaaaaatcaaaaattagctgaagagatagcaaacgcctctagtcccagctactctgaggcaggagaatcacctgatccctggtggtcaaagctgcagagagccatgactgtgtcactgcactccatcttgggcaacagagtgagaccctatctcaaaaaaaaaaaaaatgataggggagtaaaatatattcactcacttttggaggatgaaaatagccaataaatacagatgcttttatgatgacttttaatataattgccaataagtatctctgctaaatacaccttaaaattttcagagaaaatacgaaagttgaaggtgagaaacataacgtgggtttgagacagaccttgagacatggggccacaatgttccatgtatctcttttcaaaagttatttgcacagagggaagaatgactcttggggaacaaatcagtgcccaggctcctgaagcagggaaggtttagggtatgatggagaaagagagtttactatgtattcactacctccgtgggccagtcctgtagagttatgggcccttgtgaaaaaaaatttagtatttgggcttttctaatttgtaagtaacataagcaattgatatttctagccacagtttgaaaaataagatacagaatgaaagatatgagccttttacccatctccctatgcttcaatgtagggagaactaaagagaaacttggtcatctgggaatatgtgatgtttcgagtatttcaaactaaatcaaagtggctaagaaaaagaatcattgcagtgaagacactaccagtgaagtaggccttaagttaatttttggacattaataattaaaaaaagaaggccaccatggaagaatatttaaaagacttttaaggctgggcgcggtggctcatgcctgtaatcccagcactttgggaggccaaggcgggcggatcacgaggtcagtagacggagaccatcctggctaacacggtgaaaccccgtctctactaaaaatacaaaaaattagctgggtgtggtggtgagcgcctgtagtcccagctactcgggaggctgaggcagaatgccgtgaacccgggaggcggagcttgcagtgagccgagatagcaccactgcactccagcctgggcgacagagggagactctgcctgaaaaaaggaaaaaaaaaaaaagatttttaaaacacctctggagacagagaaatagctaaaacttgatgggctactaggatcttgattcttgtcactgtcagcaatgtgccagtgaaatatgattattattttgaagtgatctaatttctacctgcagttgaataaggacttaggaattttaatttttcgcagataaatgatagctgcttcctgatatcttaggcacaggattaatatacatatcatttaattaccataataatgttattagtcataattacctatggattacagatgaagaaacaaaggtatatagaaaagttagtaatttttctaggccactcaaatattgaaagtagaagcctacactttaaaacaaaccaaagcttccgcttaaagcaactagaaaaggttctttaaaaagtgccatggcagtgctaaaaacaccagtgaaaaatgacatgattgagacctagataaaaagaaattcgaaggcaatccctatatttggagatgcatgtccctttggggtggcaataaattccgtaagtcgtaactgagaggctaacaacctgaacaccagttttgaaaactttatggatttagtaagacaaaaattgcattctaggattcaccaaaatggcgaactcacatgagttagagatctcaaagaattacaacttttaagaattcaactttagtaagaatgacccagaaatacagaaccttagaaagaagataagtattacttgaaatcctctcaatttccaaagctggaatgcaatactaaccccaggttgctagcaacttacctctctaaataaatgcaaacatattaaatacatcattttgggaggaagaatatatcactctaaacctcaaattttatctgattcatatgtacaacacctgggatgtaatataaataagcaggaaaaaaagtaaaagagaattaactttaagatcttcaactcaagacaaatgtgaaatagaaatagataaaccaaagattcagatgatgaatttgttacagtgattaagctttatatgtttaagtagataaaaaataaaaaaactgagaatttcaacatggaaatctattataattaataactaaatggcaattccataatttaagaatgaaataaaattaagaactcaattatcttaacagcagattaggcatagctaaaaagagaattacttgttcggaaagcaaaccagaagaaaatgtatagaaggcagtatggaaagttgataaaatgaaagatagagaatagacttgatacatcatagtaaacatgcaaaaataaatgcaaaaagaaaaattataagggcagttgatagtaaagtaatttaaaatttttcatagattttatatggactttaagaagattaattttaactactttctgataattaatttttgtaattaatagacataacttaatgtggtgcactggctaattaattcaggaaagtgaggttttgctgatttctacatcagacattctgtctccttttcagtttgtgtagcatactctcaaatggattttagcacttcctttcagtcacactgcatctcctgatttcatttattttccaataaacaacaccctctctacagggtcattcctataagcattcaaaccatgcttttatttgtattgttaaaaccaaaccccccccgccaaaaaaactttctttactctatcacttgtctcagccacctgcccctttctcttaaaagcaaaactttaattacacatacgcacaatgtctaattcctctctgtatatagacagtgcctagcttatgatgatttgacttactattttttgactttctgttgtggaatctgatgcttatgcctgccttatgatgattcaacttactattttttgactttctgatggtttgggctgccatttgtttgttgttgttgttgttaaaaaactgacaatggctggcttaaaataatacagattacatctgttttttctctcagtacagttttcagtacattacatgagatattcaacacttcattataaaatagactttgtattagatgattttgtccaactgtaggctaataatgtaagtgtactcagcatgtttaaggtagagtcggctaaactatgatgtgcagtagcttaggtatactgaatatattttcaactcaggatattttcaacttatgatgagtttatcaagatgtaacctcatcataagttgagcaacatctgtatttactcttgaatccacaccagcctctttcaccactccatcagtaaaatgctcttgtcaaggtcctaatatcctccacagagctaaatccaattaattcatattgagacttttttctctaatgacacgtcccttggtgatattatccagtctaatagtttcagacatagtatagattacattgagcaatttcagtttatatctcgagctatgaattcccctgcactacagactattgggtccaactgcctacttgtcatctccacttggatatctgacattacatctaaatcaaactcttgtcatttccacacaagtttgctctttctgcattcctttcaaacttggttaatagcagctctattcttccaattctcaagatgaaaatctttgctaattactgactccacttctaacttttacatatcatatccatcctgttggccttaccatctaattttatccataattcaaccacaccttaccatgttctctttgactggtctattccaacttactactagtgattgcctttgcctaaagtgctcatggtcctctattcatctcattaactcttactttcattatgatccagatttaagcataattcccccaggaagccttaagtattctctctgattttagaaaatactgctaaaatgtgtctcaagtctgtctttccttggtagcacttgttgcaattgtaactgtcaatttttacaggattggtatatgtctatctgcctcctttgtagggtctactatttaagcaaaaattgtcactgtttcatttgtttaaatagccctaaaagtaatccaaagtatctagataaatatttttgaaataaatatttcaaaaataaatatttttgaaatgaattaactgaatataatgagggagaagtcaagcctcagaatttgatcctccaaaccaaccagtagtcatgctttgagtacatgtttgacactagagaaggtctaacctttctcatttctcatccttgtgcccaagttaggagtgatgctgatgaataataaaaataatattgaaattggcccaattttcccatagagctgatgtttacatttttttgaataagcatagaaattgctcctcctggtcttaaaacttgagacttacatttgtctcatctacgttcctttctcagaaaacctgccatcagttctcccagatagtatcaaggaactgaaatgtaccagatcactacatccagataatgaacaacaaaatcctcatctatcatgattgtccaactgactacacgctttctgttgatcaactcctcttctttacccctccctaattcttgtttttttgtgcatagttacattccttccctattatatagacctccaattttagtcaactggagaggaggtgaaactaatctcctgtctcctggctaacatcacccaaataaagactttctttcctggcaatactcgttgtctcagtgattggctttctgtgaggtgagcaatgggatctaaactgaacccctggtgtttggtaatggtattatagaacaaagatttagaagtagataaaaatcaagatgtagaaatttaaaagagaaacttgagtcatcaaaatcatagtctgaaaattgtcatttaaagatgaaaccagagttgtgaattgaaatgctgtcagtatctttttaaccaggcttgatattgcagtagtgttacattcaggacttacataaattagtgcttattaggggtatctatattcagtgcttgccagttgccagtgataaattatatatcgtttgtacatgaacatagcatatttgagtgtgaagacttaatattgggttatggtggggttggggtggggaaggaggactccattcaatagtgaaatatatgacaaaaattagtgtaattatttgagatttcttaaatctaatctttatacaatttattggttttatctataagatttattttcatcatgcactcattcattttgactaagctttgaaaatgctaaacttgaaattcatggtaattgttataacttcctaaaaattgtctcttctcgtgggtaatagtttatttctttatagatttggcatcagcttatttcaactgaaagagctaaaagaccataatgcagctaattaactcactgatttgtagcttcttaatgacttatttattttaaaggaaactaattaagtgtttcagaatacactgaaaattacttaggaaagacttattagctcctactgtgtcatgctcaagataataaaatgtaaggtaccatgatacaatggatgaggctccagatggctagccaggaagcttgtattttgttcttttctgtcattaactagttgttttgccttgggcaagccagacattttaccaatacatatttttcacagataagtttagtaaaacaaatgatgtgacatacacatatgtttagaaaactgccaaaatcttatgctgaaatttggctttttcattgaataccatgactctttcggtcagggatatttttaattgaaatgaagagaaatccactcaaccttgtttatgtaaaagagcgctgaatggtgatagtagtatcttatgagactcaaatgtagaaaaaacagacaaacttcagcaaagactgagcaccataaaattaagaatctgattgattcatcccagttcatgaattcaactcctggttgaaattgctttagcaaaagaggttcaaaatcactttgcaaacttgtagttgtaggggccttgactgacagacttgtctactagttttccttaaataatttctcattcatgacatttggttttttatagcccaactgctgaatggatatttaaagtagtctggggtttatattgttttgtatttaacagtttggttttggttttggtatactaagcaagattttgaataattcaaaagaaatatatcagtttatataaaactcagtgaaaatttataggatgaaggacttctgaaatagtgctccagagtttcaggcaggaaaatgttgaacagacaggtaaaaagagaaagtttcctagaacctgtgatgggaaagagtacggaaaatacaagagactagaagaatgtcagcatggctggaagagagaaagagagcaccaacctaataacaaatgaggctggagagcactacaagtacctgatcatgtagtgccttacagatcatattatggacatgtatcttcatagccccattaagagacaattctagtggtcaggaagagagttgagggtagtcttggtaattttaatagcagtaggggtggagaagagtggaacaacctaagagacatataattaataaaatccacagaatttggtggtggtttggtactggatgtgaaggagaagaatgtcctcaagattgaagtagtgtcattcatctgggataacacccaaggtttgttgtcccatgtccacagaaaactaggacatggatacaccagaatgaggttaagagtggaaatttaataggcgaaagcaagagaatagctctctgcacagaacgcgcggtcctggagaaaatgtgttactgcttctacagtgaaattcagaaggttatataaatgagcttgatggggtggtgtctgctttacatagggcatgaaagattggtcagaccaggtgtgccatttgcatagggtgcgaagaagctggccaccccaccctaatctttattatgcagatggcttctctacttggctagtgccatgttgcctggttctttactgtacacgtagcgacaaagaaaagtgaagatggagccttcgtgttgaacatacctggcttccagatagccttttctattggcacagctgtcggcattcccctgtgcaagcttccagcttgcttatctatgtttgcagttcgatttttcaggctgctttttgttaaaaaagaaatgatttgggagctgctttttgctaaaagggaagccgtgctgaggactcctttaccctctctatttgcctaaataatttctttctagctcctgtattaggatgagtgtggtggctttaaaattttttctcaaatttttttgcactcctctcttcaaagagtgctgttcaatttccctcctcttgaaatttggctgggtaaagtgacttgattgtgcatgaattttgtggttaggtcataaaatgcattgtaacttccatcttgcactcttttggatcactgactctgggaagctaatcatcatgttgtgagaacactcaagaagctacaagggagaaaccaagggcttctaccagtaggcttcattgacttcctgcccatttcactgagccatcttggaatcagcttctctatttcagtcaagacttcctctgacttgactgagatcttgacataaacctcatgaaagattcagagctaggacacctacttaagcagctcctgaattcctgactcacagaaactttgaggcttacaggtatttattgttgttttaagccacttaaatatcagggtaataaaaagtattttttaccaagaagtttctgcataataataaaacaggttgatatagaactcagtaaattttcaataaaccataacatttattatttttatggatattatagaagttgggtcttcaagaggatagtttaaatgaggaaatgtttcagtgatgctatttgacaaaggcagtgattcttcaactcttcaaacttttgtgtaattccagagagcaataaaaacacccttgatttgatttagagtatcactgtctctttgggaagggatcatgtggagcctttgtccggatattacttcaatgtcctctcagagaaaagaggtcttccttgaaaagatcaggtgaaaggtatagcaaagacttttcctgaagcttataactcctgttcttgttccttgtaaacatttttgataaatcacttttttaaatctgggatgttcaatattgttaattagcatttaaaataattaagcttaaaattataaacttaaatctgcagctttacacacacatctcattatactaatcgctgcatgcgtaagactttcaaaaaaacaaggtgtaattccccaaaacaactaaaaagcaggttttgaaaatctaagaggaaaccaaacaacaaaatttcaacattcttatagaagcagaatgttctataagacattgcagaatatttgtgcagattgttaagataagacaaagcagaatatttgttcccccatattgtatttcatatacataaaagttagccctctgtatctgtgtcaagttctgcatctgtggattcaaaaaaccagacattgaaaatattcagaaaaagaggatggttgtgtctgtactgaatatgtaaaggctttatttccttgtcgttatttcctaaacaatagagtataacaactatttaaatggcatttaccttgtgttaggtattatcagtaatctagagatgatttaaggtatgtgagaagatatgggtaggttatgtggaaatacgactttattttatataagggatttgaacatcagtgaattttggtatcctcgggagtcctggaatcaatcccttgtggatacaaagggatgactgtatatgtatctgtatatatttctatagacacccatatacatacaaaacacatattcttatattcatttagttgtatatatgtggtaaaataaagttatggaagactgtatatgcaatagatgaaataccaataaagtctctgtaactaaggaatataccttctgttggaagaaacagaaaataaacaaaataaacatatacataatcaagacagttagagactgctctatgttctcagaagaaaatagccagtatgatgaaatagaaaagacagtctatcttgaataggatgcttgaatagacttagaaagtctttactgagctgagtgtgaagcagacaaaagaagatacagagaacaactacttcaaacttacggtgttgtagcaataatcaatctactggaaaataataacataaacttggtctcttataccatgaaaataacttacagataaattaaatctctaaatatatgtaaatttttaaataaaacattcaaaaatagttcaagagtaagcacatttctattttctttcccttgcagtgttcattaaaggactactaaatgactaaacacagattcactttcaaagacaacaggaaggagataacagcaaacgagaaattcctacaagttttacaagtttctgggagatgaaaaagaaataatctataaagagatttatatgtatctatccagaaaattttcagaaatgataaaaacaggtattgtcaaagttaaatgagcctatttgagatcaaaggaggttaagcttaaatagagaattgtctagacctatttttgtaaacctgccaaaaattatgaagagaagattctgaaagatttcctgaatgaatattttgaaagaaaaagtaaaacacaaaacagtgagaccacttttaaattttcatttatggagcctacaagataaaaagataaagcctttgaaaattctgggtgagcattattttcattcagtgttttcaatccagttttccagccaatctatgaatcagaagtaactaagcagccataatacatggaatcaaatactctacctgcataaatgctctcctggaaaaatctttgagaaaataccatagcaaaatgaggaaatagacaagaaatagaccaagaatcctaggagctgatccaacttagaaagtagtgatgtgatttcctcaaatgaaatccatgcagaagatcttagaaaacacagatacagttttgatcagaagaagagagaactctaggatggtcgctgtgctgtggagtgcagtgaagtatggaatgtattgcaaagaggacatcataggtttgagagtgggaggaagaaaataaatatttgaaaaagcacttaaagccagaagaaaacaagtatggaattaaggaaaaacaaaaggtgaaccaaaaataatataagggtattattcagatgtatggatatacagtcatgcaccacgtaacgacattttggccaatgtcagactgcatgcagaattgtgatcccagaggattataatgaagctgaaaaattcctattgcctagtgatgtcatacccatggtaatatcatagggcaatagattactcatgtgcttgttgtgatgctggtataaacaaacctacagcattgccagtcatataaaagtataccacatacaattatgtacagtacataatacttggataatgataataaatgttactggtttatatatttaccctactatacttttaatctttattttagactgcatgcgttctagttagatttttcaaagttagctgtaaaatatcctcaggcaggtccttcaggaggtattccagaagaaggcgttgctattgcaggagataacagttccacacatgttatccctgaagactttccatgggacaagatgtggaggtggaagatggtgatagtgataatcctgattctctgtaggcacaggctaatgtgtgtgcttgtgtcttagtttttaacaaaaaaaaaatttaaatgtgaaaaaaatttaaacctagacaaaagcttatagaataaagatataaagaatacattttataagctgtaaaatgtcctttaagctaagcattgttatcaaagagtcaaaaatttaaaaaaattgaaagtttataaagtaagagttaccgtaagaaagaaaatattttttaatttagtgtagcctaagggcacagtgtttaaaaattcgacactagtgtacagtaatgtcctaggccttcacattcactcaccactcactcactgactcacttaatactgcaagcgccattcatcgtaagtgctctatacaggcaaatcatttgcttttacctttagcaaacgtagttttactgtatcatttctatgtttagatatgtttagacatatgtatacaattgtgttacaattgcctacagtatttaatactgtacatgctgtacaggtttgcagcctgggagccataggctgtaccacatagccttggtgtgcagtaggctattccatctaggtttgtgtaagtacactctatgatgttcatacaataactgtatcacctaacaatgtatttctcaaaacttttccctgctgttaagcaacaaacggctgtagtcataatagtaagaaaaatgtgaacatttaaaaatgattgcttagctgggtgctgtgactcacacctgtaatctcagcactttgggaagccaaagcaggtggatcactgaaggtcaggagtttgagaccagcctggacaacatggcgaaaccccatctctactaaaaatacaaaaatgagccaggtatggtggcacatgcctctaatcccagctacttgggaggctgaggtaagataatcgtttgaacccaggaggcagaggttgcaatgaaccaagattgtgccgctgcactccagcctgggtgacagagtgacactgtgtctcaaaattaattaattaaaaaataaaataaaaatgattgcttttaggaagcataactcagtataagggaggtaggactaaagaatgctatgaacagcattagagtgctatcctcaccatttgattttttaatccatatgcaaattttactttaaaaaataattcaaagtaaaggattagagatatagaagaaattaagacttttatagaagagaattttataaataagacaaaataaaaagccttaaagaaaaggctgatttatttagtacccacacttactcattttcatcttcaaataggttttgaaaatgtacaatgtgtcgagcactgtctgaggactctggattctgcaataaataaaatggaacagaatctttggtctcatggagtttacattctagcagaatggaacattataaaccagaaatatgagaaattggtaaattacatgctattttggaagaaaggagcagttagagaagaacagagcaaaggacaatcagaagtgagaggaaaggaaacaaaagatgctggactagaaacctcctcaacagaatattcacttctctattctgtggcagaatggattagcggtggggagaggcaagaacaaattctcaaggcaactctctccccttcaaagtaaaggaaacacatggaatggataagtagtattaatcccctaattggaacatttttcttaaatatatatatattatatacatatgtatttatttgtggtcacatatatttgtagaaatatataaaatataatctggaaagaaacatattaaatgatttcagtcattatctccaagaagggaactaagacagtgttggcaaccaagggaaacttttcatttatccaaaatatttggatttttatattgaagacataattatgtattacctaagtaattgtaagtgaaattaaatccacataaagactttgaaatccattttaattaaatggctataatgattagagtcaaaattataaatgcaagtttgtggttatatatcaattaccacagtagcagcttcatacacaagctttaaaaaaatgccagttacattctaaatccctgtagcagcatttcagggaaatagtttgtcaatattactttcctttgtcaaatccgtgaaatagcagttgatttcttaaaataaatctcaagctataaaatgtttctcataggtattgttgctcctagcttccttctgggaagggatagtctttcttttctctctcattcttttcatatgcaaaaagacttcctccctaagcctgattctagacaattcatctttacagtttgtttttgaaactgttttattctagttgtgttcattcaccacacacataacacacacacacacacagagagatgcatgcactcacacagacacagacacacacacagacagcatgcacaaggtacttccccgcctgttttttttttttttttttaatgaaaaataaacagggaatttgctctgactctagcctagagtgtgctgttggataacaaacttaataaaaacgttcagctaccaataaaatcaaaatttggaaggtaaaattttcttggaatagcagatgttaccttttctttagtcagaaaaaggtcagggcacccccagagtcacaagagtaattattcaaaatccaggatgtggcctgatctctgttaatttgactgtgcatttttgccaaagggaattttatcaattcttttgcttaaatgtcatgtcctccacattgcctttcttggcttagctgagccagaaatgatccctcctccactaaattcttataggccataggttatatcacaaatgtggttctcattcactggttttcaatgttgatatgtaatacttacaagtcataattctctttactagcctggaaacttaaaggctaagggcagcaatcatgtcatatgacacatatggtgaattagaaaaacaaataacacaactatgttgctttgctgtaatttctatagtcctctagaactcagtttgataacgggtggatcatttgaaactcaattcaagaacattttcttccttatattctaaatatacctcgagcagtttaacttaccaaaaggtcactgagcatgatttcaggtacatttttctagtcataatttcaaaatgattacataaaatcaatgtgaaaaaagttgatcaagaattgagattatcttctaaatcttatttggtaaaatacttcctagaactttaaaataagcacaaagcatgtttaaaataaaaacactatatacattttattttaatctatgtgtattatcagaaaaatactacaaaaatactgggaaaaagttatttcaccaatcagaaataagcaatactgacagaaattaccattttacttgggatattttaagttatagatttacaaaggaaaagatacagcaatagtactaatgaaatgcatttttataaatcttcaaatcaataagattcaggacataaaagcatgatattttgaagcaccaatctctagagtctccagacttaaaaacagatgtacacagatattgcagtgaaatcattctaaatttatttttataaatagtattgaaccagcagagtagggactcattcagattatggtagatattcatgcttgtataactacagatgtttatgttaatatcccctttaaatggaaggcattctatcttaagtatattcaagacagattgggcctttttattcctgtagtgcaagaagccctacctctgcctggagagagaaaatggcatagaacaaaggagaaaattaaacaataaagcagaaaaaaagagtctataattaaaagtggtaaggacaggtaaatatagcactaggaatggtgtcattcaatttcactctactgaatattacgctatacctcaaggtttttatagaattatattctttttaaaaagtaagagagagcaaagtttagcaagatgccatcactgatgttaacattattcttaagactaatactcagtttatacttaaagctaatattctaggttacccactctctcacctttctctccttttctcacccttcctccgtctttttttcctacctttcttctatctatatgcctaaactattataggcaaaacattaacagttccccaggaaacaaaagggttcagacagcctctaaattatagaagttatttcctgtggcaataagagcacacgcgttcctttaatcaagcataacaaaacccctagagactgtgctttgtacaaaaaggctagctattttcaacatgtaaagaaaatggttcagaaatataagtgaaaaatataagccaacactgccaaccttcatgctcatatatagaagaattttttaaaagagtcaaatgtctgaatttgtttcagtctcatattttccaatgaaaagattaaatattgtcctataattctaattaaatgagtcatattttaccttttacagagtgatgagatgattattttttctctagaaaagtctaatacagtgctcctttggaaaaataaacagagaattttaattaggtgatgtgggtcctatctctgactttgccaccaaaattagtgcagccttaataaataaagatcattccttggcttcattcacttcctcttcagagcaatagaaatgtctgctgcaatgaggctggactgaatcctctatgaaaactacagcgtagccacaccacagtaccagaaataacacagacttggctctattctgtgttgcctcgtaaccagttgcatcagcctacactggtctgtttcattgttcatctttatcatacttgagacttcccacttcaaagatataattgtgcattcaactgatgaattatgctgaattatgaaattacaacctccaaatctatagcctaatatattctgcctctattctaacctctttctatttagttccaaagacttagcccttttctgatttaaaatctatccttcaactattgctattaaaacttttctttgtcatctttatttaatgactttgccctatctcttctgtatccctcttgtctctttctaagtatttccaaatccgttgatgtcttttctccagactataaacaagctcacatcttctgaaacagatgccttggcgggactcacaaaggggttagctcgtttactcagcccacagctctcaaaccctcacgggaaggggagcacacaggtgagagtctgcaggaatcaggacaaaggcttctgggcgctggcaggagtagaactctgtgtggctctgcagcagcatcaagggggggtatccatgaccccagagctccaaagagcatgtattacagtgtgctcttttagctttgctgtccatggctggcttaagtgtttaacagctcaatagggggtcagggtgacagccttttgcacttgccttcttagtacctgagttcttgatggcatccaggaagaatcaggttgcatgaatgaattgaagggtggtgaatgtagaggattatattgattagtggaaatggctctcagcaggatgcggagctggaaaggggatgaagtgggaaggcagtcttcccctggagtttggccatccctgagcgaaattttcttcaaagttccactgtccaagcagtccctctgaagtcaagctgcttctctctgatgtccagctgcttcttctcctctctctttttctgccactctgccactctgccagtggagcttggaaagcttgatgtattagttcattttcatgctgatcataaagacataactgagactgggcaatttacaaaagaaagagttttaataggcttacagttgcatgtggctgaggagtcctcacaatcatggcaaaggagcaagtcatgtcttacatagattgcagcagacaaagagagagagcttgtgcagggaaattccccttttaaaaccatcagatctgatgagatttattcactgtcacaagaacagcatgggaaagacctgcccccatgattcaattacctcccaccatgtccctcccacaacatgtgggaattcaagatgtgatttgggtggggacagagacaaaccatatgattccatccccaacctcatccaaatctcatgtcctcagatttcaaaaccaatcatgccttcccaagagtccccccaaagtcttaactcatttcagcattagctcagaagtccacagtctaaagtctcataagtgacaaggcatgtcccttctgcccaggagcctgtaaaatcaaaagcaagctagttacttcctagatgcaatggggttataggcactgggtaaatacagccattccaaatggaagaaattgagcaaaacaaaaaggctagaggccccatacaagtccaaatgcagcagggcaatcaaacctcaaagctccaagatgatctcctttgactccatgtctcacatccatgtcatgcttatgcaagaggtgggctcccatggccttgagcagctccacattgtggctttgtgggtatagccccactcctggctgttttcatgggctggcattgagtgtctctagcttttccaggtgctcagagcaagctgtcagtggatctgctattctgaggtctggaagatggtggccctcttctcatagctccactaggtgatgtctcagtagggactctgcgtgggggctcccacttcacatttcccttctgcactgccctagcagaagttccccatgagggctccgcacctgcagcaaacttctgcctcatcatccaggcatttccatacatcctctgaaatctgggtggaggttcccaaacatcagttcttgacttgcgtgcacccacatgctcaacaccacatggaagttgccaaggctggtggcttccaccctctgaaacaacagcccaagctgtaccttggcccattttagtaatggctggaattgttgggatgcagggcaccaagtccctaggctgcacacagaaaagggatcctgggctgaaccacaaaaacattgtttcctcctaaacctccagacctgtgatgggagggtctgccacaaagttctctgacttgccctggagacattttccccattatcttggtgactaacatttggcttcccattacttatgtaaatttctgcagccagcttgaatttctcctcagaaaatgggagtttcttttccgtggcatcatcaggctacaaattttctgaacttttatgttgtctcccttttaaaaatgagtgcacgtgggaattcaagatgagatttgggtagggacacagccaaaccatatcccttgataaaatgcacattctgattcagtgagtatgtggtggaagacagtgtttgtagttctaataagcttcctaaaggtccacacattgaatagctaggtccatgatgggggaggacttctcctcatctgcatgccccagtgggttataggtttgctgtgttttccatagctcagtcttcagtgtgtgagctggggactggcacagccggatcccaaaggtcagggatctctgtgagtcaccaggtttatttaccccaactggatgaaacgtccaagtgtgcttctcaacaataaaaaatattggaaagccctgccccagaattctagccatcaaatctcacctatttccagttctgtatatttattaaatggatatctcataggcatcacgttcactatacatatctagaacttaactcacgatacttgtccataggactgttccttttcttgtatattctatttttgtcctggcactataattctccaagttactaaaagaataaatatgattatcttacattattctctctttttctcacatccaatcaatggacaagtggttttttttttttcttggtcatttctaattgtgtttccttctctctgtttttgaaatgtgctatagcattgatcacatactatgctctctgaagccagttttgcccctcttcactgatcaacacattttcttcacagttatccatattatttctctctttttttaatttgtgttcccaaattcttggcatgctttatattttaatttttaattttaattcttgtgggtacatagcaggtatatatatttatggtgtgcatgagattttttgatacaggcatgtgatatgtaataatatcatgtaaaatggggtatccacccctcaactatttccatattacttctttagtgatatttctgagacgatctgaccatgctcctttcctacctgtcacagttctttttgcttcagtgaaggtctgagctccacaaggcagaatgcatctggagcctctggacatcctttagagatgcttccaagaagttcagcatgccacttctatttacaacttcttggccagaacttggccacagaggcacacaagcctgccaggaaaactgcaaaatctttaacatcttggaagtgtctttaaagagaagcctcttcgttctgatggctaaaaagaagccagaatgaatgaaagcagagcatctatcttcgatctcaaagaagcaatcccgcgttaagggtggcaaaacaagagagaaggattggcaacctccattccagccttgagctgttcacttgcatagtttttcttttcctttctttcttttactcttgaaagggagaaaaatctttcttaaaccaatgctattgtgcactttttgtcactcacaaatgaaactaatctgtactaaaacaacaataagaggctggtctgttcatcccttatttactttcttgccgttcaacagccctcacttctactatacaatgaattttagaaacaaagatagataatctggcattaaggttactaatatatatacttttttgagatggagtcttgctctgttgcccaggctggagtgcagtgtcactatctcggctcactgcaacatccacctcctggttcaagcaattctcctgcctcagcctccctagtagctgggattaaaggtgtgcaccacaacacccagctaatttttgtatttttagtagagatggggtttcgtcatgttggccagtctggtcttgaacgcctgacctctaatgatccacccacctcagcctcccaaagtgctgggattacaggtgtgagccagtgcgcctgaccaaggttaccaatatttaattaaatatgaaattatagctataatgctaagtatatattttctgctaaagagagattatcagattttgaccatgttagtttttaaaaattgtagttggctagaacagctctacactttacattttaaaagtagcatattaaatataatcactcagtctatagaaaagtcactcagttcttcaaagaaagaatcaagatctaatcctgagtcttatttctccaaatttattcttattttcacatggcatacaagtgaatgaggagaggcaatagaattcaaggacagttaatttagaaaatatttaaaataaatgagctatttcttatagaggcatatatcttggctttttactactatgtttttgaaatttaattctgatttttctctaggaatttgaatttttttcatatcaagcttttccagtgtaatatttgatgtgagattatatttatgataactatacatatacccacagggaatgatatgtactttgcccttttgaaatagagcaaaattttagattcacagttatcacttagggggaaatatttaggctacacataaaacctaattctccactatagtctcaggaggcaccagcaaaggtctgcagcagagtcaatgactttgatgattctcactctatttaagatttgcaggaagagataccctaaatttcagagatttaaggggaaaaatattttagaatcttttcaactgttttaaggtctttacaaagaaacaacataaagcagaaggaagatttctaatagttctatctttataatcctctgctgcttctattcttaccaataaataaaccaggaggcaagttaaggactcagaggtccatttatttgtgctagacagtaggatacagaaaaaaagaaaagtctcttggtatcttaatagactaaatgtaagtcacttcttataaaggaatgatttaataatgtggaaaatagttaatgcatattagattgttttgttattaataagaaagtaatttacaaaggcagattgtctctaagttctttgggttaggatttcattacacacttccatctttatcacttatcagaaatgtaatcacttgtttataaaatcaagaaaacttgtacgtctcttttttattggatgtttgtcttgtttaacctactaataattaagtttccctttaaacttctgataagtagaacaaactgattttaaatgatggaaattaacaaaaacatgcctatgttgacaccaactggacaagtgaatatagagtagcttattagaatatgttcttccctaacagtcaagtgctgacaatgaaaaattttgtaacagagaaaattattatttgaataaacatttgctgatattttataactctcttgaagagtcatacagattttccccagcagctagtcctaacacaacaatacagcgtggatttatttgaaaagaaaacttgagggcccatgtggaaatatctccatgaagtttgccatattctctattccacatggaaactgtggcctgtgccaacagtgcttttcctgaccattcaaattccatcctcttttctgcccaaattctatcacctgctcaagattcacttaatatttcctccttctttataaagaatttatactcctttccattccagaaaaaaatgttttttctcaatatttatcattattactatttcgggtagttattcataattacattttcagttattttcagcaaagaatcatcactcatctaccttttatagagactcacaggattaatacataaatgtatgtaaacaaagagacaaatgttctgtggtaccaatggttctacatctatctagagaattggaaacttattagagattctgatcccagaactctgataggtgcaatagcagaaattcaagtatgataccttgagaatatgcatcatttatttgattaatatttagcattgtcatttagttatgctttctcttttcagtgcaaatatcttttttaaactagatgattacatcatacattgatttaaagatacacctcatatatgaaatagcaattttctacaactattatggtatgaagcgttattttagtgaaaaatatttaaaagagaaaccatcacacatgaaagctgattactgctgaaaagagtagagttgggaattgtttccaaataagaacaagtaaggcataactgagtaagaaaatgaacatttttagatatttttttctagacatttttccctgaaaaggagagataaggggcaagtggaaaatatattaccacagacacataaaattaggaataaagaaaaataagctgcaccaaattcctcgtcaaatgttcccctgaatgttagaagcgcagaatgataacatagtagttttggttatgcctggagttatttatctgaaattgttaatgtgctttagaaaagaagaaatagtgcttcatgacagaaattagtgagctctttcagcatgctagacactcttttaagcccagcagagagaactgggaatgtattttggtccctgccctcaaaaacttcacagtttgagctagacagagaactcagacagtggcaacagcgctgggatatgtggcactggcacacagaggaagcatcctcacctagactttagggagaccagaggcttcttagagaatgtgaaatgagttaaacaggaattagccaggcaaagagatgggattcacatttttttcccagtcatttgatgcaggacatttgggtagtcatttcactgagtctcaaataacttatcttcttcaggcttccacctaaagtattagatgaccaatccgacacactccctccaccacccacagaaaaggcaaacattatttgctagtgatttcctcacaccctactgctatagtaattacatctattttattttcattagtagtattttacttgttgccacagttagctgacaatcattttttttttaaatttcatagtaacattactgtcagatttttgtacatatttcctaacttctgaaaaggagaacatccagagctaatatcaggaccaactgttgaaatcttgctttataactaaaagttaactttaagaaggaatgtaaactttttacatgtatttgacattaaaaacaaagtcaacagagtctaaacctagtcaacagtgtatagaaaaacaaatgacatagaaatgaaaatatttccaatattatttttaaagttatttgaataaaattatgatatgacgttagtaagagcagcagtgtcatggagaaagtccagtggcttcttggaactatatgcatttatggaaaaatatactgctaaagttctctaatgcttttaaggctaacttattttacagagtgttttaattgtttattgtaaaaagctgcaaagccctagtaaaattcaaaataaataaatacttttttatggttttatttctatgtcatgacccaaaattgtaaattatatgaccctagtcaaagtagcatcataaaagcatagcaaccattataacaaggagtggtatcatcccaaggtgggtgggcagaagttttttctcagggggataaaaagcctttttatttttatttttaaaataaatatatagagagagtacataagaaaatacatgatgtatctgtggtattacaatttcttggaagtcagttacaaaaaatgtctacaaaaggtgctttaagaggcaataatgaaaaaagttgagaaatatacattacattacacaatacaaatgcattacacaatacaaattcggtttttcatggggcaaagaaccaaacccttctcttttccactagatgctgccaatttgtatctgttttacagcctcttcttgaagtagttaatatcttctaaggagattgtttgatcctataaactttatgatctcttgaacacaatacttcctttttctccacttgataacacaactaaatagaattcaaatctaaaatcttagaaagatgtgacagacaggcagatgtcatctcagtgcttatatattatttgttgagcatgcatgacattgaattaaacattatggaggtaaaacaaagaccagaaatgattctatccccatgggagttaaaatttagatacacagagacaacttgcatgaaaatctaaaacacaaattggaaatggatatcacaggttctcctctccacagtgatacagtgttaaaagttggggttttgcttccccagtacttaacacactgctttggatgtagccattgctccatacattattatagaagttatagagatattcaggtagaatgccatgggctctctgaaactagagaatccaaacttcatgcatggagcacctccatggacattatcatttaaaatcatggctcaaatataggcccaatttttatgaacaggaaggtcatcataagtggagaaaatccccaaagaacacagaaacaaacatttatggaagcacatataggaaaaaatagttcattttgtctaggagaaaacagaggacattttattttttactaattaaaaacaataaatattttccttctgagtaaacaagtccttatcactaggaattttaaagattaagggatgaccacctgttgaagatgttcagagattctaaaatttaggtaggatactggatggaccagttacctccattgtaagcccaatcattctatgttggcaatggttgtataatattatcagaaatatatcagggtttggccataattcctgattggttatggcaaatgtttgtatgtactcatggagaattcttcatcgcttacatcggaaatgcttccattcagtaagctttttccagagacctttaaattgtatgctattcctaattgtaccattgaggtgattgcttctgtgcatcacgttgcctacgaggtactagtaatacttcctcctaaaagcatctctagtaaggagattctgaaaaaatttcagaaatacattatgatggagctgcattgttttaccactgtttcctcttctgataacatctcaggatttaaaactccatttattgaaaatgtgtgttgttgccatgcagttgttagaatagcttcatttactgttactgaacagctcattccatatatacactgtttgttgctaaacagttggttctgtctttgaatttctgcctgcactccagaaccagttctctggagttacttgtctcttttggccatttccccaagcaaaataaagccacaggctgtaccatccacctaataaaaaaacaaaaaactaaaactcaaaaaaaaaatgtatttccacatatacatgtacatacatatgaatttgaggcgggtggaccgcgaggtcaggagatagagaccatcctggctaacatagtgaaaacctctctctaccaaaaatacaaaaaatttagctgggcgtggtggcatgttcctgtagtcccagctactcaggaggctgaggcagaagaattgcttgaacctgggaggcagaagttgcagtgagccgagattgcaccactgcactccagcctgggcaacagagcgagactctgtctcaaaaaaagaaaaaaaaagaatttattttctataagtactattaatgcaagtatataaataatcctgtggaaaagggtaggagacaagtttggtgggcaaattaaggaggctttgctagatatgtttcatgatataaggaaaagtagatgatctaccttctccaaaataattccctgaaaatgtcctgagaaaacttgagtaaagtatgtcatctgtaaatatggactagtttattagattagctgaaattagagaaatgctaatgttaaggtcctcttgataagtgatagaaagatattaatatatgctattaataataactggtccttgagataaatagcataaaactgtgataaatctgcaacttcatcacttggttctaataagcctcatctctacagctgagctcagagatctctgagtacttttccatgttctgttccaagtgttctatcctcatcgttgacaaatgtattttctattctttctttgcaccacagtatactcacctttataaccttttgtaaatctgttgtctggcaattaaatctatgcaaatacctgaattcctagctgaggccaggaaacctagctcttctgcaagcatcttaacctcaaaataccccgaaccaaattcaatgtcctcttttcctccaactatccaaatcctctactatatttcagtatttcttttaagaaactatattttgaagaaaaattctcacatggtttccaacttctaaaacaatcagattaaacttttattctagtagtgtgtcattgtttctttacatagctcttaaataattgctatcaccaatcctatgactaatagtaattttgaggtaaacactacctctgaagaagaaccgatagggatattttgagtcaagttataaaactattcctgtaatgatgactactcagttataattaaattacttctttctaaattttagccatattccatcgtgaagcaatgctgtgactcctccatattcttgtagttttattaatgtaactagctcaatagttgttgttagtagaatataattttaaatcatgaactgtaaattcttcaactgaatttgacagtcaccttttcccaatcacatactatatatctgtatcattcgttttgcatagaatattctctttatatatcattttgccccttgaacaaatatcttacaaggcccaccacaagtaccaaggtttcttgatagttgcgcttccttatattccctaaaatattgctatctgtacttttttcttttgatgtttgacccttttccgtttattctagactctaagttgctaaatggaaaaggtgacatttgttcaatcatccaaagctaaattgtgcttagcacaatttgtgcacagaatttcgtgaataaatcttgttaaattgcttaatcttacatagtaaacacataattgctgattgacttgcctcagtacacagttgtgtgtttaagggaagaaaaactatatagaagaggaaatatttttcaagatgttctttcaattggcagggcaaattgcttgaggcattgactggactatgattcttctatacctgggacaatttattgctattttcagggaaaaagggaaggataatgttatatatagcaaagatttttttaaaactatacagaatcttgctacacctccatgtagtaaatcataataatagtaaaattgtattcctagaaatatagttttcttcaatatcttacatagaaaaatagagacaacattaaaaaggattcctctcatcctccaaaacataccaaaagcaaaaccagtaagctctgtgctaagatattttactaaggctttgaagtaaaccaagaaaatattacattttttattattatgacatctgaaattcacacattcaagttttgacacgatgtgccctaatttattcaagtagcaatactgtgttgatatcaacttgtaaagatgaaaaattaaatgatatggcaagaaagtaatcaacttaaatgaaatattttctgttgcttccctgcttttggaagttgttctgcaagctcttcataatcatcacttatctgcatttcaaagaaagctgaacactgatgttttgttctttattttattaatatgataactaaaatccaaaagccatagaaaaattattacataaaatagcaatatccaaaacaagtatgaaagttttaaaaacttttttgtaaatattttgtaaatttttttctgctgcttttgccttaataatgcttatttactaaagtatagatgatactttagtgcttttatgtttttgaaagcactaaagtttcatctgtaggtttgtaaaaatatactagaaatactaaaaatttgtatagtacgataacattacactgatcaaattgtgtactagtaagcaacagaaactcttatacattactgatataagtgtaaaaacataaaactacataggaatactggcagtatctactaaagttaaacacacccatgcctgtgctatgcttagcaattccccttctagagaaagtcttggacctcaacatcatgatcccaaaatgaatacatgtattcaccacaaaagatgttcaatgatattcataacagtagtaacaaaccctaagaaatacccaaatacccatcaacaggacaatagataagttaattttgatgtattcatataatggcatatgatacaacaatgagaatgaataagctattgctacatgcaacaagatggataaatcatataaacataatgcttataaaaataaagcagactcagagtaattatataaagttctaaaatggaaaagatatacttattatataagtcaggagagtgattacctttggccaaggtagtgccttggaaaggattatggtggaggaagagggtggggtgagtgcttctgtgacagtcacacttctacttgctgaactgtagtctcttcacttgggtgtgttccctttgtaaaactttatctagagggaaatgtattatttgtgcacttttctttgtgtatgttgtatctcaataaaaattttaaaaaaatcttcaaagcctatgacataaaaagtctgtactagtgaattatttacttataaatatctgtggtttctggttgttgttgttgcctccaaattgccctggtaagctgttttgaaatttaaaaatatgttaagaattaatgccaatactttcttttgttttcatcttttttcttgtttcctttgtgctcaatacatcagggctagaattagagaataaagaatcatttccaggaagacatttattttacaaaatatttccagtagagggagcttcctttttttttttttttctataggaaatcctcttttgggggtcatcactaaaagtgaaaatgcttaattttttacatataattaaagttcttcatagagtgataacctactctcatctaagactagtcatggatagagaaaaatttatttgatttatgaatggagaaagaaaaacttgatgaagaatataagttatgaagtaaacttttgtatgttgtatgtcttttcaaagaagtacatttttgggcttctcataaaatttatttctaattaaaattatttaacattaaaaaagataaattcttataatcacaattatccatttgaaatactttttcataacttttaacaaaattggacaaaagtcagagaatctagtgatgaagattatttatctcagaacatgttttaacaaatatcatagtgattgccattatacaaatttaacctcattgaccaaaacattttagtttctgactttagcttcctaaatctaagtatctatcaactaagctaatctgatttctttgaaaaaaatgtattttaccatctaagccattaagaaatatagagaaataatcaatttatattttaacattaagtttgtactcctttacataataatttcagaaatataaaagctccatatacttggctttaattattacaaatcaaatttctgacaataataaagtcacaaaaattactagatcatatcaagatgatttttattgaaaatactttggttaaaaatagttcaacttcttattttgggaaaaaatcaataatttcagaaataataaccatcacagtttctattatatataggcaaatgaaaataatataactttctataaggtagtttgagatacactattggtttttataaggtagcccaaagatgaaaaatcgacatagcaataaagaatatttaaatacttcaagtagaaatcagtatgcatataacttagttactctagttattggacttcaatcctcctttgaaaaccttgcaagccataaaaatggaaatcctatggtaattaattgtaacagtaaaattaaatttatattggtgggtcaaaattctatatgagcagtaccttatttttacacattcattaagaacggggtaaaattatctgatcctttgtctagctctcttatactctttaaattatttttttaagcctaccaaatatgacaggatcatgataagaaaatgacatgtcatagaacaatttcatagtttaatggctttgttataatattactttactcaagaagattattcctgacatagaacatatctaataatctatttatgattttgccttcatgtattacctgagctaggtcattagaaaatagtacttgcaaggcccttattttgattcatttaacttaacctctgaatatagcaacaacatttggagtttctctcatcagtaaatgactatggtctgtatttctgcattaaaaaaagtaatgtctcgtttctaaatactaaatgttttgtaactttcaaaaaaagagtaacacccaaattatataattcacttagaaaacgggaactttaaaagcaatttgagaaggaaaacgtaggcttttaaaataatttttttttctcagctgcaaataacgcaagatgccagttactaaaatgcactaatcaatgaaaaagcaaatgagtaggtctcagtagatagactgctaaataatttagacagaaaacaatacgattaaattgattgtttcaacaagtcaatatagaattgcaaatttcccggtctcatcaataacaagtggttgcaacgtaatgcacaggcttaatgagttctccgactgttaaatccaagcgaactcacctgagtaacagtgctgcttcccagaagtaaaatcccgaaactaatgtccgaaagtgtctcacgtgggccatgatacggagagatattcacgatcctgaaaatagtcttatccaaggcatggggaaccagaaagacagaatgaaaatgtacaatctaaccccgcatggtgttggtgtagactgatgcttgggaagcttcagcaccttagacagctccccgcagtatgcggaccccttctcagcattgagcagaagtggagagtcacagtgttataaatgtgcaggtgatttttacagtgaaattacaaaaatgagtgagatgaaatgtctgaagtgcctaggtgctgggcaacagttctctaaagctccagcagcaaaggaagaatgttcgttcttccctgactgagacccaggattggaggaagaagagcagcaacagccggaaagaggacgcctctccacctgctccaagcgccgcccgccggaatccagctctccaccttgggttaaaacccgagacccggagcgcggcaaagggaagcgggggtggggccggacaacccggtcctgtcgac

SEQ ID NO: 1135 - DNA, 187268 bp, Homo sapiens; identical to SEQ ID NO: 1134

SEQ ID NO: 1136 - DNA, 88194 bp, Homo sapiens
atgttccttcttctggtgcttctcactggacttggtgggatgcatgcagacctcagtaagtccaggaatccaggcttccgagggagaccttgttcactctttccacggcccaggtccagcccagactttaccctggctccacgctctcccgctttctcctggccccttgcttcaaggtctgtggccaaaaaggcagagaggcagcctccgacagaaaatcgtttaacttctctgggatggcttcctgatgcggaaaatgaacaaaaatgaaatatgtggttttttccacatacaaaattctgctactctacgaataattgcatcactgtaaaaaaagctatctatcaaggatttactgatttggcaactgttatcctccacctgccccattgaaaagtgcagatcatccttgtattcaatattctatatttgtccctgcaaaacctttcttgatgcatctgtgttttctcatttccacatctgtttataacactgaatctggtacttagtgttaacttagctgtgccagtgccaactgtgcgtgtgtgtgtgtgtctgtgtgtgtgttgagagagggatttgcaggggagaatgggaataaaaatttgagatcttgaccaggggtcagaaatttgtaggtaagaatgactagaaagacagtggaaagggcgagatgtgtagattattttaaaaatagctgctaatgtagagaaacaaatgcagaatcagagttagaaatgaataacataagaccacaggtatcaaaataacatagtttatatttatttttagatcctcataaaatcttcctgcagaccacaattccagagaagatttcatcatcggatgcaaaaacagatccagaacataatgtaattttaataatatttttactatgaaatgttgttcaagttgcgtttaatgtcaagaccaaaggtgctgaatgtgggcaggattgcacttcttggaggcagagctgacagctgagaacaggttcacaagagggagcattttgatgtttacgaatgtgtgagactgtgtgtgtgtgtttctgttgatgatgaaggattttagggataagatcccttggggccaaaatgctaggtataggatcccccaagtttgaaatttaaggaggtagcagaaaacttggatccccccaggaccaggattagggtgaggcaagtgaaatgaatcatgtaactacaggatcagatcctgtctgtcttgaaaattttggtatttttttcatcatggtgtttttttgcattgatttttaaaaaggttgcattaagatatgatttatcttgataactgagttttctggtatcctagttctagccctagtgatcccctagtgatttgtcttagcttttactaagtcagtgaggatctgaatagtgatgacctctgggcaggcttatctgttaatgatcacatcaatttcacagtccgagattggatggtagtgaatggtccttctctaataattcagcaggagaatacttctcacatggcttcttccagtataagataatctattgttatttagtaattataggcctccaaatttttttttccgtttagtggtttcagaaatctttcctctctgtttcacataaggatatactatttatatcttttccccttccccatataccctttctttaccttttcttcctctagtagctgagttttatttaccaacatgcttatcatgcagctttgaacacccctccacgctgcctcccaagtgaattactagctatgctgtggtgtatgagccctatgacagcttccctttctgattggaaagaagaggtgacattacatctttgtttaatttcctttttcctgagatcagtaatgccaactctccctttccattgtttatcactgataatctttgaattcctcacttgtctaatttccagaatttttataaaggcatttgtaatatggaaattcagtgtgtttcttttaactataatgatttaaaaatttacattgtaatatattttagcaacagaaaattataattattgtgggatgtgattttatttgaatatgtttggtatcatatggggtaggacctgcgaaagtaaaagtgcctaaggatgtacagttataagattttgtaaataaaaatacagaatacccagttaaatgcatgtgtacataaagataaaagagaaatactacatgaggcttacttatactaaattatttgttgttcacctgaaataaattataagcatctaaattacatacttccttctaaaattacagcttcctgatgatttgacttcccctaacagttctctgttttgtagaatttgcttgcagttatagtctgtttcatttagatcgcaacataatttctacagtggtcacacccaatgtattttattctttttttctagtgaacatttccagtagttttacagtttttgcattttacatttaggcgtgtggtccattttgagttaatttttgtgagggatttaaagtctgtgtctagattcttttttatttttattttttgcatgtggcaatactgttgttctagtacaatttttttgaaaagactgtcttttaaaaatattgttttgcctctgcttctttgtcaaagatccattgaccatatttatgtagatctatttctgggatctctatttctttgaactgtttgtctatgattttgcaaacaccaccgtgttttgaggactgtaaatttatactaaatcttttattttttttgagacagggtctcactctgttgcccaggctggagtgcagtggcatgatcttggctcactgcaacctctgcctcccaggttcaagtgattctcctggctcagcctcctgagtagctgagattacaggtgcccgccatcgtgcacagataatttttgtgtttttagtagagacagggttttgtcatgttggcctggctagtcttgaactcctgacctcaggtggtccacctgccttggcctcccaaagttctggaattacaggtgtgagccactgcgcctggccttatactaagtcttgaagttgggtggtgtcaattctccaactttgttcttcaccttcaatattatattggctattttgggtcttctggctctacatatgaagttgagaatcagtttgttggtatctataaaatagcttgctgatattttcattgggattacattgatctatagatgacattggaaagaactgacatcttgacaatattgagtctttatatctataaacatggaatatccctccatttatttagttcttttggagtttttgcattagttttgtagtttttctcataaatatatattttgctatatttatacctaagcatttcatttttcagggtgaaatgtaaatgacattgtgtgtttcacttaacttattacctgttcattgttggtacaaaggaaagataatgagtttttaatattaacttcgtatcctgcaaccttgccacaattgtttatttgttccagggttttttttttttggtgattctttcagattttctacatagacaatcatgtaatctgtgaataaggacacacatttatttctagcaaatctgtatccattttatttcctttttttgctttattgcattagctaggactttcagtgtgatattaaaaagtaccggagagaagggaagtcctttgccttgttcctgatttaataggaaaactttcatggttctcacagttaagaatgacatcagccattaagaccctatctccaaagatggtcacattttgaggtgctggggattagtatttcatctaatgaatttttaggggggttacaattcagcttatatcagttggatattgtatatgaaaagatgtggaggctctggataatgtgtctttcgagagttttttccttctattggttggttttgtacatttttggtttattttagttttttttgttttagctttgtaagatatgtggattttaaattttattgttgctttcatattatcctttaattttaatcttatttgtttaatatcaaaggattttagagggcacaattttaaaggtcccttccaaattccacttatacttcttttcacaatgccattcaaccgattcctcacagaacatttacctgaatcaaagtagcttgttatgctccagtataaagttgaggaattgaaaactgttaaatgctatttcttaaattaaccaaatacataatttaatgaccattgcattttctgttatcttctatggtgttctctagacatgtctttagtctccctgtattctctcctacattctattccagaggagtttgattgctcacacagataagtaaaatgcaatggcttttgatgttatattgctagaagtatattacatttcttgtacttatatcttttgggagggtctctttcaatgagtaggacaatttaccttccaggagagctctaggtaagcaaccaatgggtcctcacaattagttgtgagttgatgatggggtctgtctgaactgaaagacaataatcatcagataagcttctccctcagaggtgtgagtaatagtgaatagcaggcaagtgagtgctttatcacttagttctcaatgcagaattctgaagctccaagtatctgtgtgggaaggaaagccaatataatggttacaggttgttattaattttgtcaatattttaaactctaatttggagaagatacactatttggcatgtgttattattgaatttttctaataattttgttataggttatttacatgattaccatagggaaagccatattttgtccatctcaaaaagcagtaagtaattagtttgtcctttcaaattttaatactttggcttcttaatttctaaaagtatgtataagtagaatgaatcattttgattcaaatatattgatgcctactctatactgggtactgagtaaagtcctaggcatgcaaaagagaataaaacatattgcactgttaaagaatttataataaagaaagatacattcagataccttaatagaaaaacaaataattttattataatatggtaatatgataaatgtgtaaatagtattacttggaagtcaggaaaggcttttatggaagaggtaagagattacttgtatcttaagggaggagacagagctatataaagtagaggggcaggacagggggacatttttttttctgagagagtcttgctctgttgcccgggctagagtgcagtggagtgatctcggttcactgcaacctctacctcctgggttccagcaattctcatgcctcagcctcccaaatagctgggactacaggtgtgcaccaccatgcctggctaattttgtgtacttttagtagagatggggtttcatcatgttgcccaggctggccttgaactcctgccctgaagcatttctccctccttggcctctcaaagtgctgggattacaggcgtgaaccactgcacccagccaacattctgtttcgagaagaaatcatggtagagcacagaggtgtgagacagagtggcttttctgatgtgcatagtcaatgtgaattactgaagcacaaattttctgaaaaatagaggtaaaagattcgggaaaggtaggtaggagccaggctgtagaagattcagaatgccatggtcagatattgggagccaaaaatggttttaagtatgtacttatgtagccacattgagtcttttaggctgtttttgaggggacaaattagagttaaggtgatcaattatatcacgatacagtttaggtgagtaacagtggtggtttgaatgatggcaccagtgatagcacttgaaagaaaaatcggtggacctcaatatagatttggtagaatgattagtaaacagtgaggaatttcagataatttagttgtcgctcaagaaaatgaataggctatagcataattaactgaggaatatgaacaggggatatatttgtgtgaggaaggggtgatttcggttttttagcacatatgagatatccaagtgtgttttttcctctagatcaggggtgtccaatcttttggttcccctgagccacactggaagaattgttttgggccacatataaaatacacttatggtagctgatgagctaaaaaaaaatttaaaaatctcataatgttttaagaaagtttacaaatttgcattgggccgcattcaaagccatcctgggccatatgtggctaggaaatttgaatctctgaaaatattcaataggaatattggaaaatagttttagctataggtatatagattgagcagaaagcagtagcttggctgtgttttttttttaatgagtgctcttacgtagggtgcttataaatagatcgtggctaaagactggaccctgggaaacggcaatgtttcctgggataggttgaacaaaaacagcagccaacatggaagataaagctggagggaccaaggaggtaggaagaatagcagaagaatgaagtgttatgtaaattaagtgaggggactgagtggccacagttttcaaaaagaagctagaggtccaatgtaacaatgattttttaaaatgccttttggatttggcgttctaatatttgtggatcttttccagggaagttttagggataataagaattgagaaagtgaaggaattgtgtgtagacaattcttttgatgaaatctgttaagaattgaaaaacatgtacataaggaatagctacagtagaacatggggtcaagaaagagttctttaggataataatgacttattagtatcattttaaatagcattatgataaaaatccagtagagcataagagttcaaaattataggatagaaaaagtagtgtcctccgtatatggcacaggatggtatctgtagcaccagtgtaagggtttgttctgaatgaaagcagtaatcttctggcaataaagataaggagtgcagatgggaacaggtgatctgacagtgagggaacatgggggttttgtgggatgagtgacaggagtagtctcaagtttttgaatagttactgagggaaataaaattctgaccggagttattgagaagaaattggcccttagcatagcttagcaaatatgaatttgtagtgagaacaagtaactctttctacattttctgtttgtattagtctgttttcacactgctgataaagacatacccaagactgggcaatttacaaaagaaagaggtttattggacttacagttccacatggctggggaggcctcacaatcatggtggaagacgaggagcaagtcacctcttacgtggatggcagcaggcaaagagagagcttgtgcagagaaactcccgtttttaaaaccatcagatctcatgagacccattgattatcacaagaacagcatgggaaagactcgcccccatgattcagtcatctcccactgggtccctcccacaacatgtaggaattatgggagccgcaagatgagatttgggtggggacacagagccaaaccgtatcactgtcctaaccttacactttaattttgaaactttggtataaaatctaaaatcaatgagtgaaatagacaaagactagaaagttctatgctggaaattgggacctatgctatttcctcttcatgtctctagcaatctgagttgctcacttatctgcatttttgtattgtatgttattctagttaaaatgtctcactaagcacctaattcagtttaagtgctagaaatgcatggacaataataaaacaagtcgattagcactactttaaatttttcagtaaaaagaaaatttgtataagaatattttttctacctttttggtttcacaacttgagcatgtttttattatttttgcctagatcaattttatcttcagcttctgttattaattcttatgacgaaaatgacatccgtcattccaaacctctgctagttcaggtaagaattaggttatttttttcttatgtatttgtaattctagatttctttaaaaagacaaatattctataataactagaatgttattttacatattcgctgaaattgaataacttgggctggtgcttatttctacatggcacaaatttattaggtaattgccaatcatattaaagtagaaatgtagctaaagtaataaatagtaaatgtagctaaagtaaaaaataaataaaaaatataaagtaatacatataaataaatataaataaaatatatggggtgtttattttaaaaataagttatccattaatttttctttttttttcctagatggattgcaattataatggatatgttgcgggtattccaaattctcttgtgactctcagcgtatgttcaggactcaggttgtagactacttaaagatactcaatttgccagtattatatcctgctagcctatgaattaattctccatgtatctgttctaattctataatcacctttgttatatttcagttccttaaggactgaaccaaaattactaataaaatagtattgatattctagcagtatctgttcctgatgagaggctacctgttgatactgacaggatctgctgctttaggctttaagaaaggttgagtgtagggagattgattggtctcctcatacttttttagttttctcaaattctgttattgtccaatttcctaatgtcctagaaaaattgacaattgtggaatgcatgggactaatggacgctggctctgcagtcagtcattattaggcatatggtaccttcaatccagcccacacaaacaaatgatttagggtatcaagtgtcagaggagagttaagtgtatcaaagagaaggaatcaaagactaaagaagagactgcctagagattctacaggctggttagaaaatatacataatagaaaggggtttcaacctgtttaagtgcacagatccatgccaccaccatgctttcttgaagataatcacagatttgtaatgtaaggtaatatgtatcctgtgatatagtcgtctagttctggtgtaagaaagaccccaaaagataaagagataaaagtaaaaaaaaaaaaaagctaaggtcactttagatcttaaaaactgtggcccaaatttctcgttataatattatggttttagaccgggcgcggtggctcacgcctgtaatcccagcacttcaggaggccgaggcgggcggatcacgaggtcaggaggtcgagaccatcctggctaacatggtgaaaccccgtctctactaaaaatacaaaaaattagctgggcgtaatggcgggcgcctgtattcccagctactcgggaggctgaggcaggagaatggcgtgaacccgggaggcggagcttgcagtgagccgagatcgcgccactgcactccagcctgggcgacagagcaagactccgtctcaaagaaaaaaagaaaaaaattatggttttagtagaatcatttcagacttgtttcgattgtcttaacactcaggggaacaatgcagctgaaaaacatctcatatggaattgaaccgatggaggctgtatcaggatttatacacaagatttatgaagaaaaatatgctgacactaatattctcttagaagaaaatgacacttatacttggtttaattcagagtatcaagtcagaaaaagttcagaagtaagtattgactcttttattttaatttagtataattttgtgtaataaaaaatactttcagagccaagatttggtgacttacaaatcttaaaactattttacttcttcatgagggccctacatgacttttaaaatggcaagagaataaacttatgtttgtcattatgcttgccgttagatgaaagcttagcaaaaacttaatcttagaaatataaagatatgaatatagtataaaagaaactgaaacattaattttcatatgtgaacatttagataattaatgtaaaatattttttcttcaattactcagaaaatttaggggagaatattatacaacctggatttctcagttgagagttcaaaaatggatgagcaacttacataaagtacatgtaaagcaaagtgatgattttttttctctaccaagacctatagactgctctaaataacatgtctggctctagcaaattgccattggttgtaaattttaatatttttctagactacattgtttgccagaagtaacttcctagtaattggtagcagaaaatctgcttgcgtgaaagattagtatgaaaattatcaaaaggctaagaaaaaccaaagctgtatgttataaactgaaaatttcagtttcaattattataaaagtaaaagattcctgagtttttacgtatcttgagaagtctaatagaaaagtcttactacccagggcactttgaactggaatcttctgaatagcacctaattttgtacttgaaaacagcctcgttatgtaatcaggagcaatgtatctttcagtgtatctctcaatataatttcagtagaaggtaaatttttgtaagctcctcatgactcatgtgtgtttttcagaaaactgactttattaagttattccctcgatatattgaaatgcatattgttgtggacaaaaatttggtaagtcttactttatgcattgttattttaaaattaatatatctctttaacttgatttcagtgaggcaatggaaattaccaaccattctattttacgtttgcgatgaacacattcatacaaattaatcaagtttttgttattttgtatacagcatctactcacttttgcaaagtgaagcatcttaatttctaaagcttgttgacatttttgatttttcaaaaaacctacatcctcagtgaaaggataggttacaactcccttaagccctcaaccctcatatacaataataatatttaactgtctcagtctaattggaaggatggtctacaaaacaaatatgccacttctttaaagcaaaaggagaaaacatattatcacctgttttcttctcagttctaggtgaatgaaacaaaaagaaaaaccaatgaataaaatactcatattgagaattcatgactatactttggatctcttatgaatttaggctccgaatatttgttacctatgtggttaggattctaatccatgaggctacatttgtcccagattggtaaaagctgagggtgcatgatggaagcaaatagtatttatatctggaggaatgtcacttcaagcagaatacctcaggattcctacagattaatatcagccatacataaatgggcttacaatccgtaaggaaataaaacaccatgaacaatggttagcaaaataaaaaatatatgtatggctaatattcattttttaaaaatatagttatgattggcagaacaataatttatttacttgccaagatttaacatttccctttggggacttacaaagttataaaggcaatcccatgtataattaaatctccctgcaaatatgcatttaaaagaagttttaatattcggtggtgaactttgagaggaaaggttagaaacagtaaaaagtatctggtgaggtaggagtggggctaagtaagatgagtagtcctcacttagttacttattttttatgatttttagcttaagatcttctatttcttcactttgatattttggacatttttctgggctgtcaggggttgctccctcagtttttcaggctttgacttgagtgtgatgtattcaggagttgatttttgtaacttttactgctgaggggtttgaaagaagaacagtgtagggctcttcccagcttggcttattaaggagagagagataagagtttttactaatactaagtttcctgggttaaataaagatggttcctgttggaagtgagctagagaggttatatgtttaaccagtttagaggttttctgcctgaaaacaatttttgagcacattgataagttttatccttttccaagtgaaaagcttggtgaaggatttttttttttttttttttgagacagagtctcactctgtcacccagactggtgttcagtggcactgtattggctcactgggttggctcactggctcactgggtcaacctctgtctcctgggttcaagcaattctcctgcctcagcctcttgagcagttgggattacaggtgcccaccaccacgctcagctattttaaaaaaatttttagtagagatggggtttcaccatgtcttgaactcctgacctcaggtgatctgcctgcctcagcctcccaaagcgctgggattacaggcgtgagccaccatgcctggcccctggtaaaggattttaaggactttctattggccggaagctggaaaatggagtttgccattctctgaccatagccattttgaaggctgaaaagtatgcccttgagaagtggcctattttatttttgcaggggaatactgaggttaatttttcttatggagcgttcctagattagaagggcttgaagcgtgttaatgccttgaagtttccttgtcgctgacttagctgtctgatcagctaacctatattttttggctaccttatctgtttccttttgatgttactcagagtgcatttttgctatttttttgtgatagaaaaactgaggataatagcctgctaattttttggtgacattttataggagatttattggtggtaagaaaatgtgtttccttttaaatggcagcatgagcatggagagctatgaaagcatacttagtgttagtataaatgttagctatttttcccttgcttaattcaagtgctcttgtcagagctattagtttagctatttgagtgcctgtgcctggggagagtgactactgtttattcagccttacgcacttctttctttaaccactgtttgttagctaagaagagctccccctagaggacagtaatcctgccactttatgtggcgtgcacatagttaaattatttcctagggttaacttggaggcttttttgaatagtagaactatcatgacaatggcttggaagcatgtgttaataggtcctcttaactgcaaataaagttgagaaaaatattggattagagttttccttgagatgccccttacagtcatgctatgggaagaggggaggcctggattagagacgagaaaagagagagactggctctagtgtttagaaggaggtctactttcctttctttaatttccagaattagctggggctcctgtgctataatggcagtttgagctgctggagctggggcttgagccccgggacccattagtcctgctggaccatctgtgagactgtttctgaacccagtaacctccacctctgggggcagtttcatctccagtggtttgtgccacaaactagacaggtttgaggtggcttcatcttgctgcctgggcattccttcttaaaatgccctggcctgccacactaatagcaattagccgatgcacctgggggatcctggactttgcaagcctgttaagctgctgctagagactttgtcctttttctgagctttctttcttttgggcctccttctggtccctattataaaagactgaagtggccaccttcaggaagttctctaaggtgctatttggtcctatagcttgcttctgtagttttcttctaatattgggagctgcctgtgtaataaacttgtccttcaggatgagctgtcccttgactgaattaggggataaagaggcgtgttctattagtgcttctctcagcctttccataaaggctacaagattctcatttggcttttggtttattatagatagtttagagtaattgagtggttggtcctggtttttcataggccttctaaaatgcatattaaaaagtgctttcttttccatctagctcctgagctattggggtttcagttagagttgtctactggaactgcttccctcccaattgggaatggtgtttctactactttttcactttcccaatctgctttcttaccttttggtgtattatgggagatacacattgttcattttcaaaattctctgctgcttgcagagctgcctgcttttcagctgcagtgagggtctgacttaggaccaatatgacattacttcttattttggagagcttttatatacctatcagggtcatcagaaaatcagcctaagtctccctttatttgcttaaggtcctataatcagaagcgaacttgaaggggccccaactaagggggatccttagatggttcccctggaaattgcttttttaattttgggaaactattttccttgggcctgcctgatatgattgctcaaagagctgggttgatcttacaatgcttgtaaaggtttagtaaaaatgctatgcccttgtggaaaagaaaatgagttgcttttttcttcaatgttctgaggttaaggaagtgccagtgtttccgagtgcattccagaggggtgcaagctgaagataatttgttacccatttagaaaaagaaaagagaataaaagcgtcctcttattctccttcctttccatatgacccagagtggaggagaagacagggagcatcctcggacatttttccttccctggtttctggatcctggccccatgttaaatgtgccacccatggttgaaggcatggtccttcaaaccatggaatcagatgagctaagcgatgggactaaccacgctttacccatgcaaccttagcttctctgccttgtgtgattcccctctgacttcctaaagctgtgtgatcctcctggctccccgaaaaatggatctcgggagagactgtgtcacctttgggcaaggctcctttaatgtaggcaatgtgctagattgcctgctattatggcccgtgctaaagcatttacccttaaaaaaaatggttccggttatcttctgaatttaaaatccccttactaattaagtactatcttaattggagacagaataggtgccttaaaagaatgtagcaactgaatggccattttcctgctgatgggacaatatccagactaaaatttggctgtggaagacatcttactcctaactgttgcagcaaaggactggcaatgtgtcttatgaagaggatttctatttccactagatgaagcgctgttggcttagaaataccatgtgctcattagcagtgagtgacctcactgtgggtgaaaggcgagaactctcttcctagaaggttgcaatggcatttttcctgagctatatccccagtctacagcatttcctgatcttgcctaacaggattatttcgctagcccataaaagttcccacacattcgacacacacacagagagtaagagactacagatagagaagaaaagtttggcgacaggatagctggaggagagccttgaaattaaaggacagatttaaggtggaagttcgctcctaatactcaccactccgatgaatgaattctcggcccatgaaccaaaatgatacagctctgataaatgaaggaatggggggctcggaacaaagaggaaccccgggtgcagcaaagaagtagttgcttatattgggaagctaaaggaggcagtatctaatttacgtagggcccaggggattggtttaaccaggtgtatcatccacatagcccatgagaaacctggccctcctaccttagtcctttaatatgcaaatgtgggtcaccacactgttttatcacatggtgttatctaaaggtggccataatacttggcacatctggtaacaagaaggaaaaggtgggactcgccatgttaagtggacccagattttaatcatcagcatttgcatatcaaagcttgctggcctggcccttcctgttgcgttttctgttaagtaagaaatgtttcttattacaggaaaatttgcaccaagaacctttaccctttctagtggcctaaaaactgtttcttaataactcctgtattattgccatgaacgttggtgtacaaatatttttatgagtctgcactttcaatttttgtaggtatatacccaaaagtagaaggttagctcgtatggtaattctatgtttaactttttgaagagctgtcatactgttttccacagcagctgcaccatgttccattcccattagtaatgcacaaggacttcagtttcttcccgttctcaccaacaattgttatattcagtttgttttattaataatagtaattgtaatgggtgtgaagtggtatcatcttgtaggtttgattttcatttccttaatgattagtgatgttgagtgtcttctcctgtgcttatttctcatctgtaggtcttctttggagaaatgtctgttcaagtcctttgcccatcttttaactgcactgttgtttttgttgctattgttgttatagagactggggatttctttatgtattctggatattaattccttatctgatatatgatttgcaaatactttcttccattctgtgtgttgccattttactcagttgattgtgtccactgatgcacaatagtttctaattttatgttggcttttctgtgtatccagttatagtttagtccattcatcaaaagccacattcacaaattccttaaaaaataggcacctttactctgggaggcttgccaagcttctgagtgacaactcccttaatattagaaactgttttgtataactaaagggtgtctactaagtacaatcttaaatctctcaaaggcctcaacaaaatgtactatagttacacccttgatgtgagatagtttcttactttgagtgtgaatggctggagataaggattctccttacaatcggaacagtttgttcctttagcataactctttcttcttttactttatcaaaaacagcaaatataagctaattgacacacttaacactctgattttaaattattttgccaaagttcacaaattgattaggtacatttaaaattttttttcgaagactacacattgggtacagagtacactgctcaggtgatgggtgaacctaaatctcagaaatcaccactaaataacttaattatgtaaccagacaccaccctttgcaagtaaactctcaggattttagttccagcaaatgaaggcaaaagtgactaatcagagcaaatgagactcagccaggtgcatcagtcgcagggtgcatgagcctcatccagctggcacagagcactgcttctgtgaccaccaagctgcagacaaaccagcagactgcaaagaactacatcacttagaagctgatagaagtcttattattgtgatagattatgctgaaacattgagccttactgtacttaatcatttcatataattttcacaatgacagtaaaatcctgtcacaagtggcactgtcaacttttctgcttttctatgtgcattcccttttcctcacattgacattcaaattacagagtctccttcgtctaaaggagctgtcctattgaagcagcatccttgcctggggaaatacccgaggtttgtcgtctcgttctgagattaatgacatggacacacacacatggaatgggttaaggagcaggaagttaaataggcagaagaaaggagagaggagagcagcttgctctttgttatgagagagagatgtccaaaagggaaaagtcggccggcggcggactgctccagatcttataggcaggatggaggaggcagtgttggatttccgtaggccccacagtttggtttgatcaggtgtaatgtttacatggtgcccagggaaggctggttgccctgccctaatcttattatgcaaatggactttctacttggccagcgccatcttgtctgctccttactgtacgtgtggctggcaaagagaagatggagctgccattttgaacatgcctattcccaggaggccttttcctattggcacaactgccggcattcgcctgtgcaagcttctagcttgcttgtctatgtctgcagcttgattttacaggctgatgtttgttagaaaagaaaatgattttggagttgcttttcattaaaaggaaaaccttactgaggactcccgtaccctcagtgtctgcctaagtaatttcttcttaactcctatataaccagctcgctaatgggaccaattcatttgacctgcactgcagtacagccacagagctgagtaatatgtataggatccagggggaatgagccctcccagctggcccctcctgccatttgattcagagatgagagttcctctttcttttgacttaggctgatttatagaaaaaaagcacattccagaataattaagtaaagtattagccagatagtcttcagctgctggcttggattatataacaactccctaattctagaagctaaggaacagaaggccagcattttctctgatttcctatagttttaatgcttttccactctccccttcccttctcccagcccactgtcccaccacttcactgcatatgcctttgaaagtctatgtggatcatattcttcagctattttgattatcttgggtgcttctgcttacactgccatgtatcctggcctcataaaatattcactttacgtgacccttgcttgctgcctttaacacactcaccatagaactcttgcagagacaaaattccaggaaaagcacctgcaactgttagtgcgttaaaccagtattccgagatgactaaatgcattgcttctgccgtagaagaaaatgctggggtgaagcgagagcacaggtgaaagacctggttttccttaaatggataaagcctcagaggcttttatattcttggaggacccagtcctgattcttctgatcatttttcaaatcaacttaatgaatatgagatgggctgtacattaaactgatataacaggtaaatatcacctgcatttagcatgggcagctgatatagggcaactgttttctgtgattgtaaagaatttgtaaggggagtaaaaatgtgggccggatttctgaatgagatttacgttctgctctcactcttgacccgctgccacaataaacacggggagatatttttaagctctcatgagtaaaagcaatgccaactgctatggattgcttttggtagaattttgggtaatttcgcattacaaatgtttcctctacttacgccttccttaaaagataactaaatgccaagcccactggaataaacatacagagtaaagagctacatataccccaacatattgtttttccaaagctacaagcctatgtcagatgctttgtaccccacactgctgtccaagtgaagcctccttcctctatcttccaagtacagcccaaaccctaaatatgacctttaaaaggaccctttacaaagtgggtgtttaaagtgaataaaatgtcatctaatcatctattccttttgccttaagctgcagagtcatccacgtttgctatttccttcaagtctactttcttttcctaaacaccggaagcttcagagccactcacgcattgcagtaattttgctggctcagggtaaaaaataaggccttttctgtgttgatgaaatcaggccggttcctcagtaggatctgtggtctagggtgaccctggagagacatgaatttctaatttttatactttactcaaatttcataaattatttttatttcaaaatccagtgctttagggctgggcgcagtggctcatgcctgtaatcagcactttgggaggctgaggcgggcagattgcttgatgccaggagcttgagaccagcctggccaacatggtgaaacccggtatctactaaaaataaaataaaaaattagctgggcgtggtggtgacacctgtagtcccagcgactcgggaggctgaggcagaagaattgcttgaacccaggaggcagaggttgcagtgagccgagatcgtgccactgcactccagcctgggtgacagagcgagactccctctcaaaaacattttttaaaaatccagtgcttcataatgaattgattaggtgcctaagggtatcagggaacctgccccgatattcacgtaggttcttttctattttccttaagcgttggccagcttgatctccattcatattatatggtatttcattcatggcttctctgggagagaagcactgagttgtacctctcagtcagccaacaacactcccgcttgtgatgttcccgtataataatgagaaaagaggctcccatgggtatcccacacacgtgcataaaagaaatgccttcaaagtgaaaatgatgccacgctacacctagtgtaggatcacctgggttagctggggaaaaaaatgcttcagtgtctgtagtcatgaagtgattctgtattttattgtagaaatcatatcaagtatcagtttcaaacgatttttcttttttttttttttgagatggagtctcgctctgttgcccaggctgcagtgcagtggcacgatctctgctcactgcagcctccgcttctcgggttcaaatgattctcctgcctcagcctcccaagtatctgggattacaggtgctcaccaccgcacccggctaatttttgtatttttagtagagacagtgtctcaccacattggccaggctggtctcgactcctggcctcaggtgatccacctgccttggcctcccaaagtgctgggattacaggtgtgagccaccgtgcctggctacaagcaatttttacatactccatgcttaagttgagatgttgcctctactttctttctttctttccaggagtgtcagcagctatagtgaagtttcaagaagggggaatgctgtcgggactgagcaggcaatggcctaaaaacaataaaaagccctactaaaagctggttttctttttattattatcctgtactgacaattcttagtaatatcagtgatgaaataaatcactggggaagacctctcccacaccagcccctagttgatatggcactgtgaaagcactccaatatctttctttctttttttcttttttgagacggagtcttgctctgtcacccaggctggagtgaagtggcgcaacctcggctcactgcaagctccgcctcccgggttcaggccattctcctgcctcagcctcccaagtagctgggactacaggcacccgccaccacacccgactaattttttgtagttttagtagagacggagtttcactgtgttagccaggatggtctccatctcctgacctcgtgatccgcccgtcttgtcctctcaaagtgctgggattataggcgtgagccactgcacccggcttccgatatctttcttaggaaggatacatcatcatttaaataatgaaagcaatatatattcactgtagaacatccagaaaaatttgaaaaaatatttttaggagagaatcaaaattcacattaactccaccacttattgataatcatagatctttatgtcattattactttttattattaaaagtaattctgccatatatatccttgttacatatatttcttttgacatttgtgatttttttggggaagtacattcttgaaagtttaactttttaaaaagcatcaaatatatatcatcatgtccttaaaaagtatttatcaatttataattcctagattagtgtacacctctcccaacacaaaactttatcatgaaaaataaatcctgattatttaattggcaaaacttttttgagttttccaattgttttgttactacgtttaataggtcactacttttttcaggataatagtcatttcctcattgctctcttagcttctgataacaagcagctcaccatttctctagcctttgctagagaagagctcccctgatgcatctggaaccctgggttgctttcttagactgagagtagtcacacatatttgtggtgcttgttatcatagcaccttacttacaagcaccaattttaaatactctaatactctgtaaagaaccaccacaaaaaagtggcttaatgcaaaagccatttatttagctaataattttgctagatatttcttttggtctgtatgtggcttggctgggaagttctgcttgtctcagctgggctcattaatgcttctgaaatcagcttctagtcaaaaaggtgtctttgattctggaagttggctaaatattagatagggtcactgggctttgtgttttgtgtcttctaggcgggtaggccaggcttcttcacataacaagtgttgcagggatcccacagtgtcaagagagagaaatccagtgctcaaacactttaacatctttgcatgtgtcacctttgctgctgttccactagccaaagaaacagaatgttcatcctcctgtcaaaacccccactacccttcccagcctctggttaccatccttctactctctgtgaccattagttcaattgtcttgatttttcaatcccacaaataagtgagaacatgcgatgtttgtctttctgttcttggcttatttaacttaacacaataatctccagcatccatgttgctccaaatgactggatctcatactttttttatggctgagtagtactccattgtgtatatgcaccacattttcttatgcatttatctcttgatggacccttctaaatcttagttattgcaaacagtgctccaagaaacatagggatgcactgatttccttgcttttgggtatatacccagcagtgagattgctggatcatatggtagctcaattttgagtgtttttgaggaaagtgcaaactattctcctcagtggtacatccccactagtacatccccactagcagtgtacaagggtttccttttctctgcattctcttcagcatttgtcatgtgatgagcctcttatatattgtggttattaatcccttgtcagatgggcagtttgcaaatattttctcccattcaatgggttgtctcttcactttgttgattgtatctttcaatgtgcaggatttttttttgacagagtcttgctccgttgcccaggctggagtgcagtgacatgatctcggctcactgcaagctctgcctcccaggttcatgccattctcctgcctcagcctcccaagtagctgggactacaggcgcctgccaccatgtccagccaattttttttttgtatttttagtagagacagggtttcaccgtgttagccaggatggtcttgatctcctgacctcgtgatgcacctgcctcggcctcccaaagtgctgggattacaggcgtgagccactgcaccgggcttactggaaaaagaagaaattagaacatgtattataatatgttgtgaaaaaggatgtttctaacacagtatacggtatcattttaatggtaatccactcattgaggattttcccactttctccacatactgtttttcagtgtaggattacatttataatgatatccattttagaaattcagtattcaattttcataaaaaagaaatagtactacaaattgagtgcattaaacattgcctaaaatcatgttgttatatatttttattaaatcattatttgcatattatcactgatttcctggatttcaattggagtggattcctatggctactttagaatatagcatattgtaaaatgaaagagatgtgaaatattaattatatccactagtttttaaaaataatttatctttttcagtttgattacatgggctctgatataaacactgtaacgcagaaggttattcagataattggccttgttaacagtgtaagtttttaaaaactattttattttatttatttatttttttaatttttaattttttttaaagtatttattgatcattcttgggtgtttctcggagagggggatttggcagggtcacaggacaatagtggaggaaaggtcggcagataaacatgtgaacaagggtctctggttttcctaggcagaagaccctgccgccttccgcagtgtttgcgtccctgggtactggagattagggagtggagatgactcttaacgagcatgctgccttcaagcatctgtttaacaaagcacatcttgcaccgcccttaatccatttaaccctgagttgacacagcacatgtttcagagagcacggggttgggggtaaggttatagattaacagcatctcaaggcagaagaatttttctaagtacagaacaaaatggagtctcccatgtctacttctttctacacagacaccataacaatctgatttctctttcttttccccacatttccccctttttctattcgacaaaaccgccattgtcatcatggcccgttctgaatgagctgttgggtacacctcccagacggggtgtcggccgggcagaggggctcctcacttcccagacagggcagccaggcagaggcgccccccacctcccggacggggcagctgctgggtgggggctgcccaccacctccctcccagacggggcggctggccgggcgggggctgccccccacctccctcccggacggggcagctggctgggcggggtctgccccccacctccctcccggatggggcggctggctgggcgggggctgccccccatctcccggatggggcggctgctgggcggaggggctcctcacttcccagatggggcggctgccgggcggaggggctcctcacttctcagacggggtggccgggcggagatgctcctcacctcccagacagggtggcggttgggcagagacactcctcagttcccagacggggttgccgccgggcagaggcgctcctcacatcccagacggggcggcagggtagaggcgctccccacatctcagacgatgggcggccaggcagagacactcctcacttcccagacggggtggtagccgggaagaggcgctcctcacttcccagactgggcggctgggcagaggggctcctcacatcccagacgatggttggccaggcagagactctcctcacttcccagacgggatggcggcggggaagaggcgctcctcatttcccagactgggcagcagggcagaggggctcctcacatcccagactatgggcggccaggcagagacgctcctcacttcccagacggggtggcggccgggcagaggctgcaatctcggcactttcggaggccaaggcaggcggctgggaggtggaggttgtagcgagcggagatcacgccactgcactccagcctgggcaccattgagcactgagtgagcgagaccccgtctgcaatcccagcacctcgggaggccgaggctggcagatcactcccggttaggagctggagaccatctttggtctttctcacaattcaaaatacattcatttcacccaagtagcccccaaagtattaacttctagcatcaactaaaaaatctgaagttcaaattctaatctaagtcagatgagggtaagactctaggcatggtttatcctgaggcaaattcctctccagctgtaagcctgtgcaattaacaagttgcattgttttttggtgcttccaaaatacaatggaggaacaggcacaggatagacattcccattccaaaagggagaaataggcaagaaggaaggggtaactggtctcacataactccaaaacccaacgtggaaaaacagtattggcttaaacctggagaataacctcctttgactccatgtcctccatcctgggcatacttgggtggaggttgagtctgtaaaacatcaggattcttgcttctttctggtcttagtccacccagtagctttcacatgttggagtctcatgcctgtatctctcccagactgaggttgcaagctggtggctttaaagttctggggcctcagggactgccccactcccatggcttcactaggcatttccctagtgggagctctctgtgatggtctcactcttatggccttgataggttttgctctagtgggagctctctgcagtggctctatccctgtgacaagtctctgcttgggctcccaggtcgttgatgacattatttgaaaagatctaggtggaggtcaccatggtctggcaactgttgtgttctgcaggtttgcagagttagcatcatgtggacattgtcaaggcttaccacttgtgccctttggagaggtggctgagccacacctgggcccacttgagtaatggatggggaagctgagaagcactgtgtcagaatgcagagtcccagggcagccctgggcagtgaacctgtggagcacaccccaggcctgttctctgaaaccattcagcccttttagagctctgagcctgtgatgggatgatgggagaggcatcctcagagatctcagaaatgccttcagggtcattctcttgttgtcttcctagttaagcaggatagaacctggctttattgtatccatattaatctctttagcaaacagttgcttttttttttttttttttgagacggagtctcactctgtcacccaggctggagtgcagtggtgcgagctcagctcactgcaactttcgcctcctgggttcaagcaattctcctgcctcagcctccagagtagctggaattataggcacgtgctaccatgactggctaatttttgtatttttagtagagaaggggtttcaccatattggccaggctggtctcgaactcctgacctcaagtaatcctcctgcctcagcctcctaaagttctgggattacaggtgtgagccaccatgcctggtcacagttgcctttttaaacatgcttttttatttcttacatagccatcctgaaagttttcaaatctgtctgttctgcttcttttaatgataaattccatatttaaatcatttccattctcattttactataagcagccaaaagaagccaggcagcaccttgaacactttgccacttagatatttcttctgccagatatcctagttcatcactcttaaattgagtcatggatggggaagctgagaagcactgtgccagattgcagagtcccaaggcagccctgaacagtgaacctgtggagcacaggatgtcttccacatggtcctaggacgccaaaacaattccactaaattctttgcaactgtgtagcaaggatggcctttacttctgtttccagtaccttgtttctcatttccacctgaggcctcatcagaatgaacattaagtccatatttttattggttttatgatcacaaccacttaagtaatatttaagaagttccagactttctctacacttcttcacttcttttgagccctcaccacaatctcccttaatgctccatttatgacaatctaggacttttctgcttctccaaactcttgtagcccctacccattattcagttccaaagctgcttttacatttttagaaatttgttatagcaatagctccactactggtaccatttttttttcttattctgatttgtactgttaaaacagaatgcccacgactgggtaattataaagaagagaggtttatttgccttagggttctggatcctgataaattcaaggttgagaggcccacatcttgtgagagttccttgctgtgttatcccatgacaaaaggcataagggcaagaaagcagacacacgtactggagaggggatcaaactcacttttatgacaaacccactgttctgaaaatgaacttgttcttgtgataatgacattagtacattcataaggacagagccctcatgatttaatcacctcgtaaaggtcccacctctaaacactgttgcattgggtattaagtttctaacacatgaacattaggggacacattcaaatatgggggtgatattatacataattcagccttaaaaaacaaatacattttgtcatttatgacaacatggatgaatctggagaagattatgctgagtgaaatataatccaggcacagaaaacaaattctgcctgattttacttataggtagaatctaaaaaagtcaaactcatcaaagtagagagtagaatggtggttaccagaggctgggggtggggagtggggaatggggaatggaaagatactggtaaaaacgtacaaaagtttggttagaaaaaagaaataattttagagtaaattgcacagtgcagtgactatagttaataataacatgttgtatatttcaatattgccaaagagcacattttaaacattctcatcacaaagaaataataaatacgtgaggtgagggatatgctaattagcgtgatttatacatatattgcaatatatacatgtatcgaaacatcacattgtgcctcataaatatatataattatcatcaactgaaaataaaatttttaagagttaaaatgctttgatacctgcatttaaaactggcattgtacaatataaagataaatggtaaaattcatgctaataacttagaattttaatttaggacaacactgactagcaaacaaataacaccatgactcctgagagactgctgaaaaaagaaaaagctttttgttttaataccattaacagtaattttccctgctttatacataaggggccccatatttccattcctgaaaactaagctgttagtcctagtttttctgcatcaatgccaagacttgatatgctcagtatgttcaatttacgtctctttagttggtatgtagtattatctcatataggttgtatatgtacttccctagaagctaatgatttgaacatattttcatacttcatatcctttgcatagcttatttggtaatgtgcctatttagatcttttttccactttgtaaaataaaaatataggtttttgtgctgttgatgaattacaagatttgtttgtatattctggctatggtttctttaccagatacatgattttcaattgtttctttgtagtctgtggcttgtcttttttctttatagttgtcttctctggaagacaggttttaaaattttgattcaaaagtccaatttatcaatttttatgcaacatgcgtttatagctcttatagttagtttatgatacattttgcaattattgtacatgtgtccaagttcatttttattttgtcatatagagtgacagttattctaatactatttgttgaaaagactagccttttacccacttaattgtcttggcaattttgtcaaaaatcaatttaccatgaatgtgtggatttattattggaatatctattctaattcattaacctgtatgtctatccttataggaaagcacactgtctctattactgtagctttacactgagtttgaaatcaggtagtgcaagtgccatgagtttttaaatattttcccaaattgttttggctattctaggtcctttacatattcatctatattttattatcagctttgtaatttctgcaagagtcctgctgggatattgcattttcaatatcatagttgttttttttttttaagacggagtctcgatctgttgcccagactggagtgcagtggcatgatcttggctcaccacaacctctgccttctgggttcaagcgattcatctgcctcagcctcccaagtagctgggactgcaaggtgcgtgccaccacgcctggctaatttttgtatttttagtagagacagggttttgccatgttggccaggctggtcttgaactcttgacctcaggttatccgcctaccttggcttcccaaagtgctgggtttacaggtgtgagccactgcgattggccaaaactccttttaagaaaggatgagacggtattggtgatggagcttgctgtagcaggcaagcaacatcagtttgcaaggaaaaaaaattcatcttgtttgtgctgtcattgaacaggactgacaacagcatgaacaatagtcaacaccacagacatttcaattggttcagctaacacaattctggctgaaaaattaaaggtgagcaaattttccactcagtgggtgccaaagtcattgtgtccagagatagataagagcagataagagcagaactttgatggagatcagataagaacagaactttgatggaaattttttgaagcaattttgaaaaaaaaatcaaataaaactagtgaattttgcaagtcattggatacacaatcagtgtattaatataacaatgaattggatttctgtatatttggcaacaaatagaaaatgagataaaaggtacaattccatgtataatgtttttcaaaacaggaagtatatagatataacattcatgaagtatgtacaattgtgtacaaataaaaattaagattctgaaacatttcattgaagaattgtaacaggaggtggaacagctttaccagcacaatcctgaagataaaacacagtcaaagcaatggctaccaagtggtggacgtggtccagccaaagccaaagtgaaccagtcaagagcaaatgtcatggcaaaagctttttgagatactcaagatactttgcttgttgactttctagagggccaaaaaacctgccaattaggagactattttgagaaacttagccaaagctttcgcagaaaaatgcctatgaaagtttcacccgagagtccttcattataacaatgctcctgctcattcttctcaacaataagagcaattttgtgagagttttgatggaaaattattaggcatccatcttatagtcttgatttggctccttctgtcttctttttgtttcctaatcttaaaaactctttaaagggcactcatttttcttcagttaataatgtaaaaaagacttcattgacctagtaaaatttccaggatcctcagttatttaggtccggactaaacagttgatatcattgcttacaaaactgtcttgaacttgatgttgagaaataaagtttatatatttattttcatattttcattttattttttcatgaacttttagaggtccgtgtatctataccagatcttgtataaaacaagatgtatgactaaaaagaattttggaatgtgtgtgtgtgtgtgtgtgtgtgtgtgtgtatatatatatacatatatatatacacacacatatatttattttattataaatatatattattcttggagttaaaaacatgttaaaacatgttaatataataagtatattttaagatttgctaattgtcttctatgaagaataatgctctttaaatctctctttaaagcaccatattatgggatatataaaaatatacaacattaatttgtgtcatacccatatttttatatattaggtactctggtggtgtaaaggattttaacatctgtagcttggatgactttaaatatatttcttctcataatggccttacatgtcttcagacaaaccctcttgaaatgccaacctacacacacaggagaatatgtggcaatgggttgttggaaggaagtgaagaatgtgactgtggcactaaagacgttagtagaatattttttctaaaatttaaaaaatgttctagtagtaaagaagataaatgccttatctattagtaaaatagatttgaaaaatatattctttggaaaagatgggagcctttgttttctaattttattatttttggaagcatggtccttagataatttttgtcttcagttattgtcttctgacattatttagtgtgtgtattagctccaaacgtaaatttaattaccactaagagtggtgaagggattgaaagatataccctcaacaacaagcagaaataaaaacagttaacaacatctaaaaacggtagattataaccaatggggtagcaaaatgcatggtttgttaatataggtaaaaacattttctgtggaaaggtgattctaattaaaatattttgaaattaaatctatcataattataaaaaatataaaaatatacaaccaagatcaaacaaaaataattataaaatatgataaagggacatccgcaagatggcccattagacagcactagaggtgcctaatgctggtctcccaacacaagagaggaccaaaacaatggataaacaactacatttgaccagagtgagtcatagagtgctggagtacaggaggggagtggcaaaaacccagtggtgcacagaaactcagaatgactgcttagagagaagaaggaaacactgcggttatgacaagataaacgcataatgataaagaacaagaagtaaaactcagtctggcttagaaatatagattactggcaatcttcaaaataataaaactaatgaatcttgcaagtcattgaatacaaaagtcaacatataacaatgaattggatttctgtgtagaaacagcgaacagaaaatgaaatcaaagggacaattctacatataatgtttcccaaaacatgatatgtatagatataacaaaataacatgcaattgtgcgcaataaaaattaacattactcaggaaaagcaaaaaacattgaaatgaatggagacatttcccactttcatggattgggagacataatattgagatttcagctctacacaaatggatccatacatttaacacagccccaaccaaaatccacttatctttttgtagaaattgacaagctgattctacgattgatatggaaatggaaatgacctagaataaaccaagccatgaaaagaaaaacaataaattggagcacatatgctaattttctataaatttcaatattttctatgaagttataataatgaaaaggtagtattgaccaaaggataaatatatacaattaataaagtagaacagagaatccagctataaaataatatttatatggccattttgcatggtaagacaaagggctattcaatgggtgaagaaaatctttccaacaaaattgtatgaactaaacatatgtgtaaataaaataaaacttcacctctcaccagacacaaaaaattgacttgaaataaatcaaagacctaaaaattagagctaaagctcaaaaacttttgggataaaacataagagaaaatctttgtgactggtggtaggcaaaattttttagattatggcgaaaagaagaagtttaaagagaaaaatgataagttgtactttctcaaatttagaacctttttcacttagactctgataaaaataaaatggcaagctccagaatgtgagaaaatatgtacaatttgtatattgacaagtggcttttattcaaatatgtgaaaagacaagacttagtttctggtcaggtatctaagacacttggaagttgccactccaatgtgtcaactagtaaaaaggtgaacagactgaataagctgcaactctttttagatctgttggagaagtgagatcacaggatgaagcactgcccccaaattcaatagaccaacaagtgaatacagaggatcacaacttgctagaacagaagcatgtgagttaaactttcacacagccagcgctggagtagaaaagcctaaactaaaattgacaaatgtcagaggctcagtgtatgtaactatgagagttaagaactccaggaggacccagttattgaggttgttatcatatttttatgagctttacctctagaagtttaatcttgttctcacagtgaatatcagagaaaaattccctgtgcttccagaagaaggaggagaaaaggaaccattttgaaataagtcagagtgttcagttcctaccaaaaagaaatggaagggaaaaattaggatgattatgttattatgaattacactatccctgaagtggtatagtgttatttgaaagtggacttggattagttgtaaatgtatattttcatctctagggccaccactaaaaaaatgttttaaaaaagtataactgatacactaagaaaagatagaaaatagcattgtaaaatgctcagttaaacacaaaaggcaggctgggcatcgtgacgtgcacctgtagtttcagctacttgagaggatgaggtgagaggattccttgaacctagaagttcaaatcagcctgagcaacatggtgagatcctttttctaaaaagaaataaaaaaggaaaagaaaaaaaagacaaaaacaagaagaaccaaagtcacacaaatagaaaacagcaataaatatagtagttattaatttaactgtattcattatcactttgctttcaatgatttaagtgcaccaatttaaaaaataaaagagattgtcagaatggatcaaaaaccaagatctagctctctgttgtggtgggtaatactgagtgtcagattgactggaatgaaggatgcaaagtattgttcctgggtgtgtctgtgagggtgttgccaaaagagattaacatttgagtcagtggactgggagaggcagtggactgggagagacccacccttaatctgggtaggcaccatctaatcagctgccagcacggccagaataaaagcaggcagaagaacattgaaagactagactggctgagtcttctggcctacatctttcccccatgctgaatgcttcctgcccttgaacatcgaactccaagttcttcagctttggtactcttggaccttcgaccacagactgaaggctgcgctatcggattccctacttttgagattttgggactgagactggcttccttgctcctcagtgtgcagatggcctattgtgggacctcaccttctgatcatgtgagtcaatactctttaataaactcccctttatatatacatctatcctatttgttctgtccctctagagaaccctgacaaatacagttgtctacaaggagccctctttaatataaatatacatgtagataaaaattacagaatggagaaaaatatgctatgcaacagtgataaaaaaaaatccaggagtagctatattaatttcagacaagcagtctgcagaatgagggacaattataatgacaaaggggtcaattctgcaagaagacataacaatttttaatgtgtatgtgactaacaacagagtatcaaaatacatgaggcaaaaactgatagaactgtaaggagaaatagatgaatctgttattatagctggagacttcaacactgctttatcagaaaaaggcagatccagcagacaaaaaatcagtaaagacatagtggaactcaacaataactttaaccaactggatataatggacatctatggatgacttcatccaacaaaagaatacacatttttctcaaagtcatattgaacattcagcaagacaggccatgttctgagccacaaataccactaaacaaacttcaaggaatagataccataaaatgtctgacctcagaccacagtgaaaatgaactagaaatttgtaacagaaagattgctggaaagtcccaaaaacttggagattaaaaatcacatgtctaaataacacatgggttatctaagaaatatcaggagaaatttaaaaatagtttgaactgaataaaaataaatacacagttatcaaaagccatggtattcagcaaaacagtgctcagagtaaagtttataacattggttgcatgtattagaaaaggaaaaatatctaaaatcaacagtgtaagcttccaccttaagaaaccagtaaaagaacaaactaaagtaagcataagaaaaaaaataataaaaattagagcagaaatcaatgaaactgaaaacaataaattaataggtacaatcaataagattaaaagatggttttttgaaaagatcaataaaattaatatgcctcttatcagactaagaaaaaagagaaatgacacatattactaacatcagaaataaaagagagtacatcactacagacagggtattaaaaggatgatcaaagagctatatgaacaactctatgcccacaaattttataacttagataaattgactaaatccttgaaatacaatctgccagatttaaacaaaaacagacaatattaataggcctacatctatttaagaaattgaataaataattaataaccttccagaagagaaagcatcaggcccaggtgaatttaccagtaaattctactaatcatgtaaagaaaaaacatataccaattctctatagtctcttttagaagataaaagcaaaggaaatacttcttaacttattctgtgaagtcagcatactcaaatactgaaaaccaaaatgaaggccttacaaagaaagaaaactacaaaacagtatcactcaaaagcatagaggcaaaaatacccaacaaaatattagcaaataaattccaacaatgtataaaaagaattgtacaacataatcaggtaggatttatcccaaatgtgcaaggctagttcaacatttgaaaatcagctaatgtaatccatcacatcaacaaagtaaaggtagaaaaattatgtgatcatattaatagatgcattaaaagcattttatagaagttaacaatcattcatgataaaaacactgagtaaattaagaatgacaaaaacttcctcaactcaattaaaaaatatcaacaaagaaccgacctgtgaggaattggaagctttttcactaaatcaggaacaaatgaaggatgtcccctttcaccactacttttcaatatcacactgggagccctaggtaatgcaataaatgataaatgtaaataaattgatacacattcggaggaaggaaattaaagtgtcattgttcccaaatggcatgatagtctatgtaaaaaatctgaaaaaatcagcaacagcaaaaaaccatgtgaaacaaataagtggttatagcaaggttgtaggatacaaggttaatatatgaaagtcaacctttttcatatataccaacaatgaacaggtagaatttgaaattaaaaatgcgataccatctacattctcattccctgaaattaaatacttaggtataaatctaaaaaaatgttcaagatctatatgaggaaaagtataaaactctgattttaaaaaaagaaaaaaccaaataagttaagcaatattccatgtttataaataggaaaacaatattttcagatgtcagctcttccaactttgatctagaaattcaatgcaattccaatcaaaatctcagaaaagttgtttgtggataccgataaagtaattctaaagtttgtatggagaggcaataaacccagaatagtcacaatattaaaggacaataacaaagtttgaggactgatactacctgactcaagagttactataaacgtacaacaatgaggaaagtgtagtatttacataagaatacacagatagattgatggaatgggatacagagcccagaaatagaccgatataaatatagtcaactgatttttgacaaaggagctaagatcatatgatggaacaaagatagtattttcaacaaatggtgctagaacaactggatatccatgtgcacaaatgtgaatattgacacaaaccttatacgttttgcaaaaactaacttaaaatggatcacactcctaaatgtaaaatgcaaaactgtaacacttctatgagataacataggagaaaatctagaagatcttgggtttggcaatgactttttagattaaaaaaaccaaaggcacatacatgaaataaataattgagaagatgggctgtattgaaatttaaataatgtctctctgcagaagatgctttcaagaaaatgaaaagacaagtcacagatttttgagaaaatatttgcaaaagacagacattataaaggactttatccaaaatacacaaagaacttttaaagctcaattatacagtttgactgtgtccccaccctaatcttgtcttgaactgtagttcccagaatccccacatgtggggggagggacccagtgggaggtaatttaatcatgggggtggctaccctcatgttgttcttgtgatagtgaattctcatgagatctgatggttttataagaggcttttctcccttttgcttggtacttcttgctgcagccatgtgaaggatgtgtttgctccccttttgccatgattgtaagtgtcctggctcccctgccagccatgctgaactatgagtcaattaaactttttttataaattacccactggcaggtatgtctttattagcaatgtgagactgaactaacatagtaagttggtaccaggagtgggaggctgctgtggaattgactttggaacctaaagatgtggaagtggctttggaactgggtaacaggcgaagattggaacagtttggagggttcagaaaaagacaggaagatgtgggaaattttggaatgtccttgagacttgttgaatagctttgatgaaaatgttgatagtgatatggacaatgaagttcaggctaaggtggtctcagatggagatgaggagcttcttgggaactgcaataaaagtaattcttgctatgcttcagcaagagactggcagcattttgctcctgccctagagatctgtggaactttgaacttgggagagataatttagagtatctggcagaaaaaatttctaagcagcaaagcattcaagatgtgactttttaaaatttattcacaaagatattgtttggaattggaacttatgtttaaaagggaaacagagcataaaagtttggaaaattcacaggctgatgatgtgatagagaagaaaaaaaaaaccattttctgaagagaaagagaaattcaagctatctccagaaatttgcataagtaatgaggagccaatgttaatcaccaagacaatggggaatatatctccagggcatgtcagaagggcagcccttcccatcacagacccagaggactaggaggaaaaatggtttcatgggctgggcccagggtcttgctgctttgtgcagtctcaggatttggtgtcctacatcccaaccatggctaaaagggcagaggcacagctcaggctatggcttcaaagggtgcaagccccccaagccttggcagcttctacgtggtgtttagcctgtgggcacacagaagtcaagaattgaggtttggaacctctgcctagatttcagaggatgtattgaaatgcccggatgtccaggcagaagtttgctgcaggctggcaccctcatggagaacctctgctagggaagtgcaaaagggaaatgtggggttggagcccctcccaaagaagtccccaccatggcactgcctagtggagctgtgagaagagggccaccattctcctgaacctagaatggtagatccattgacagcttgcactgtgcacctggaaaagccagagacactcatgccagcccacaaagaaagctgggaggggtgctgtaccctgaaaagccacaggggcacagttgcccaaggctgtgggaacccacctcttgcatcagtgtgacctggatgtgagatgtggagtcaaaggagatcatttcagagctttaagatgtgactgccccaatggattttggacttgcatggggcctgtagcaccttcattttggccaatttctcccatttggaatggatgtatttatgcaatgtctataccccattgcatctagaaagtaactaacttgcttttgattttacaggcttataggcagaaagaacttaccctgctgggaaagcatgattgtgttttaaaatgtgacgacatgagatttgggaagggccatgggcacaatgatatggttttgctgtgtccccacccaaatctcattttgaattgcagttctcatgatccccatgttttgtgggagggacccagtgggaagtaattgaatcatggaggtggttaccctcatgctgttcttgtgatagtgagtgagttctcatgagatctgatagttttataaggggtttttctccctattgcttggcacttctcctcgctgcagccatatgaagaaggacatgtttgcttcccattctcccatgactgtaagtgtcccgaggcctccccagccatgctgaactgtgagtcaattaaacctcttacctttataaattacccagcattgggtatgtttttactagcagtttgagaagagactaatacactcaacagtaagaaaacaaacaacctgagtaaaaaagagccaaggactttaacagacaccttgccaaaaaaaggtatacagatggcaaatatgaaaaggtgtgccacatcatatattattgctgaaatgcaaattaaaacaccaaggtaccactacctacctattaaatgatcaaaaatctagaacactaaaaacacaaaatgctgatgaggctgtggggcaacaggaattctcattcattatttaataagcaagatgagtggaatgcaaaatagcacagccattttggaaaataggatggtggtttcttttaaaactaaatatgctcttaccatattatctggcaatcactctctttagtattttacccaaaagagttgcagatttatgtccacatataaacatgcacacagatgtttctagtagctgcacacagatgtttctagtagattaatttttaattgccaaaacttggaagcaactaaaatatttttgaataggtaaatgaataaatagtctttgctgcattggacaatggaacaatgctctaaaaatattgtctattaaataaaaagtgctaaaaagaaatgagctatcaagccatgaaaaaacatgaagaaatctaagatatgtattactaggtcaaagaagccatctgaaaaagctgtgtaccacatggtttcaactatatgacattctagaaaagataacagtatggggacagtaaaaagatcagcagttgccaggggttaaagggacgggagggatgattaggtagaacacagaggacttttaggacagtgaaactactctgtatgatactgtggtggtggatacatgtcattataaatttttcaaacacataccatgtacaacaccaaagtaaaccctaactaatgtaaaattgaactccaggtgtaatggtgtgtcaaggtagggttatcatttgtaacaaatgtaccactctgatctgttgataaggagggaggctgtgtatgtgtgtgggcgaggcatgtggaaaatctctgtaccttctgcccaattttgctgtgatcctaacaatgctctaaaaatattttatattaaacaaaatttaaaaagacaaaatctgtatttcttgagagtacatattataactcaattaaaaggagacaaatgacctaataaaattaggcaaaataatttggacagtttacagtagattatttataaatgacaataagaaaatgaaatgatgtttaatatcactagtcatctgggaaaaataattaaaaccacatcatatatactgcacacatattagaatgtctgtaataatacatccccttctgataaaaatagtgagttttgttgagatgtagagcaactgaaatttgtgtaaattgctagttgggtgtaaaaatatttgaagcattttggccatgtcttataaagttaaatatatactttccttttgacctagatttccatctctgagtattttttttccaaagaaatgaaaatatatatcccccaaaatatttctacatgaatgtttagagctgctttattcatggcagccaaatactagaaataatccaaatacctatcattatttggacagatacattgtggtatttctagtcattggaaaactactcagcaataaaaaatgaacaaaatgctggtaaatttatcaccattggtgaatcacaaaaaagattatgctgattgaaatgagccagattcacaaggttatgtgatatatgattctgtttctgtaaaattataaaaaaatggcaagtaatctttagtgtgaagaagtggttgacttcaataagtaggagatatctctggtcggcaatggaagtgttctgtaacttgattatatgagtaaatgcatatggcaaaattcattaaactaaacattttaaatgggtgtagtttattgcaattaagttagttgaagggtacatgctttcagttatgcaagaataccctctactgtaaatttatgtagccagaatacttctcccagaatacttttgttgattctgtagttaactcagtgtatgattgtgattcaaccatgatttgataattggagttctatcctaatttgctaactcttaccgagtaaattcatctttattaaatctggtatattagttgctgttgaattatttctcaacctcatacaaattatattaattaacccaaaaccttttagcacgcacaccaagacaatcaacaaaacctgatttgggccctgatttgtagcacttgctgaattccttcctttaaacactcccacaatggcagatttaaagtgacaaatgcaacattattaaatgcagagttggaaaaatgtgaatggtagcagatcattatacagtatttccaccaaaaattaataatagacattaatattttcaagagcataggtaaaattaaaatgtaggaaaataagaaatgatgttttcaatatttgttaccttttaaaaatttaatttatttcattgtaagttaatgaaattcaatttttattaatggctttgttagcaacctgttcacaaaatttctgaaaatttaacaattggcccttgcaagccagaacagggttggtccagcacactaggacatgtaataattctaaattaaaaatcacgcaaacatagtttcaaaatattttaaagcgaaattttactatgaggagagacagacaaattcacaatcactttaagagttgttaacacatctttggcaggaaacaatagaaaaagcaaatgaaggccaggcacagtggctcacagctgtaatcccagcactttgggaggccaagatggatggatagcttgaggtcagcattttgagaccagcctgaccaacatggtgaaaccccgtctctactaaaaatacaaaaattagccgggtgtggtggcagacgcctgtaatcccagctatttgggattactataagaaaagattcattaaagagggtaggaaggacagttttacattacctgcatcgcccctccctgaaccccaggcagcaccgcacagcacagcacagcatagcacagcacagcacagcgaaagatactgtctgcttgccagaaaaagagggaagtgagacttggactgtaccttttaaccaataccaggtcaaccgcagtaaaacctggcactgggcagatgcccaaggcccttgaatcttagctggtaattatgatctgagctttcagacctgccgcagcaccaaacagtaacctctagcccctgcaagatggcctcaagtttcggcctgcatcaccacccacctactacaacagtgttgggcttcaaaagcccacagtgacaaggtgacttcagcagctgggagggttgaattctagcccagtgtaactttagcagccaagagattgaaaatcaaacaggaatcctggaactgaaaatacaatgaatgatgtttaaaaatgcagtaaagagtgcaaacagcagaactgataaagccaaagaaagaatctgtgaaataggagataactattttgaaaatattcagttagaggagaaaatagaaaaagaatgaaaaggaatgaagaaaactcacaggctttatggggcaccatcaaaaaaggtaatatatgagcagctggtgttgaagaaagaataaaaaagatgaagagatagatggtggccgggtgcggtggctcacgcctgtaatcccagcactttgggaggcccaggtgggctgatcacaaggtcaggagatcgagaccatcctggctaacacgatgaaaccccgtctctattaaaaatacaaaaaaattagccaggtgtggtggtgggcgcctgtagtcccagctactcgggaggctgaggcaggagaatggtgtgaacccgggaggcggagcttgcagtgaaccaagatcgcacctctgcactccagcctgtgggacagagtgagactccatctcaaaaaaaaaaaaaatagcttatttacagaaataatagaagagaaaactctccaaacctagagaaagatatactccacgtacaggaaaagtcaaaagtctccaattagattcaatccaaataatcaataaatgtatatgttctaattgatccctatccagccattcccctgtctttccctctccacaggcttttctgttccttgaaacacaacaatattgacattagaccaattaataaccatacatggcctctaagcgttcaccagaaagaaagtttcatgtttttcattttaagtcaaaagctagaaatgatcaagattcctgcgacaggcatgtcaaaagctgaaataggttgaaagccaggactttgtgctaaacagttagccaagttaggaatacaaaggaaagttcttgaaagaaagtaaaagcactagcccagtgaacacacaaatgataagaaagcaaaacaggcttattgctgatatggaaaaagttttagtggtttggatggaagatccaaccggccacaacattccctcaagccaaagcctaatccagagcaaggacctaactctctttaattttatgatggctgagagaagtgagtaagctgcaggagaaaattttaagctagcagatgtttgtttataagatttaaggaaagaagatttttccatagcatgagtgcaaggtgaagcagcaagtgctgatacagaagctgcagcaagttatccaaaagatctagctaagatcattgatgctggtatctacactaaacaatggattttcagtgtagatgaaacagccttttattgaaaaaagatgctaatatagtttggctatttgtccctatccaaatctctgttaaattgcaatccccactgctggaggtggggtctggtgggaagtgtttggattttgggggtggatccctcatggcttggtgctatcttcacgatagtgattaagttctcatgagatctgattggttaaaagggtgtggcatgtctcccttctcccccaaccaactccctcttgctttggctcctgttcttgccatgtgatgtgcctgacctcctttgccttctgccatgaatggaagcttcctgaggcctccccagaagaagatgccactatgtttcctgtacagcctgcagaaccatgaatcgattaaatgtcttttcttgtaaagtactcaatctcagatactactttatggcagtggaagaatggcctaataccgatgctttctaggactttcatagctagagagaatttaatgcctggcttcaaagctttaggctgactctcttgttatgggctaatacaactggtgactttaagttaaagccaatgatcatttatcattccaaaaatcccatgacccttaagaattgcgctaaatctgctctgcctgtgctctatgttggaacaacaaagcctggatgacagcatatctgtttacagcatggcttaatgaatatgttcagctcattgttgagacccaatactcaggaaaaaaagattcctttgaaaacattactgctcattgacaatgcgactagtcacccaagagctctgatggagatgtataagcagattaatgttttcatacctgcttaacacaatatccattctgcagcccatggtcagacaaatgatcaaggagtcattttgactttcaagccttattatgtaaagactctagctgccatagatagtgtcttctgatgggtgtgggcaaaattatctaaaaatcttcagaaaggatacaccatttaaaataccattaagaacatttgcaattcatagatggagatcaaaatatcaacattaacaagagtttgggagaagttgattcaaactttcatggatgactttgaagggttcaggatttcagtggaggaggtagatgcagatgtgatacaaatagtaagagaactagaattagagtctgaagatgtgactgaattgctgcaatctcctaataaaacttgaattgatgaggagttgcttcttatggatgagcgaagaaagtgatttcttgagatggaatatattcctggtgaaggtactgtgaacattttcaaaatgacaatataggatttggaatattacataaacaaagttgataaagcagtgacaacatttgaagggattgacttcagtgttgacagaagttttactgtgagttaaatgctatcaaacagcattgcatgctacagagaaatctttcaggaaagaaagagtcaattgatgtggccaatttcattgttgtcctattttaagatattgccacagccacttcaattgttaatagccatgaccctgattagtcagcgccatcaacattgaggcaagatcctccagcagcaaaaagattaccagtaaactgaaggctcagatgattgttatcactttttatcaataaaatattttttaattaaagtatgtatattttttaggcatagcgctattatacactacaatatagtgtgaacacaacttatatgcactgggaaaccccaaaacttatgtggcttgctttattactgtatttgttttactgaggttctctagaactgaatccacaatacctctgaggtacatctatatatagaaaactccaccaaaaaaacaaaacaaaacaaaaaaaaaacaactgttagatttagtacataaattcagtaaagttgtaggatacaaaatgtacatactaaagtcagtggtgttcctatacattaatagtgaattatctcaaaaagaaatcaagagaacaatcccattatgatagataaaaataaaatacttaagaataaatttaaccagggagttaattgatgtctacactgaaaactaaaaaatattgatgatagaaattgaagacacaaataaatggaaagctatcccctgttcatggattggaaaaattaatattgttaaaatatctataatacccgaagcaatctacaggttaattgcaattcttatcacaatactaatgacactcttcacagaaatagaaaaataattcctaaagttcaaatgaaatcagaaaagacccccaatagccaaagcaatcttgtgcaaaaagaacaaagctataggcatcacactacctgaccttgaaatatactacacagttatagtaaccaaaacagcatggtactggcataaaaccagatacttagaccaatggaacaaaatacagagcctggaaataattccactcatttacagtcaactgattttctacaaaggtgccaagaatacataactgaagaaaggatagtttcttcaataaatggtgttggaaaaactggatgtccacatacagcagtatgaagttagatccttatctctctccatgtgcaaaaataaaaccgaaatggattaaagacttaaatataagactcaaagttgtaaaactacttgaagaaaacagggaaaaagctttatgacattgttctggtcagttattatttcggacatgacttcaaaaacatagacaacaaaagcaaaaatatacaaatgggattatatcaagctgaaaagcctctgcacagcaaaggaaacaatcaaaaacgtgaagagagaatctacagaatgggagaaaatatttgaaaactatacatctgataagggttaatatccaaaatacataaggaattcaaacaactcaatagcaagaaaacaacccaattaaaaaatgtggaaaagatctgaataggcatttctcaaaaggagtcatatagatggccaataggtatatttaaaaagtgctcaatattactatcttgagtatcttgtcaatcaaaaccacaatgagctatcacctcacttctgttggaatgggtatgatcaaaagaccacagataacaagtcttggcaaggatatggagtaaagagcacccctacacactgtttataggcttgtaaattaatacggccattatggaagacaataggggagttcctcaaaatattaaaaatagaattaccatgagacccagtgattcctctactgggtatgtatccgaaggaaataaaatctgtttgttgaagagacattaacactcctgtgtttattccagcactatttacaatagccaaattatggaatcaacctctgtgtccatcagcagatgattggataaagacagtgtggtatacatacacagtggaatactatttagccataaaaagtaggaaattctgtaatttgtggcagtatggttaaactgggaggatattatcttaagataaataagccaggtacagaaagacaaataacgtataatcatactcgtatgtagaatcttaaaaagttgatctcatagaattagagattagaatggttgtttcagggaggaaggaatggggagatgttggttgaaggatgtgtaattaagttagagagggggaataaattcaagataactattgtatagcatagttactataattatgttgtatttttgacaaatgcagagaatggataataatgttctcactacaaaagaactatatatatagttcactttaaaatattgtgttgtatatgataaatacatgtaattttacctatcaactaaaaaattcccaaataatttttcacacccagcagagttcactgaaatactctgggaaaatgaaacaaactctgaaacagggtaaatgacagacatccataagattggagggagtgtatgcttttaaaattaagtcattataggctctataagcaatttcagaaaaaaaataacattctcaaaaaaaaaatttcaaggcttggcatctttgaactaagagaatgttgtaaaaatagaacaaaataaaactgaaggtgaataaagtgaagaatcattacagataaactacattcacaatttaaacttaagataaatgccaaacttagagaatatcagaattcttatggctcaaactagttattgacatggaagataaatatgagaaattacagccaaatgtaaggattatagcagagagaaaaacagaaaaaaatagatagcactgaacacacagatagtaagtttttaaaatcaatataaaaaatcagtggcttccagcattctgtttagctttttcatattattcctaaaattacgtagagtaacaatgtgcagatcaaaccttgccaaaataggatgagataaaatgttggcattagaagcagacaggttcatttaaagcttaaagttatttgttcattcactaattcaggaaatagtttactccacactatctagtgggagatagtaaacagaataaacatataagcaaacaaacactaaacaagatagtttcagacagtgataagtgatttaaaaataaaataaaataggacgatagaataaaaagtgagggaagagggtattttagccagagtaaacaggaaatgtctttctgaggggtgacatttgagctaaaaccttaatgacaaagaaaataattggcatagaggcttcagggaataaatgaagtggtagagagatccttattttggacatgacttcaaaacatagacaacaaaagcaaaaatatacaaatgggattacatcaacctgaaaggaagatgtatacataaaggaagaaaagtggcctgttttgctctaatttaatgactaatagagaaatagtgtactggtcctagtcaatgtgactcttcagaattattcagccatgattttttttttctcagtgttactgatggagaaacaaaagtacgtagctaacagttattttcaaagtatggattctatcaaaattgtcaactcaaatcataattaggtaagatgatttagaaccacattctaaaatgttgttgactgcatgttctcacttataagtgggagtacacatggacacaaagaaggaaacagcagacaccagggcttagatgagagtggagggtgtgaggagaatgaggatcgaaaaactgcttatcgggtaagcagataagcttacctgggtgacaaaattatctgtgcagcaaatccctgtgacacataatttacccatgtagcaaacctgcatatgtgtcccttgaatgtaaaaaaaagttggaaagaaaaaaaaaaaggagatattaagctaaaaaaaaaatgtggttgactaatcaaacaatttttaaattggttcctgttttaaaggtgataaaaatgatttcatttgcatgtgaatatcagcttctgaatttaccagcagatttgctatagtgtagtggtggatggtttaccagacagagtttatgtgactattgaaatgggctccatcatggtttgatgctcaattctaatgccagattgttttgagaagaaatgtttcatgtgctctttccagagacaaatctcctgatagagcaattacacaggatatttggtaaagctctggccagtttgataattcactacgtaagtccagatagcctgactggtgaattctaacaaatatttaaagaagggataatacaaaaatactccacaatcttttgcataaaatagaagaggaaggaacccttctaaatttattttatgagaacagtattaccttgatactaacgctagacaaagacaagaaaagaaaactatagatcaatatccctcacgaatatggatgcaaaaagtcctttaaaaatggcaaacagaataaagaaacataaaaggaagtatccaacatgaccaaaaaggattatctcagtaatgcaaaagtggtatagttaatgtaacacaccatactaacataataaaggacaagaaaatacaagatcatctcaaatgatgcagaaaagggatataacaaaatgtaacacccattatagattattaacaaattgtaaatagaagggaacttcccctacctgatgcaaagtatttatgaaaaacctacagctaacatcatactaaccatgaaattctcactgctctccaccctaaaatcagaatgaaagtgaggatgcaagctctcagtacttctactaaacattgtattggaggtccaagagagtaaaatcaggtaggaataaaaattaaaatgcatctaacttggaagacaaaaagtataactgtctttatttgcagattacaccaccccgtgtatgtaaaatcttaggaaatttaccaaaatacctgtttgaataaataaatgaattcagcaaagtcacaggatacccaattgctatgcaaaaatgaattgcacttctatatattagcaatggaaaatagaaaaataaaattaagaatagaatttcattcacaatagcataaaaatacatacttaggcatatattaagaatacaaaatatacatgcaaacaacaaaaaatttctgagaaaaatacaaaaacctaaataaatgctgagatcttccatgtgaatgggttgaaaaatggtattgttaagacagcgattctcccttctgtcagggatccccagtattaccccttggttcagtaaatcagtaggaagactcacgtgattgagcatagaatgtactcatcactataatttattacagaaaaaggatacaaagcaaaattagcaaaggaaaaaggctcatgggtcaagtatgaaggaaagtagtcacaggcttccaagagtcatttcctagtagagtcacccatgatggacttaattcctccagcaatgaattatgacaatatgtgtgaaatcttgactgccgggaacccagaccctaagatttttattagaggctggtcacataggcatcgtttgcctagtatctacccaaattccaaattcttagatggaaattggttgttcactataaataacaaggtctaaacagttcaggcacagtgacttattagttaggcaatggtgtgggaacggtaactgaggtgtcagccaaaggccagctttcgaatatacctttctaagtatagcagtctgaagtctgctatgttaactcttctgtacatctctaaattgatctatggatttaagacaagctttggcgaaattctagtaggcttctttgcagaaattgatgacataatcctaaaaattctggaaatgcaaggcacccagaagtgctaaaacaatcctgaagaacaaattgatggagtcaccatttcatatttcaaaaattactacaaagctaaagtaatctagcttaacattgtactggcataacattaaatacatggataaatgggatggaattgagagtccagaaataaactcttatatttatagtccattgatttttgacaaatgtgtcaagacaatttgatagaggaataatagtcttttcagcaaaggctattgggacaattcaatatccacatacaaaaatgtaaatttggacccttttatcatgccatacacaaaatttaactcaaaatagacaatcaacctaactgcagtagttaaaactatacatctattggaagaaaacataggaaaaattattcataaccttggatttggcagaaacttccaagacacaacatcacaagtataattcataaaagaaatagttggtaaactggactttatcaaaattaaaaaccttcgtgcctcagaaaacactattaagacaataaaaagacaagtcacagaggggaagaaaatatttacaaactgtgtttctgatatagtacttgtatacagaatctattaataatgctaacaactcaataattgaagggaaacaatccaattacaaatgtatgaaatatttgaacaggtaaaatacctgttcaaagaagataggcaaatatatacaaagttatatacaatgatatacaaaatatatagaaatatatacaaaataattacatagaataataaatacatgaaaaatagtaaagacattgttagtcattagcaatgtgtatattcaaacaagatactacaagacacccactagaatggctgtaatcaaatgacagaaaataacaaatactggtgaaaacatagagaaacaggaactcatagactgctagtaggaccaaaaaatggtgttgctactttgggaaacagtttgacagtctgttaagcagtttaacataagtttaccaattgaacgaaggattctactcctaggtctactcaagataaatgaaaacacgtatttacaaaaattcgcatatggatgtctatagcaacattattcaacgaccaaaatctgaaaacaactcaaatatctataaactaattgacaaaaactatgatatatccatacaatggaatactagagagcaataaacgttgacagaatactcatacatactacaatctcaaaaacactactgtgcaagagaagctaaatacaaaaccccacccattttatcattttatttgtagaagaggtcccaaaatgcaaatttatagagacagtaagtagattagtggttacctggggccagccacagacatggggattaactataaatggatacctgggatcttatcctatgctaatagaaatgtcctaaacttgggttgtggtgctggttgcacaactatgtaaattttcttaaaatatcactaaagtgtacacttaacataggtgaattttatggtatgtacgttataaattaaacctcaataaagttaaaaacagaaaaggtcaccctgatgaagataaactcccacctagtggacaagaaacatgtttctcctgaatttagtgattgtggactcaagagttgtgttagttgataataagtgaaaaaaatgatttcagcatatctgtaggccatgggaaatatttattaaaatggtgtccttgaaggttttacagtgagaattgtagaatgatggaaatgtcatccagtatgtcagtggagcagatgatatctctaaaaagaaaaagtaaataagaatatgtaggtgttattgaaaataatatcacattgtgagaaacaatgtggcataacagaacaaaactgaaatcagaatgtttggatttaaatttgtgtctatacttttgtctctcataatgtcatatagttgtaagaatatacgcatgtagccttttcagattggcttttttccattaccaacatatatttatagttcatctatgttctatagctatagttcatggcttggtagctaattgctttttatagctggataatattcaattatatgaatgtaccagagtttacttatgtatttatctattgaaagacatttaatttacttcccaattttggcaattataaataaatctgtaataagcctttaaaaaataaaaaattccattacccatcttgtcgagtcacattataggctcacaatttcctaactttaaaaacagtgtttgttctaattatttaacagatatatatttggggtgcaatgtatttgaaaattgtttttttgaaatatgctaattcagtaagctattcttttttataatacattttatttgagattgctacagatttctggacacacacacacgcacacatgcacacacatgaataagcaaaaaataatagattgaccctgaaaaaagcataattttcaaaaaattataagggctactctcataatatacaattaatgtgtcagagttttattcaactcattaatgagggaactagaaagaataataggcttgttcaagagtaagtaacaaaactagataaataggatttggaaacaaaagaatgttagcataatattactatgttcaaaactggttaatatccacaggaaaaaaacaataacttatttggttatcttttctaaatgacaggaattatttcctattctatcagacaaaaacctaaaagttaatatgtaacttcacaaagtctatgacaattaatcaatatttcttagtttcattacttttttctagcctctatttcatttatttctgttcctatctttatttccttttttctactaactttggattttgctttttctagtcccttgaggtgtaattacattaggttgattatttgatatctttcttcttttttgatgtagatatttattgctataaacttccccactggaatgatttttgctgcatctgataagttttagtatattgtgtgactattattgtttgtatcaagatatttcacaatatttttaaattttcattttaagtgcctctttgatccattgattgttcagcagtatgttgcttaattttcatatacttgtaaaatttccaaattccaagtcctgttattgacttcttgttatatcaatgtggtgagaaagatacttgatactattttaattattttaaattttctaagacttactttgctgcctgacatatgatctatcctggagcatatttcatgtgttcttgagaaaaatatatattctgttgctgtttgatagaatgttttttatgtgtatagtaggtccatttggtctaaagtgtagtttgagtctgatgttttcttattaattttctgtctggattatctgtctgttgttgaaagtggaatattgaagtccattatgattattgtattacagtatatctcttctttaaaatctattaatattgatatatatcatactttatatattatatatattatacacacacaattactactagacctcagaaatgaagttgatggcaacacaatgatagtgggggtcttcaatgctccactgagagcactagaaaggtccaagacagaaagtcaacaaagaaacaatggacttaaagtataccctagaacaaatggacttaacacatatttatagaacattctacccaacgactgcagaatgtacattctgttcatcagcacacggaacatactccaagatagaccatatgatagaccacaaaacaagtctcaataaagataagaaaatcgaaatcattatcaagtgctctctcagaccacagtgcaatacaattggaaatcaacttcaaaaggaaccctcaaaaccatgcaaatatatcaagttgaataacctgctcctgaatgatcattgggtcaccaatgaaatcaagatggaaatttaaaaattctttgaactgaatggtaatagtacacaacctatcaaaacctctgggatacagcaaaagcagtgctgagaggaaagttcacagcattaaatggctacatcaaaaagtctgaaagagtacaaataggcaatctaaggtcacacctcaaaaaactcagaaaacaagaataaaccaaatccaaccccagcagaaaaagagaaataacaaagatcagagcagaactaaatgaaattgaaataaaaaaatacaaaaaataaatgaaacaaaaagttggttctttgaaaagataaacaaatatgatagaccgttagtgagattaaccaagaagagaagagagaggatccaaataacctcaattagaaacaaaataggagacattacaactgatgttacagacatacaaaagataattcaaggctactataaacacctttatgtgcacaaactagaaaacctagaggagacagataaattcctggaaatatacaatcctcctagattaaaccagaaagaaatagaagctctgaacagatcgataatgggtagcaagattgaaacagtaataaaaaaaatgccaacaaaaaaaaagttcaggaccacatggattcacaactgaattctttcagacattgaaagaattggtgccaatcctactgaaactattccaaaagataaagagggaatcttccctaaatcattctattaagccagtattaccctaataccaaaaccaggaaaggacataacataaaaagaaaactacagaccaatatcactgatgaacatagaagcaaaaatcctcaactcaatactagataaatgaattcaacagcatattaaaaagataatctaccatgatcaagtgagttttaaacaagggatgcagggatggtttaacatacagaagtcaacaaatgtgatacactacataaacagaagtgaaaacaaaaatcatatgatcctcaatagatgcataaaagcatttgacaaaatccagcattcttttatgattaagaccttcagcaaaattggcatagaagggacatacctaaatgggaaaaagttgaaagcgttcccccctgagaactggaacaagataaggatgctcactttcaccacttctattaaacatagtactgaaagtcctagccagagcaatcagacgagaaaaaaataaaggggatccaaattgataatgaggaagtcaaaccgtggctgttcaccgatgatatgatcatatacctagaaaaccctagagacttattaaaaaagctcccggatctgatgaatgaattcaataagtttctggatacaaaatcagtgtgcacaaaccagtagcactgctatccaccaacagcgaccaagctgagaatcaaattgagaactcaacccccttcacaacagctgcaaaaagaaacccttaagaatatacctaaccaaagaggtgaaagatctctacaaggaaaactacaaaacactggtgaaagaaatcatagatgacacaaacaaatggaaacatcccatgctcatggatgggtagaatcaataatatgaaaatgaccaatggcaaaaaacaatctgtaatttcaatgcaattttcatcaaaataccatcatcgttcttcacagaactagaaaaacaatcctaaaatgtatagggaacacaaaaagagcccacatagccaaagcaagactaagcaaaaagaacaaatctgcaagtaccacattaccagacttcacactataccacaaagctatagttaccagaacagcatgatactgatataaaaacaggcaagtagaccaatagaacagaatagaggatgcagaaataaggccaaatacttacagccaactgaacttcaacaaagcaaacaaaaacataaagtgtggaaaggacaccctattcaacaaatggtgctgggataattggcaagccacatgtggaagaatgaaactggatcctcatcactcaccttgtacaaaaatcaatcaagatgaattaaagacttaaatttaacatcatctgaacgataaaattctaggagataacatggtaaaaactcttctagacattggcctaggcaaagacttcatgactgaggaccgaaaatcaaatgcaactaaaacaaagataaatagatgggacttaattaaaaagcttctgcacagcaaaagaaatgatcagcagagtaaacaggcaacacacagggtagaagaaaatcttcacaaactgtgcatcagacaaaggaccaatatccagaatctacaaggaatgcaaacaaatcagcaagaaaaacaacagcaacaaataatcctatcaaaaagtgggctaagggcatgaatagacaattctcaaaagaagatatacaaatgaccaacaaacatatgaaaaaatgctcaacatcactaattatcagggaattgagaatcaaagccacaatgtgataccaccttactcctgcaagaatggccataattaaaacttttttaaaaaaaatatgttggtgtggatgtggtgaaaagggaaaacttttacactgctggtgggaatgtgaactagtacaaccactgtggaaaggactatggacattccttaaataaccaaaagtagatccgccatttgatccagcaatcccactgggggcatctacccagaggaaaataaatcattatatgaaaaagacgcttgcttatgcatgtttatagcagcagaattcacaattgcaaaaatatggaaccagtctaaatgactatcaaccaacaagtggacaaagaaccaacaagtggataaagaatttgtggtatatatgtatgtgtatatatatttgtgtgtatatatgtatatatatgtgtatatatatgtatgtgtatatatgtgtatacatgtatgtgtatatatgtatgtatatatgtatatatgtatgtatatatatgcatatatatgtgtatatgtgtatatatagtgtatatatgtgtatatatacacacatatacatatatagtgtatatatgtgtaaatatatacacatatatacatatacacatatacacatatatacatatactcatatatatacactatatatacacatatatacacacacatatatacacgtatatatacacatatatatatacacatacatatatacacatacacatatacaatggaatactactctgccataaaaaggaatgaaataatggcatttgcagtaacctggatggaattggagactgttattctaagtgaagtaactcaagaatggaaaaccaaacatcgtatgttctcacttataagtgggagctaagctataaggatacaaaggcataagagtaatataatggactctggagatgcgtgggaaggtatgggagtggggtgagggataaaagactacacactgggtgcagtgtacactgcttgggtcatgggtgcaacaaaatttcagaaatcacacctaacgaacttatccatgtagccaaaccccacctgttctcccaaacgattgaaataattaataataataaaggtgagatccagaacaaaaaaagatgagcccatgaggtgcacttcttgagcaacacaattcaatttatttaattttacctcaatgattgtgaaaatatagtttttcaatattctaaagtcacgactctcatatacctacaaagtaaaaatatttttaaaagaattttctctgcctctcaatgaaggagccagtaggatgataaagcttgattcaaagagtacttgaggaagtgagtgttcacaggtatttttaaaaatgttagagtaggctgggggcagtggctcatgcctgtaatcccagtactttgggaggccgaggcgcgcggatcatgaggtcaggagatcgagaccatcctggctaacacggtgaaaccctgtctctactaaaaaatacaacaaaaattagccaggcgtggtggtgtgcgcctgtagtcccagctactcgggaggctgaggcaggagaatggcatgaacccgggaggcggagcttgcagtgagccgagatctcgccactgcactccagcctgggtgacagagcaagactccgtctcaaaaaaaaaaaaaaaaaaaagttagaatcaaagtacgattgccttttataccagttcgtaaaaggaaacaaattctgaagaaacaagtgttgatactttctcattatacatatgcaaattttcctctataaatactttgaacaattagttttgaattaaatgttgactctgtaagcttgagtgacagtagatattgtatttgtcttctcatgcatcacctggaaaatttgtgtgagactttttacagatagcaaatacttgaaaacttaagaaaaagttggcgaaaaacaattttgagaagataaatgttatataagctgggccttcaggacctttgaaagctaggaaaatttttatttactttgcataggataatgacaatagccataagagactggggcatgtgttgaagaaagaagagttttcagagatgatgattagatgcttcttagcaaaagtaaatttgtagaaagggaagcccagaagcagatcagaaatatgtaattatggaagttatttttaagttttttgcaacatgaaatttgaaataaatatgaaataaactttctcctgcgtgttcttagaatatcttcatcatttgtgtgattaaatttcttgtgcataaaaaaatgggtaatgcttataagagaagctagaaactcaaagataagcagacatccataaaggaaagaaaggcaaagtggagctagggatataaaaattacttgtaatccattttggctctgctcagttgggcagtttctggtttctccatattaatcttaaagaagaaatcagcagccatttataaaatgataaatcctcatcataaacattttaaaaatgttgcaggctttaaaaggagatattttaagaatcctgtgtgatgcttaaatagttaacaagaagatttaattttctaattgctattagaaacttagggaaaaaaatggaccagcatatagagcctacacagaaataaaacttaaatagcattgatatttaaagttttatgtttctctttcctcctagttcaaaccggctaatatgatttgtaggaaatcagttggtaaagaatgcgatttcactgaatattgcaatggggaccttccatactgtttgcctgacacttatgtacgtgatggagaatattgtgattcaggtggagccttctgttttcaaggaaagtgtcggacttttgacaaacaatgtgatgatttaattggaagaggtaataatcataattttcttcttagtccctaaattctgattattccaaactctgttattgaattttatggaacaaaaatgtaaatgtatgtgttaatgactgaattcttgcataatgtatattagtgttaaagaaaaaacaaaattatcttttctttttcttttttgagacggagtttctctctgtcgcccaggctggagtgcagtggcctgatctcagctcactgtaacctccgcctctttggtccaagcgatcctcctgggttcaagcgatcctcctgccgcagcctacggagtagctgggataacaggagcacactgtcatgggtggttaagtttgtgtttttagtagagacagtgtttcaccatgttggccaggcttgtctcaaactcctagcttcaagtgatctgcccacatcgtgctcccaaagtgctgggattacaggcacgagccactgcgcctggcgcaaaaacaaaattttcatgattgtgaaatacaacaacaaaaaacctctctgaatttatatggaatttctgtaggaacagaaaataaacctcaagtgaaaatgcagtttttcaaaatattatatagaatttgtggtgggggtttagtttaaaggaaacaaggtttcttaatcagaggaaagcagggctaatcactgattagttgggtttctaagcgcttgctgaaaagtgagggcttcagttcattagcaatctagtccattttgataatttcctataaatgtcatttgcttgattggaagatacaaattcctgaacgtatgcagtgcatgttctccgagagagtgaaatttttcattcttagccctcccttgaggtcttctctaaccaggtcatagatctctaaatattgtctacagcaatgtgactgccaggaatttaaggagaaggtgagatgggggttttgatgattttcataattttgtcctgcttttctaacagaatcattatttgtaccatatggcaagacaatagctatagactttaaaacattgttaacatacaaacaaagagctggggccagtagctcatgcctgtaatcccagcactttgggaggccaaggcgggcggatcacaaggtcaggagttcaagaccagcctggccaacatggtgaagccctgtctctactaaaaatacaaaaattagccgggtgtgcttgggatgaggcgggataatcgcttgaatccaggaggccgaggttgcagtgagctgagatcacgccactgcactccagcctgggcgacagagcaagacaccgtcttggaaaacaaaaacaataacaaaatcattcaaacgaatgaccagtaaaattaggaggaatgggacagtacttcagatctatgatctaatgtttctttaagtaaagccaggactcaatgctaggcagataaaattagagccacatagtggattgccaatcaggtgtcttccgggttatgccattcactgtgtatttagtattatcagtgattttaagagattttaaagtcctttgtgagaactgtgggagtacacgggtatttgccccaaagagtacagttttttttttttggaaggcaagcatgacttctaaagcaccttgatttcaaaataatgtatgtccacttctagtgaccatgtgttcatgcatctaggacgtgataattctggacttgactaccagtttttgtacttatttttgaaaaacaatctcactttgctagccccctgagggcaatagaagcctgatgaaaatttaccctcaatggtagctgtatttcaacgcatattaaatccagttctttgtacaataacatgctatacgggtttgcagcctaggagcaataggctacaccatatagcctaggtgtgtagcaggctataccatctaggtttgtttaactacactgtatgatgttcacacaacaatggatacattgctcagaacatatcctcatcattaagcaactgatgactgtactcagtaaatataaggtattattattattattagattatgatgtgtgttccctacaaatatccaattatttgagtaggtcatctatgacctgtcatggttggctcaaatgatccttgagcagggtttgatataattctgaagtaggcattagttttgcttggtaaaacctatatgctatttgtaggaaacagacaataagaattcttataccacaggcctaatacaaatcatcatgcccccccaaattgttgatttctggacaaaatatactaatgaagttgtcacattgaaagacatagcttatttatcaagcaatggcatttaaaatagggaaatctgtagatctatggtaaaagaacgaggttaagtattaagctttttttttttcaaaaaaatcaaaccagtgaaggaaaaacacctcaaatggttaccacctttttctaagctctttactaaattttgtttttggaaatgtctggcccctacagcatgctcctcttcagtgttatctctgcaaatgcagaaacttcctattgtaggtataatataaaatgatgttattacctttggtgttatttggtttgtggttatgtttgccctaataaggctgaaagtctcatgagttgtaaagttccatatattattagagggctttatgaccaagttgagttgtatatcatctagacaaatgttaagtgctaatccaaccgttatacaagggtttctcaacctcagcactagtgataatgtaggccagctcatactttattgtgagaagtgggggcagggaatgcttctcctgtgcattgtaggatatttggcagcgtccttggcctctgcccactagacaggatgcctggagagacttttggttgtcccagcttggatggggtgaatcttggcttctagtgagtacaggtcaggggtgctgctaaatgctttgtaatacacaggatagcctctacaacaaagaattatatctgctgtgctgtgttgagacctccttctctagagagggccagaagtttgactacttaagctgattaagactctgaaaaaggattatattccacactaaagtatgaacagtctttgcaaaactaacctggtaatgtttctttttcaatttttaagatatgatttatcaaaaaccatattggatcaatattcttatgaaagtggcacaaaggttggctctgggcgtagatattttccaaaccatagaagcatacttaccagggacgtgtaaaagatttgctggattattgaatagttgtgtgagaaggagaaataaacaatatttcatgattatttaatcaactaataaaatatgttcagggttttcagcatctatattcaggcttatttagtatatagcactataaaatttaaatgtaatccttatacaaggtctgaggatgcttcaactaatttatctaaagctacaattgctctggatttaagaaacagactacaaacaggtgatggagctttgatgagcactgggcagttaggtaaatattcctataatgtgacttgacctttaatgaacacatagacactaacatttatgataatctggaaaacacagtaaagatgtgaaggctgctttggggtcctgaaggcatcttttacctctcagttcactgaaagatattctgaaatgtttgaaaaagtaaaatcatgtatggaacttagtattccataaaattaggaaccaattgtatatttagccatttaatcctggacatccttaaatttataaatgtctttcagaagtttcttttggataattatgaatagtcaacaatcttttgactatttcagacaaagttcttcctttggctgacaaattatggctaggtgataaaataggatagggaagcttttccttaaaaattttatacttccttttagccaatggaatagataaatatatagagatagcttgaaaactccaaataagtacagataggagatcgcctactttgggcaaaggtagatctggaaggaaactttatattttgagatgctgatttaaaccatgagaaaagtaaggtggatactcagaaaagccttaatgtattattgtcgaagtattattgttctgtagcaccttgtacatgtatggattgtgctccttaactgagtgaaatttacagatcatgttctccaagtatgaaagtctgtgaaattattgaagatagctctcttgtcaattaatagtggtaacaacaaatgatctctattttgattacatatgactaacatgatcaacgtaaactacgtctaaactactaagtcaaagtaataggacagttattatagatgtttgaatttttcagaattttaaaattagacataactaaatatataaaggactgaagtagatgaacattgatattctaattttaaaattcaacaatttttatttagtgattattaggatctaataattattaagatctaataatctaataatagattatgactctagtgtggagcaaggagagttaaatgaagtgttctttgtgtttgtcatcattattgcactaaagatactatttttctactgtttcatttagaataagagtaaacagcattttcacaacgggtagggaagtaaggcaggaagtaaataatttataggaaatagagagggcgacagttgcttatttgtctaacaatacagaagcattctaataatgttgttgtttgttttctgtttctgcagaagaaagtcttctaggcttataaaaaggagtttgttttttaatcctagctctgcccccagaaactttttagtcctgggtaattataaactttcttatggatcacattgtaatttccagattgagtctttcatttctttaatataacttaaattctgtattgtaatttacttaagtttttgttgttgttcataggttcaagaggtgctccggttttctgttatgatgaaattaataccagaggagacaattttggaaactgtggcactgcacactgtctttttcagtatgtatttagaaaattataaaactgtttggaatgtaggttagagattgttaaaatcctaggaaatatattatatgcagtaaaatcgaatgttgggggtcaggttttctttattacatcatctgagctggacaatattatccactgcctacaagaacatttgttcagcgcctataatgttaaaacaacaatgaccataaaaatgtcctctgtttattgttgtgatgagctagacattgttatgcagcttatatatattatatatttataatataggttatattattcaatttatgtacatcaaatgtgtataagaattacttatcccatttactattgaaaaaactgaagaccagagatcattttctcaaatttcagcagctattgtggaacagatcacagctgtcatagtgtaaaaaccattagtttttcacttgccagattgcctcatgaaacaaaaaagaatcataacataagtcattgtgcaaaaaaatatgtactgagagaaaatagttgaaatttggatttaaattagtaaatcactttttaaaaatttcactgtatcagcaacctatgttatctcaataaacaataaggtaatttttttcttccttgtgcttctagacatattctatgtggaaaattagtctgtacatgggaacacagagacttaatatcacgtccaaatttatctgtgatttatgcacatgtacgagaccaaacatgtgtgtctacatacctacccaggaggacgccacctccagtaaattcacctatttcaatcacatcatattattcagctgaagacagagatgaaacatttgtacaagatggttccatgtgtggtcctgatatggtaattagaactacacaaattaaagtgttttaaaatgatttttctggttatactcattttgacaatgtactaaccaatgcattttcttccattttttcttgtggtaaaatgcacgtaatataaaaattgccattttaacctttttaagtgtacaattcagtggtattatatacattcataatgctgtaaaaccatcaccaccctctatcttcataaatcttttcattttgtaaaactgaaactcatttcattaaacaataactccccattcctacctcctctgatcccctgaaaaaccaccattctactttctgactctataaatttgactattataggtatctcacataagaggaataatatagtatttttctttctgactggcttatttcacttagcataaggccctcaagtttcagctatactgtagtatgtcagaatttccttcatttttaaagctgactactattctgttgtatgtacgttctgcattttgtttatctattcatctgttgatgaacatttggaatcattccatgttttagctattataaacaatgccactataatcatggcagtataaatatgtcttcaaaactgtgctttcaatttctgggggtatatacctggaagtagaattgctggatcacatggtagttctatttttaaatttttgaggaactgctccactgtcttccatggtggctataccattttacatttctactagccatgcataatgattccagtttctccacatcctcaccaacacttactttccgtttttttttttttcgatagtagccatcctaatgggtgtgaagtggtatctcactgtaattttgatttgcatttccctaatgatctgtgattttgagcatcttttcatgtgcttattgaccatttgtatatgttctttagggaaatgtctatttaaatgctattcccgtttttaaatcatcttttttgttgttgagttttaggaattctctatatattttggatattactctcttatgatatgattttaaaatattttctttcattctttgagttgcctttttactctgttgatagtgtcttttaatgcacaatttaaaaacaactacgaaatccaattagtctattttttcttttgttgcatgtacttttggtgtcatatccaataaatgactggccaaatcaatattatgaagcttttgccctatattttattctaagagtattatagttttaagctcttatgtttacctatagaatccatttcaagttcatcttggtatgtggtgttaggtaaaggttcagttttattcttttgtgtgtggacatctagtttctccagcaccatttgttgaaaagactgtcctctctccattgaatggtctcagcacccttgtaaaaattcagtagtatctcttaaccatatatgcaagcatttgtttatgggctatttatgctattccattggtaatatattagtctttatgccagtaccacactgttttctttcctgtagcttcctagtaagttttgaaattgggaaatgtgactcttttagctttgttctttttcaagattgtttttggggttctttgagattctatatgaattttagtataaatttttccatttctgcaaaaaaatcattgggatttttatagtaattgtattgaatctgtagatcactttgaatagtatggacatcctaaactgctttgttaaattaattcttaagtactttaagtactttttgatgctatcataaatggaaatgtgttcataatatccctttcagagtgttcattgttactgtatagaaatgaaaccagtttttatatgttgattttgtattttgccactttgctgaatacattgttaattctaactgtttggggtaatccttagagttttctacttataaaattatgtcctctggaagcagaaaagttttaattgttcctttccaatttggatgccttttatttctttttcttggctaacatctctggctagaacttccagtacaatgttgaagagaagtggtgaaaggaagtatccttgccctgttcctgatcttagcggagaagctttgaagtcttatcattaagtataatgtcagttgtgggatttttatatatggatttttatcatgttgaggtagtttccttctacctcatgactgagtgtactttgaatgtttgtgtcatgaaaggtgttgaattttgttaaatgccttttctttatcaattaagatgatcattttgtttttctccttcattctattaatgtggtcattacatcgatcagctatcatacattgaaccatccttgcattccagaaatctcaattggtcatagtgtatactcctaatatagtgcagtttgccagcattttactgaggattctgcatctatgttcataatggttattggtctgtattttttctttgtagtatatttgtctggctttgatatcaggataatgttggccttataaaatgagttagaagatatttcctcttcttcatgtttttggaaaaatttgagaagaactggtgttaattcttctttacatatttgaaggcattatgtccagaaattttcttcataggaaggcttatgattattaattaattaattaaattattaattaaatctccttatgagttaggagtctgttcaggtttttaagttcttcatagtgttgataggttttgtttctaggaatttgtcagttttatcaagctaatccagttcattggtaaacaattgatcttggtattcttataatcctttctatttctgtagaattggtagtaatgttctcacttttattcctgactttagtaatttgagttttctgtctttattagtacatctagataaaggtttgtcaattttgttcatcttttcaaagaaccaatttttggtttccttaagtttattgttttactctgtattttatctccactttaatctttatttccttccttctgctagaatttagtttatttatttatttatttttctatttccttaagttgtaaagttaggttgttgattttaaatttctcttcttttttattgtaagcatttatactaataaatcttccccctagtacttctttcactgcattccataagttttgggatattgtgtttatatttctatttgtttgtaagtattttctaatttccttagtgattccttctttgatccactggttccttaagagtgttttgtttaatttctatagctttgtggagtttacagttttatttagattatttttccaaatttttaatttacttttttattagaaattattattctaaattttttgatacattaaacaatttatttttaaatttttatatattcatggaggtacatgtgcagttattggtgaagttttgacatccagtgtgcctgtcacctgaataatgaacattgtctccagttatttttcaactctaaccctctgattcttcctcacttttggggttgctggtgcctattatttccatctttatgtccatatgtacctattttttagcttccacttacaggtgagaacacatggtatttgattttcagtttctgagttagttcatatatgataatgatgtctacctttatccatgttgctgtactgcatgggacatgatttaattatttttattgctatgtcataattcatgtattatatatccttatatgtctagatatataattcatttattatatatcataatatataataaatgtatatatcatatattaatatcatatatttatatatatatttatatattatatatttatttatataatatattatataacatattatatatttatataatatatattaatatataaatatatatttatatattaaattaatttatatatatttattatattataataatatataatatattatataatatattaaataatatataatatattatctaatatattagataatatataatatattatctaatatattataatatattagataatatattatctaatatataatataatatatattatataatatattatatagtatacaatatattatataatatattgtatactatatattatattatattaatatatataaattatatattaatataatataatatatagtatacaatataatatataatacattatattaattcatacataataaatgaattatataattcatatataataaattcatatataaataatatataataaattaattatatacctagatatgtagatatataatacatgaattactacacagtaatgtatataatataaatacataaataatgtataacataaattcatttaattattgtatatgataaatgcatatattatatattgtataattaatgtaatttattatatataatgaattcttatatataataaatgaattatatatctagatatataaagatatttataaaagatatttatatataaaagataaagatatatatctagatatataaatatctttatatatctagataaataattcatttattatgtattatatatttatataattaattatatattatatataataaatgaattatatatctgttacctttatacctgaattatatatatgtgttaccttttctccacatgaattatgtatatgtgttaccttttcttcacatatatataattatctataagtgttaccttttatccacatcctcaccaacatctgttgtttttagactttttaagaatagccattctgaggcatggcgcggtggctcacgcctgtaatcccagcactttgggaggctgaggagggtggatcacgaggtcaggagatcgagaccatcctggtaaacactgtgaaaccccgtctctactaaaaatacaaaaataatagccgggcctggtggcaggcacctgtagtcccagctactcgggaggctgaggcaggggaatggtgtgaacccgggaggtggagcttgcagtgagcagagattgtgctactgagctccagcctgggcaacagagtgagactctctctaaaaaaataaaaaataaaaaatagccattctgactggtgtgagatggggcatcatcataattttaaattacatttctctgatctttggtgatgctcagcattttatcgtatgtttgctagccactcgtatatcttcttttgagagatgtctgttcatgttctttgcccactcgttactgggattatttgtttttcagttgagttgttgcattcctggtggattctggatatcagttctttgttggatgcatagtttgcaaatattttctcccattctgtaggttgtctgtttactctgttgttatttttttgctatgtagacacttttttagtttaattaaatcctatctatctattttttttgttgttgcatttgcttttggagttttagtcctaagttctatttggggttttaatcctaagtttttgtccagaagagttgtttcctagactttcttcaggaattgttatagtttcaggttttaggtttaagttttgaatgcatcttcggttaatttttgtgtattgtgaaaggtaggggtccagttttattcttctgcatttggctaaccagctatcccagaaccatttattagatagagagtcctttccccatttcttattgaattttgggtgtggctcttttatcctgcaactgtcctgtgttaaattagttgtaggagtttgattgtggacttcttgggatttttttatgtagaaaataatttggaaatagagaccattttattttttccttttcaatctgtatatgttttatttctttttcttgctttactgcagtggttagaacttacagtatgatgttgaataagagtgttgagagaggatgtctctgactttttcctaatctaagaggaatgtattaagtctttcatcattaagtatgttagatgtagggttttttcttttttgcagatgccccttaagttgagctaaccgtcttctactgctaatttattgcaggtttttattatacttgtgtcttgaattttgtcaaatgctttttgtgtgtcgattgatgtggtcacatgagttttcttctttagttcattgaatgttggattacattaatcaatttttaaatgtagaaacagcattacatacttggtattaatatcacttggtcattgtgtataaattttttatacattgttgcatttagtttgctaatattttgttgaataatctttgtaaccaaattcatgaggggtattggtctgtagttttttttttgttgcaatgtatctatctgattttggtcattttatatggcattataaaattaattgaaaactgtttttcactcttctatttttggaaagagattatgtaaaatgtatgttaatttttttctttaaatgttgatagaattctctagtgaaatcatttgggcctggaaatttcattttttaggaggttttaaactatgaattcaatttcttcaattgttgtattggtcttcagattataagctgtttcttggtgatttttggttgctcatagtttcccagaaattggtcaatttcctcaaagtttctgaatttataaatataaagttgttcatagtatttctttataattctgtgtaatggctgcaggatctgcaatgatatcctctatctcatttctgatattggtgatttctgtcttctttttttaacttctcagtcttgctaaagttattaatttcataaaaaattttcaaagcatctgctttttgtttcgttggttttctcagtctagctaaaaatttattaatttcataaaaaatttattaatttcataaaaaatttttaaagactccactctttgttataatggttttctttattattttccagcttttaatttcatatagaactagcaatcaatttcattgatttctgcttttattatcgtttactttcttttgctttgagtttaatttcttcttcctttcctccagtttcttgaagtggtaacttcaatgattgctttgaggctttttctcatttatagcatttggtcttataaatctccctctcagaactgttttagctgcatcctacatattttaatgtatatttttgttttcctttgattctatgtatttttttttagtttctttgagggctatttgatacatgaattgtttataaatgtattgtttaatttcaacatatttagaaattttcctgttgtatttcttttattgatttcaggtttgattttattattatcagagaacatgttctcataattttaatttttaaaaacttgttgaggttttctttatggtaaggagtatgatatatcttgctgcatattccataggcacttgtagaaatgtatattctgttgatacgggttgtagtgacctgtatatgcatcagttaaatcctgttttgtccagattcctgtatatctgctgactttctgtataatttctgtaaattgctgagacaaaggtgtcaaaatatccaactgcaattgtggctttgtctattttcctttcagtgctattactttttgccttatgtttggaggctttgtggtttgggatgtagacatttaggagaactgtgtattattgttggaatgattatcatatcatgacataatgtcttcatttgtctctagtaattttctttgctctgaagtctactgtatcagatataaatatagctactcctgcttttatggataaatgtttgaatgatatattttttctgtcctttttatttaaatctatctctgccattgaattcgaggtgagtttttaaaagcatcacagagttgagtcatgccttcaatacagtgtggcatgtcttttggttggtataatgttattgcctaagtatgttatttcattatttgtttcctctggttcccattcttatttttctcttttcttgcctttcaatgggtgatttaaacattgttttaggatgctatcttgatccagttatagtgtttctaagttagccatgtctttctgtagttttcatagtggctgctcaaggttttatgatatatgtatgtggcctaaagaggctactgctataaacattttgccactttgagtgaaatgagaaaacaacctcattcccattttagttgtgtttaccttccctacatttaagtatcattggtggtgttataatttttgtttcaatcattaactataattttaaaaacctataaagaaatggatagtccattttatttactcatcttcctttccctgtttttttcttcctttgtggtgttccaagatttttgataaacatttctttgctatttcaagtttactgatttaagctcagtcacttggctttttttaaaatttaggttattgtattttttcattctataattcccatttggtttatttttatatcacctgttcctttgctaagatttttgtatttttttatttgtttcaagaagatttgtaattgattattgatttttttataatagctgctttacaatccttgtcatgtaatcccatcatctgaatcatcttggttctgatatcagctggttgtcttttatcattcaagttgtgattttcttagctcttggaatgacttagttgcatccagaaattgtatttattatgttaggagactctgtgtcaaatataaagcactgttttagcaggaagtgatcttgtttaggtcttggccttcttttgtgggctgttccaaaggcagttcaatgttcagagcctttacaatattatttggttggcttggtttacctattgccactggggctctccatggtctttgctggtgcctcctggaaggataggagattcatcaggccagccaactgcatgtctctctgtaggggagaggtgtggtggagttctccatcaggtcccgtttctcactcccacagttttccttatgtctctggatagagaatggggtctcagacctgcacattcaaacaagcctcctgtgctaatatatttgttatgtttccatctctcctttttgttctacccattcacctggtaatgtctttacatggtatgaattttcactcaaatgattaaataatctttaggtggaccttaggtgggcctcttaaagaatgtttaaatagaatattgaaaagttaggtaattctccattttccctatttatttaaaagttcagcagtatatgttattaatcatcttcacacctcttttaagagtaatataacattttagtaatttttatacacacattttttgatgttctgacatataatctaataattttgcatacattattagtgagtaaatctttagacaagagctgaagatctcaaatgaataatagttttggttgagtaagatattatgtgagcaagaatttttctttattagcatggtttttgcgataacatttcttgaattgtatttattgtttcaatagaaaagccaaatgtatgttggtttttactttttataatggactctgattttttcctgattggtagatgaatactttacttaaactgactattattatactattatgttctactataatataatgcacattattgttattatttatttaacataccaaaatatgaaaacaacattaacaattaatatagcacaaaataattatgcaatattattggagacatgtaatattctataaattaagtatatatttaatacaattttaatattctaattgatttaagtcaaaaagatactatgtgaagttaaattaacatactgtttttgagagaaagcttctgagtagacttgctaaatacaaatttatttctatttagtaacattttgataataaatagcacataaaaaggaaacagagtccctgttacttcttgctcattttgaaacatatggaatacaaatatgatctgaagcctcccttacccttgaaatctaaatgatattagctcaaacctccattacagagtcctgactctcctgtttctgcatatagtcattattatgacccaaagacaaaactcactccaggtataaaactctttcacaacgtggtgaatttagtgacagttttttgataattaaagaagatcacataaatgtatgtcataaattagaaaaatttaatttcatccatgaaacttttctttcttagaaggccttttatccagctcaccaagggagtttcccattgtcctgttacctcatataattacctgttgtcctttcttccctctttctttttattttatcatatggaatagtaaactatcttcccttgctgctcatactcatgattttaagatctcacttctctgctcaatagttctcaaacctggctgctcctgagaaacaactggatcctctccccagagtttttgatataatgctctcaaggggagcccacacatgggtatattttaaaatgttcttcagataattcttgaactcaaaggactaatcaagttatttttcccagtagtttatctaagttgacttctggtactaaatggaaagaaaataacacctctggcttcttacatatgattacatctttacaaactgaaagtacatagtttatttcatgtttacttcagtgtagtcacaatttttttttccactggacactcacagctttttaatgcaagtttttgataatatgaattctaatattttcttgaatttttgaatgtgttagccaggcacaaaatctgattttttgactgattttattttgtactttttggctttgtttttagtattgtttcgaaatgcattgtaaacatgttagattcctgatgaatttaaaattgtgtgatgcttctaatcattgtgatcgtcatggagtaagtaactgcaatgtttattttaaacaacttgcttttaacaatcaaacaatttgaggattttaaaaaaataaatgactttttttgtttgccatttttatgtcatttggtgtcatttaatagtctataatttataacctcaattttgtcttcttaagaaacttatcaaactatttattaaagaagacaaagagaaaacatttaagatgattctggatatattaaatgtttgatggatatgtgaggaggatgtgctataagcaatagaagatagaaactggtaaataaagaccattagaattttcttgctagtgctgcaagttaatttagagtctgggctgtcagctagcaagtaggttataattagtgacaggttactggtaatttgaggtatttgggcctggctatggggggagttaaaagaattttttagaaaaaaatttgatttgacaacacaagatagatgtactttgtgtagtatgaacattagcaagggaaaatttgacaaatttatctatttagataaattctctagaatgagatactctgtggaataagtatagattattcattagtctccatcgaaattattcttttttttattatttaaggtttgcaacaattttaaccattgccattgtgaaaagggatataatcctccttactgccaaccaaagcaaggagcatttggaagtattgatgatggacacttagtaccaccaactggttagtgttcttaaaattgtattaattatgcacagtatgtaagatagtaaattataggtttcaagccagattacaaagcaactaatgtcaacatgcttttttttatttataagatttaaaaaatgttgacagtgcaagtttatactgttctttctatatcagcattgacattctttactgagaaaaagtatggccaatgttaggcagttttaaaagtagaaattttggtgtgtaaaatttgaccagttaatttaaactgttcactttggattatctcctatatttatatttactattatatttatatttactatatttattataaactcctataaactagagtttataatagtgtcagtatagtcattattatattaatgcccctagaatctttcaggctgtcttttcttcctattcacttataattggttatttttctcctgcattgtaagggctccatgctaatctttggagatttgctctttctaatcctgtcctgatgttcctgagtagtattttgagattaatcaggcctagatgaattgggctcaactggtggtgaagggcataccctggttctagaaggtatgagcctacccaaaataactgggagcatagatgggctgcgaactctacccccatctctctcttttttgtgtgtgtgagacggagtttcgctcttgtcccccaggctggagtgcaatggcacgatctctgctcactgcaacctccgcctcctgggttcaagtgattctccagcctcagcctcccaaatagctgggattacaggtgcccaccaccacgcccagcttatttttgtattttcagtagagacgggtttcaccatgttggccaggcctctacccccatctcttttaggaccttgcaagaaagtcctgaaactttggggcagacttatctgtagcttgggtgctatataaacacatacctaggttgatcaactttttaaagagacaatacaaagccacatcaaactatgtatcagacaaaaaaaccccataataatttagcctataacctgtaactatacgcatatattattattttcacatgataacatgaaaaatacatgtttatttgaattatgtattttcagtaaacagtagtttacaatgagaaacagaaagtcctataatatagcaatttaactctttaaaaatcctttactagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagaccaatggaacaaaacagagccctcaaaaataatgccgcatatctacaaccatctgatctttgacaaacctgacaaaaacaagaaatggggaaacgattccctgtttaataaatggtgctgggaaaactggctagccatatgtagaaagctgaaactggatcccttccttacaccttatacaaaaattaattcaagatggattaaagacttaaatgttagacctaaaaccataaaaatgctagaggaaaacctaggcaataccattcaggacataggcatgggcaaggacttcatgtctaaaacaccaaaagcaatggcaacaaaagccaaaattgacaaatggatctaattaaattaaagagcttctgcacagcaaaagaaactaccatcagagtgaacaggcaacctacagaatgggagaaaatttttgcaatctcctcatctgacaaagggctaatattcaaaatctacaatgaactccaacgaatttacaagaagaaaacaaacaaccccatcaaaaagtgggcgaaggatatgaacggacacttcttaaaagaagacatttatgcagccaaaagacacatgaaaaactgctcatcatcactggccatcagagaaatgcaaatcaaaaccactatgagatatcatctcacaccagttagaatggcaatcattaaaaagtcaggaaataacaggtgctggagaggatgtggagaaataggaacacttttacactgttggtaggactgtaaactagttcaaccattgtggaagtcagtgtggcgattcctcagggatctagaactagaaataccatttgacccagcaatcccattactgggtatatacccaaaggattataaatcatgctgctataaagaaacatgcacatatatgtttattgtggcactattcacagtagcaaagacttggaaccaagccaaatgtccaacaatgatagactggattaagaaaatgtggcacatatacaccatggactactatgcagccataaaaaatgatgagttcatgtcctttgcagggacatggatgaagctggaaaccatcattctcagcaaactatcgcaaggacaaaaaaccaaacaccacatattctcactcataggtgggaattgaacaatgagaacacatggacacaggaaggggaacatcacacaccggggcctgttgtggggtggagggagaggggagggagagcatttggagatatacctaatgttaaatgacgagttaatgtgtgcagcacaccaacatggcacatgtatacatatgtaactaacttgcatgttgtgcacatgtaccctaaaacttaaagtataatttaaaaaaataataaataaaaaaataaaaatcctttactgggcatttaaatttttatttttatttttatttaaatttctatttttatttaaaattttcagcctatattatataccctgaaggtacataaatgtaagactttcaaagaaagaacataaatcagctaattgcttcaacttgggaggtggaggttgcagtgagctgagggcatgacactgcactccagactaggtgacagagtgagactctgactcaataataataataataataataataataataataataaatacagtcatttagcctccttatctgtgatatcttggtcatgctggtgttcgtattataattgttctattttcgttatccaagttcttagaaaacacaattacaatattctcaatttgaaaaattatatgtgtgctatcttgatgcaaagcacaacagtgattttgtagtgtacgtcaaagatggactgttaacactgatgcttttgatacctttaaattgcacatttaagttacattaatcagagtgaacacacaaattgtggttgccaacgtcagcagtaatggaaagaaaaagaaaaaaaagcagcaatagcaactatagaagatggataatcggtgatttagtcatttgacactaaaacagtgttgcttttagtccctatttttttcaccttttatatttcgttttatattaatattttatatttggttcttttccctgcaaccttccacactagttgccaaccagaaatttttctgtcccagtgacagattcactagcatgtaagactttcagtactacaactaggataagttctaggcaaacctatgtgattggtatcctaggcctaccgctctaagtccagatggaagtccagatcgcagcacatgagcctgcagtcagagaaaaccttctaacccaactagtttcctttagccagctgccatgggctcttctttcatctcttccattctggggcttacaggtctaccctgaaagacctaggctgatatgctagttggctgtatgttttgtccccatgtagtccctttggaggccctctacccagtcaaggaggccttgagctttccccaataaagcctggactcaatgtgggagaaacacttgtgatcctgaatgcattttaggacataaagagtttgggctgcaatggtcatctaaatgagtccaggtttatttcatcatccccattctgcttacttttaatgtcactgctttgtgttaacataatatgacccagaaaaaatgtcaaattatggattttatgattgccttaattgtaagccaaaaacattgttgacttttgttactatttcatgaatattttcaaggaacttacaatctgttctacagctctatgtatatagatataatcatataaaatatgtacataattgaatatatatgtgcttgtatgtatgactatcagctttttgcatatgctggagtctaaattcacatatatttttgcctaattgactacttagtatataaaattataaagagtatattttaatctcactttatgatttttctttccatagtttttcattttatcctaaacctcagagatgaccattaataatactatatacattcctgattttcagaggttattattaacccttttaatatttgacaagttcatagaccagaaaaaattatattctacttacatttctttaatgttatggggcttcccagttgcttgatggtgataggaaatttataatttttctatgaattactatttcatcaccgttgtctctctattcttatgggtttgtttgaccttttataacatacgcatgcaaacacacacacacacacacttaagtgttgcacaatactcataaaatttaccatctgaatgctttttaagtgtataattccatgacattaagtacattgttgtgcaacatcatctctctgcagagctctttccatgttgcaaagccaaaactgtaaatcaattaaacaataagccctcattcctcctcttcccaggccctgcaaactattattctattttctgtctctgaatctgacaacttcagtaactcaaaaatggaatgaatcatgctgtatttgtcttttttgaaaaagcctggcttttttcactaagcccgatgtccttaaggttcatacatattgtagtgtgtgtcagaatttcatttcttttaaaggttgaataacattttattgtatgtatataccacattttgtttagctgttcatctgtcaatggatacttgggtttcttccacatttgggctattgtgaataatgtttctgtgactatgggcttacaaatatctcgagactctgttttcagttattttgtgtatatgtccagaagtgaacttgctgtgtcatatgatgattatatttctaaatattttgaggaatcaccatactattttccagcagcgactttgttttacattcccactagcagtgtacaagttattttctgtttcaatttctccacatccttgtcaatacttgttattttctgttttttttttttttttttttttctgattatagccatcctgatgggtatgaagtggtatctttttgtctctttcatccctgtataggtataatagggtcttatagatcagaaatttatcatttttaaaaagggcatggttttgttaaaaattggttattgggagatattttctgtcattgtatttcaacattacttgttacatgtagaaaatctactgatatttgtgcataaattttatcaatggattatcactatattgagaagtctatttgtttatttttggggatgaacatttttgaaatgatgtaaactgcaattaacagtaattttgccacatcttttcaacaataattctgtgaatggagagagagagagatagagagagacagaaagagagagagggagggagggagcacatgcattctggtctctcctctttttatgaagacaacaatcccatcagattaggaccccacacttattacctcatttaaccctaattatttctcaaagtcctcatctccaaatatcatcacattgggggttgaggcttaaacatatgtatttagggggacacaattcagtctataaaattccactctgtgttccccaaattcatgttcttcttacatgcaaaaaaattcatcccatgccaagagtcccaaaagccttaagccattccagcatcaattttaagtagaaagtctcatctgaatagcatctaaatcaggaatgggtaacatttgagatatgatttatcttgagacaaaatttctccccaactgtgaaagtgtaaaaccagacaaattatgtgtttccaaaatatattttatttatttatttatttattttgagacagagtctcgctctgtcgcccaggctggagtgcagtggcgcgatctctgctcactgcaagctctgcctcccgggttcacgccattctcctgcctcagcctcccgagtagctgggactacaggcgcccgccaccacacccggctaattttttgtattttagtagagacggggtttcactgtattagtcaggatggtcttgatctcctgacctcctgatctgcctacttcggcctcccaaagtgctgggattacaggtatgagccaccacgcccagccctgtttcaaaaatatagtggtgaaataagcataggacagacattcccattccgaaagggagaaattagaaggcaggaagaggtgatgggtttcaagaaattccaaaacctagcagtgcaagttccgttgtgtcttaggcttgagagttggccatacactacacaccagacacctcaattgctttgtctttagtctcccatatgaactgagatgtaaattaaatcctatccaaatcctatttggctgaatgttcttccttccaggctcactgaggtggtgcattacttccacaatcctaggtggcagtcccactcccttggcttgggagcctaccctgttcatactatctttacaatgtcccacccataaggcactgggctagggcaacttggtccgctgaaattaaaaaggaggccccgccctgtataaccaaagagaatgcagccttgatcctttggtctgtggcaccccgataatctttgagtcaaaggcgcaattattctttacttttcttgaaagataaagcatgctcatagcaaaatagcccttttgtcccattctttttccttcatttccaactggcaatgtctctgccagtataattccatctatgctggtattgtcttatgtttctgatttctgctgagatggctgattaaatccattattcacatccgtaatctctttatcaaatgattttctagccacacccttggtattctctccagaacacgttttctgattttgggaaatatggataggctgagaatttctggctaacaattatttcaattacttctttaatccatctctcctctctttcattttaccataagcagtcaggaggactcaggccataacttgaacattttgcctaggggtcacctcagctgttatctaacgtcagcttgcaaactctatctttcacaaaactttagaacacaagttagccaagtctttgccactttttaacaggaatgacctttccttcattgtccaataacatgttgctttatttctgtctaagacctcactagaagcacctttaatattcatatttctcccaacattctgttcatgattatgtacatattctctaagaagaggtaggcgttcccttttctctcagtgccctcaccagaatcacctttaatatctatatttctatcaacagtcctttattgcaatctaggctttttttagtttacaccttaaaatgattccaacctctacccattacccagtcccacagccactgctgtatttttaggtatttgttagagcagcacctcatatcttggtaccaaaatctgtattaatcagggttctccagagaaactgatcgaataagatattagttcatcatatggtggaaggttgagaactcaaaaatcatcaataaaacactagtaacatcccatttggtacattagtgtttttgtttttattatattcactttatatatataaaagaaatgtttgatgtttggaaatgatgttggtaatgatatcttctccttttcattgggataataaaatctctgacgtaacttaaaattgctgtttttcattccagagagaagttacatggaggagggaagataggccacttttcaaaaacaacggtttcaactcattttctacatttctctacctgtgcttcttattactactgccattttaataaaacagaaaaaattgagagagctatgctatagaggggaaaatgaaagtgagaggtatgtatatacatatatatgtaaaaaaatatatatacatatatttactcttattacattaagaaagacaagaaaaatgtatttatgtttcatcaggaataatctccaactgtagctaaggcaatataaagagaggctcagggagacattttaaaaatggtttgatgctgtttgttatttgttttgatattttttctcatcttacaaattactaaaactacagagtttaccactagtatcatggtaagagcagatatggctgccaggagaattttggaggtttatttagcctcttagttcaccgaccctgtccatacagtcatatcacctatgagctctattagaattatatgacactgcatttcaagggaacttccaaaaactaaatttattagatacagattttcaggccagtgataaacatctttattagaacacctctctcaattagagataatatctataaacctattttgacaatatttatttttctaaatatagatattgctgatttgtaaaatcatttcttaattagaaactacatgtgtagttaataatgtcaggttaaagagacaggaggcaccaccatgtaggaagagaattacgcttagcttcaggaaacctcgttttaagttataaatcttgcatgtaatactgtgataccgtgagtaagtgatttaatctttatttccttaagattattctctataactctacagaatgggaggtaataatagcttttcaatttatctaaacttttgagtacatccatttaatgagtgaaatcatcatgttatctgtaatcagttgcacaaatttttaaacatcatattgagccccttattcataatttacaatatttcatcacagatatatttacatctaggtttaccctccgagaactgatgcaaagataaaacgtgtttatattttctgagagagagaaagaaatatattgatctgtaaagaaaaagtatttaaaatttttgagtgctactttatggtttgccttattggaacggaggaattagggatatcataaaataaggggagctgcctatataaatgtgggtttacaaacataaattcttgattaaatgtagaatgagaatgagaagactcagttaccagactgaggtaactgatggcatttgttctaatattgaaacagtacctgtttaagttgttaaaaggagacctttcatttatttgaatcgctgtttctttgaagaacagttttcattcagttgtttaattattcaagaattacaattttcatcactttaaaacaaagtttatcaattttatagctctgtgtcagaagaaagcagcagtaacagcaagtcatccctcagtgaaag

SEQ ID NO: 1137 - DNA, 47224 bp, Homo sapiens
ttagttttttttaatttatttttcttgagatggggtcttgctttgttgcccaggctgggcacaatcagctcactgcagtttcaacctcctgggctcaatccatcctgccacctaagccttccaagtagcgaggactacaggtgcacaccaccatgtctggctaacattttgtggagacagggtctccctgtgtgttgcccaggctggactcaaaaccctgagctcaagcgagcctcccaaagtactgggattgcaggcaggagttactgtgcctggccaccatttaattcttgagcattttcttttatattctaattgtccgcttctaatttggccaccgtattcacatcaaggttaagtgacttaacatctttggggataaataaggtgctgattttgtctatagccatcagtttatcatactagatccaagtttgtcaatttaaatcaggtgtgtttatgagcaaagatatgatcatgctgaatgttccatgtgtacttcaggagatacattctgctagtttggggtggtgtgttctataaatgtcaatttaatccagtcggcttatgattttcagttctatattcttactgattaatgtgtatatactagttctgttactaaggagggatgttaaattaatccctagctgtaattgtgcattagtttgtctcttttcagctgttctagcttcataaatttttggagctgttaggtgcatatacgtttaggattattttgtcttcttggtgaactagaccttttatcattaggaaactgtccatataaccactccatttttaattgtttacatggtttttccatccttttaacctatcaatcacttgaattgactttctttatagacagcagatcactgggttatgttggttttttccgtgtctcttgtcattgatgcacttagaccatttacatttaatgtaatcattgatacgtatgggtttagttctaccatttttttttctttttttttttttttttttttgagacagagttttgctcttgttgcccaggctggagtgcaatgacacaatctcagctcactgcaaccaccacctcccaggttcaagtgattctcctgccttggcctcctgcgtagctgggattacaggcatgagccaccgtgcctggcctttttcttttttaaacagggtcttgctctgtcacccagactagaggtgcagtggcacagtcatggctcactgcagcctcaatctcctgggctcaagtgatcctcaagggcctccagagtagcccaccaccatgcctggcttttttttttttttttttttttgtaagtagagacacatttcactgtgttggccaggctggtgtcgaactcctgggctcaagccattgcccacctcaaagtgctgggattacaagtgtgagccaccacacccaaccaggttatttgaacatttttaagtactgtattttctctattgtaatattgactgtcatctctgtgcaggttttttagtggttgctctaggttgaaacgctttgaattcttaggtatctaagagtgagcattttctttttttgactgctatactctcaccagttgccagcttctcatataaatattgtaaatgctctcgtttaggtaactcagcttctggagttgagggaacttcaaaatcagaagagctctgggaatctgcatttgtgctaagatttagcaaacttttttcctcgggtatatgtgtctcactgcttagagtagttggttctccagtactaggaactattgtcacatctttatctctgcttttcaaatcagagtaagtatcctttgggcaaattacattttgttccatgagagaggcaggaatattctctttgattgttggtctgtagtcagctttgtccaaggaagtaatatccccactgtttctctcttgggaagataacaaaacagtatcagattggctgtcccagccttgacttccttgttctgttatgtgtgttgactgggaagaattctgggaggagatgtgagttgattctccatcagagtcactgaaaagctttggtgactgagatccccctgccactgtggaggaagggaagttttccaaactctcatctgtgatttcatcatttcttttaaagaatacttcccactggggtacatccccatcagccttttgcaggtgaagtacagagcccagatctccttgcagtgaagctgggattcctacttcttcttcactttcactgttggattcttcacaatctacaaagtttgtgaaacgagagctctgcatacactctgctctgcagcatcctggggtttgtctcagtttttcaggctgcttttctgatactgcagtcattgaaaatacctcagggtgaaaagtttccgggtatggaactttgtgccttaaaggtattggcagaggatcatcaaagagatagtcatcttcctcctctgtgggacaaacaaaacaggtttataggaaacaaggcaaagggagccaatttgtagtatttatctgtacttttaattcttggaattgcaaagaatagggaggccactcttcttcaaagggaaaagatattcttgggatatgctgaacaatttaactgccatccttcaactttttataataaatgccagagtatcagtggagaatatagagcagtcactctgctctatatgtaagcctggctgatcattacgatcatatgcaaaacttcaaaaaaagaaaaaaaaaaaaaacaggtttctgtatctcattccagacctactgaatccctgaggaagataggaccaaataatttgatttttaagttctacagctgatatctgttcagccaggtttgcaaagcctgtgtgctctgcaaatagtagatgctcagtgggttggctgacttaggaaaattaaattgctttttattaaggtttttcttctgtgagcatcttattgacatgttttatgcacaaggttgcaacaggttaaatcaactttaaagcaaaatactgaataatcaacgtgtcaagaacttaaaattcaaaacattaataagcatgctgtgtcaacaaatgttcttaaaatgaaaaaagccttacttagaaaaacaaatattttcccatcttgtaacagtatctaacctaggaagaaagttaaatgcacccaagactactgtgtatggcaacttcttgttctactgctgaatctggtgttataataatccacttaaatgatgtggctaaacactgcatttttaagacactaatataaaggaccatagagaccattatccagctcccatgttccccgtgtgaagctaggcccagagaaaagggtgtgccaatacacacgacccaacctcattcttaaaggttcagtgttatgacttgtaactgaacttagggcttaaggtcactaagatatctaacgactgtatttggaatcatcctagactgcagaatgtagattttaagccaaagatcatatgtatgttttaggtccctcactactatgccaaagttgttttttgagttttatacagtcacagttcagcctctacctctcaggctcaggagatccacccccatgcccagctaattttttttagacagtgtttccccttgttgcccaggttggttttgaactcctgcactcaggcaatccaccccctcggcctcccaaattgctggaattagaggcatgagccactttgcctagcccaaaattacctttttatgaaatatttttgtatgatctctaagttgaacagttctgcattccaaatcagtgactatgcctgatcccaaaagacatttatcaaaaaggagtgtggattgggtagatgcataaaaggcacaaaagattaaaggaagaaaggacttttgcttccaggtaagatggagtaacggactagatttaacctcccacttgaaataacgaaaaatcagaaactatctctcaagaaaatggacatcgagcaattaaggacaatgacatgagaaataagacacagatgagtcctatgattgcctgactccctgcttcataacagattccagtcagggagggaacatctggatagagcccatggacatccttgatgtgaggtggaagtggaacattgaagaaataaatgtacctggagtttacagagcagaagaccagagaggagagtgctgcacagaaactctgaaaagctgcagaggcgtccccaccacgtgttcagtgcactaagcagcatgtgcttgtaaggaaactacctgcagccaggcaacgaatcactcaaacaaaaggaaagaaagtgcccagaactcaccgtgccaggaacagtgtcttgtcctggtcccaacagccagagtggaaaacctcatgatccatgggcatttgtaaaagaaccaagaagagccttgcctcagtagtggggaaaattaaccatatactaaatgctactctgttcctgcataacaaaggtaaaagacacgaaaagatcaaactataaacatgctaaccacatgccagaacaaagctcaagaatgtttttagaaatcccaaaattatgcaggacctaaaaaggtaaaattcagaatgtatggcattcaaaaacaaattatcagaaattcaagaagcaggaagatacagtcaaaactgactgtaaaattatgtaacatgggagtcaattttcatgatcttggatcaaatagtttcttagatatgacaccaaagcatatgcaataaaagaaaaaaatagacaaatttaacttaaaacctttacgcttcaagacaccatcaagaaggtgaaaagacaagtctgagaaaatatttcctaatcatgtcagataaaggactgataccagactttaactcttacaactcaatacaaaggtcaataatccagttgaaatgggggcaaaagatcagaatagacatttcactgaagaagttacataaatggccaataagcacatgaaagaaagctcaacattagtcattagagaaatgcaaatcaaaactgcagggtaccaccatacactaggatggctatactaaaaaagacggaagtgttggctaatatgtgaaggaactggaatctttacatattgccggagagaatgtaaaatgtattcagtgtgggaatgtttggcagttccttggagtgttaaaacagattgaccatatgttatgaactgaacgcttcctgtcaaaattcatatgtggaagccctaaagccagtgtggctgttatctagagatggacctctagggaaataattaaaccatcataaggctggagacttgatctgcctaagtgctagaattacaggcttgagccactgtgcccagcctaatttttactttttttttaagcagagacaagttttcaccatgttggccaggttggtcttgaactcctgatctcaggtgatccatccgcctcggcctcccaaagtgctgggattataggcgtgagccactatgcctggcctcctgtttaagctacctagtatgtgttattttcttagggcagcccaagccaactatatgactccaaaattctaccccccacaagaaataaaacccaacagaaagatacgtaaagacttgtactcaaattttcatagcattattatttaaaaaggagaagcaacccagatgtccatcagctggtgagtggataaataaaatgttgtatgcctgtacaattgaatattggttggcaataaaaaggtatgaaatactgatatatgccacagtatagatgtaccttgaaaagataatgcgaaataaaagccaggcacaaaatagcacatggtgtataatttcttttttttctttttgagacagagtctcgctctgtcgcccacactggagtgcagtggtgtgatctcactgcaagctctgcctcctgggttcacgccattctgcctccgctgccctaatagctgggactacaggtgcccgccaccacacctggctaattttttgtgtttttagtagagacggggtttcaccgtgttagccaggatggtctcgatctctctgaccacatgatccacccgccttggcctcccaaagtgctgggattacaggcgtgagccactgtgcctggccaatagctgggactacaggcgcccgccaccacacctggctaattttttgtgtttttagtagagacggggtttcaccgtgttagccaggatggtctcgatctctctgacctcatgatccacctgccttggcctcccaaagtgctgggattacaggcgcgagccactgtgcctggccatatgagttctcttatatgaagtgtccagaaaacacaaatctatagagacaaaccatagattagttgcggcctaaggccgggaatagtaatggggagtgactggaaatagacataaagtttcttttttgggtaacaaaaaatgttccaaaattagatagtggggatgattgtacaattctgttatactaacagtcgtggaattgttcacctataatggatgaatttatggtgtatcaattatacttcaataaagcttaaaaaataattttgtattgtggagtttataaagttaataacagagaatgtatgacaataacagcacagactgggagaagaggaatggaaatatactgctggaacattcctataccatatttggagtaatatatcatttatcttttcactctgatatgttaaagatgtatacggtcagtcctctgtatccacaggttccacatctgtagatttgactgaccacagatcaaacatatttggaaaaaagcaaaaattaaaatacaaaaaacacaaaaattgatacagtataacaactagttaccaagcatttacactgtattaggtataagtaatccagagatgattttaagtatatgggaggatatgtgtaggttatatgcaaatgtaacaccatttaatatgacttgagcatctgcagattttggtactcttgggggggtcctggaaccaatcccccaaggatactaagggatgactgcattataagccactaaaataagaaatcagtgagttacacagccaataacccaacaagagattaaacagaatcagtcagtaattacttgacctgaaagaaggccaaaaaagaataaagaacaaatggaacaaatagcaagaggataaacttaaacctgaccatatcaatgggtaccattaaactaagtggactaagcactgcaattaaaagccagaaaataccaggttggccataaaaacatccaacaacatactgcttacaagaaacccactttaaatataaagactagttaaaaatacagagatggaaaaagatacatcaagccaatattaatgagaagaaattcaaatggctctagtagattgtagaactaagaatgttaccaggggatagactcatttcctaaagataaaggtatcaatccctcaagaggatataagaatcttaaacttgtgtatacctattaatagtgcctcaaatagatgaagcaaatgccaatagaactaatcaaggcaaaataggcaagtccacaattacaactggagattgcaacacccctctctggcaataattgatagaacaagaatgtagaagacctgaacaacattgtcaactaacttagcctagttgacatttatagaacacttcatccaacaacagtagtacatatatttctttgaagtacacattaaacatttaccaggtttaatgtgtaaattggtccacaattgatggtccgtaaatattctggaccataaatttcaaaagtaccaggccaggtgtggtggctcacgcctgtaatcccaacattttgggaggcaggtggatcacctgaggtcaggagtttgagaccagcctggccaacatggcaaaaccctgtggctactaaaaatacaaaacattagccaggtatggtggcgtgagcctgtaattccagctacttcggatgctgacacaggagaatcacttgaacctgggaggcagaggttgcaatgagccaagattgtgtgactgcactccagcctggggaacagagagaatccatctcattaaaaaaaaaaaaaatcatacaaagtatgttctctaaccacaataacattaatttagataacagaataatccctgggaagtcctccaaaattcagaaactagtaacaaatttctaaataacccatgtgtcaaagaaaaaaagtcaaaggaaaaatttaaaaatgttttgaatgacaatgaaaacaagacaaatttatgggatgctgctaaagagggaaaattatagcactaaatgcctacattagaaaataaggtctcaaatcaacgacctcagcttccatattaagaaacttaaaaatgaaaagcaaataaaattccaagtaagcagataaagatcagagtggaattcaatgaaatagaaaactaccccgtgccaaaaaaacaaaaaagagagaaaatgaaaataaaaccaaaaacttcttatttgagaagatcagtaaaactggtaaacctctagctagactaatcaagaaaaaaatgagagaagacacaaactactaatatcaggagcaagaggattaatatcagtagattctacagatagtaaaataataaacattaagaacaagtttatgccaaaaaattaagcaacatggataagacaaattctttgacagattcaagttaccaaagttaactcaataaaaaaaaaaataacctgaatagtcctgtgcctattagagaaatcacatttgtagttaaaaaaaaaaaaccttcccacaaagaaaactcctttcccacccagatggcttcactggtaaattctaccagtcatttaagaaagatataatgccaatcctcgaaaaatttttccagagactgagaataaacacctcacaacaatgaggccagcagtatcctgataccaaaaccacacaattacaaggaaaagacaaaactccagatcaatatcccttctgaaagtaaatgagaaaattcttaccataatacttaaaaaggataatatgccatgactaagtgggattagagaaatgcaagtttggtttaacactcaaaaatcagtgtatgtcaccatattaacagagtataaagaaaaacaatatgatcatctcaacaaatacagaaaaagcgttagacaaaacccattatccattgttgatatctctccacctaccaagaacagaagggaagtaattctgcctgacacaaagcctatacttatcattatacttaatggtgaaataatgaacttaatggtgaaacaatgaatgctttctccttgagattgggaacaaggcagtgacacccactcttgccacttgtttcacactgtagtggtagtctagacaagaaagagaaaaacatcctggctgaaaaggaagaagcaaaactgtctatatacacaaacaatgatgatcttatatagaaaccgcaatggaatctacaagaaaaggcactagaactgatacttgagattagcaaggttgcaggatacaagatcaaaaatcaattgcacaggttgcattgcatatccctaatccaaaagtctgacatctgaactacaaaggaaatccttattgcagcattttagattttctgattaaagaggttcaaccattaaatgcaaatgcaaatgttccaaaattcaaagaagtccaaaatccaaaacacttctgctcccaagcattttgaataagggacactcagcctatatttctatatactaacaacaatcaggaattgaaacttaaaaagtaataccatgtgcaacagtatcccccaaaatgaaatacttagggattgatttacacagacttatacgctggaaatcataaaacactgctgagagaaattagagcagacttaagtaaactgagaggtataccatgttcatggatctgaaaattcagtattgttaagatgccagttcttgccaaattgatcaacagatttaaaacaatcctcatcaaaacctcaggagaggacatttttgtacaaattggcgtatgattctaaaattcatatggaaatgcagaggacctaggataaccaaaacaactttgaaaatgaacaaggctggagaacttaaagcacctgacttcaagatttacaaagctacagtaatcgagatgggtgatattggtgtcaagatagagattatgaaacataagaaagaatccagaaaataatctccacatatcttgtaaattgactctcaagaaaagtgctaaagcaattcagtgaattaagatagtgtttccaacaaatggtttaagaacatttggatatccatacagacacacacacaaaattacctgggatctacatttgaaccatatttttaaaaacaaaaatgaatcacagatctaaatgtaaaacctaaaattgtaacaacttctggcagaaaacaggagaaaatatttatgcctttgggtcaaagatttcttagatatgatacaaaaaaaagtaaaaattgataagttcacttaaaatttaaaatttctgctcttcaaaatactctgctaaaaagattgaaaagattacctacagagtagaagaaaatctttgtatacacctgatatatttaaaaaaaaaaaacaaaaaaaacttgtatccagaaacttaggaaaacttagtaatatgatgggtgcagtggctcatgcatgtaattccagcactttaggaggccaaggcaggcagattgcttgagctcaggagtccgagaccagcttgggcaacatggtgaaactccatgtctacaaaaaatataaaaattagccaggcatggtggcatgtgcctgtactacttgggaggctgaagtgggaggatcacttgagcttgggaggttgaggttgcagtgagctgtgattgtgccactgtactccagtctgggtgacagcaagactctgtctcaaaacaaaacaaacccaacaatttaaaaatgagtaaagatttgaatagacacttcaccaatgaagatacatggatggcaaatacgcacattaaaagatgcacaaccttgctagtcattagagaaatgcaaattaaaaccacaaagagctatcactgcacacctattaggatatttaaaattaaaaagtctaaccataccaagtattggcaacgatgtggagcaactgaactctcatacacttctcctgggaacacaaaatggtcaaaccactttggaaaacattttggcagtttcttaaagatacagctaccatatgacccattcttaggtgtgaaagcctacgtccatacaaaagtttgtacatgaatgttcatggcagctttctttttaataagaaagacactggaaacaacccaaaaatacatcaacaggtgaatggatcagcaacttgtagtatatccctgaggtggcctactccttatcaataaaagagggtgaactattgatacatgcaacaacatgaatgaatctctgatgcactgagtaaaataacccagacgtactatatgattctatttatatgaaattctagaacatgcaaactatagtgacagaaggcagatcagtggatgccttggcatgggtgagaaccggagggaattacaaaggggcataagaaaacttgaaggtgataatttcagtatcttaattgtagtcatggtttctcaagtatatgcatatacaaaaaatttatcaaattgtacaccttacatgtgcagtttatatcaattatacctcaggaaagctgttttttaaaaaaaaaaaaaaagaaaaaaaccttagtaaatttgtaaggattagaggatgcattacataatagagttaacatctgaaattaatggaactgtttttctaaaaccttttaattattgaaacaaaaacaaatgtggttttttttgggcaccagttataggcttactatatcagtcttggaattgtcatctaaatgttttaaaattagattctccatgagcagaaatgcagaagcagagatgagacaggcctagattagaatcccaggcccatcacttacttcttgctagtccttagggacttaagtctctaaacttcagtttcctcatcattataattgggatggtaccccttgtaagtttgtttagaggcttatctataacatatgtaagggacctagcacaatacctgccattaataggtgttcaaaaaatagtatcatcattatctcgtgtgttttggtcaagtatttactgcatggcagagtaactgactttccaccaaaggaatgaaaatcaagaatcctaaccacgaaatagggctgctggaaagccccagagctttgctcagaatctaacgttctgattactactgcagagcttgcctctgtccttcactagaaaaatcaaagtagcaatgaaagaaggtacaaagtatagagaaaaatccttctgtataaacactactgatcaacttgatcagaaatgatgatgagaaaagtctattatcagcatttactagtatcttaagaaaatgttcaaggataacaaaccagcctctctatgtcctaagaaaatgttcaaggataacaaaccagcctctctttatggcctctactgatcttagggtgtatttccagaaagctgagaacaccacacacgatggcaccgttttcaccacttgttttaacccagagaaggagagcagactcctgattttacaggctgaagacaggaaggcaaagtacttcctgagaccatgtgtcaagtctgacctgtggtgggtcccaggtccactctgcccaaggccacttctcccagacccaagctccctggaaagcagtgtttgcagggagcccacccctctgaacccaggaccatttttcttacctgagtctcggtgaactgttctagctctcttcagttttcccagtggtttatactttggctccgtactttgggaagaccggcataaaggctttaagctgaaatgaatcagaatatttgatttttccttttgaggaagttgttagaaggtagacatcattgatagtattacaaatttttttgattttgttttttaatttcttggatccctgtttttaacaaaatcttgaccataagggaaatcacacaactactttggaggattgaaaagcagttctaaactgatttcatagttaaaaatcactttgatgtaataaagtggcaaatataagcaattaaatgcaacccggttgatgtttatcttattgttacatcagtagactaaggtaaaacttagatctttgctcttggaatgcaaaaaaagcaggtccctatcctgaaaacctatgaatacagtgacatcctctggcattcgggatacaatataactagctgcttctcctgccctgttcagtagggtttacttatatctcacaggaatctccacaaatttatcttgtcattctaggtccttaggctgaaagctaagacaaagtggagataaaatacaaaaaggcagagaaataagatttgaagacgtcctacccctttcgaaggcctcactgccaactgcctcctcctggcagattccgggaagcctttaggatgatctacaacataccatttgaacagggccatgaggtgcccaacctgaaacttctttacagccacccccattttacgtcctcacccctgttcccacagctgttctctggatccatccccttcaacctttccaggagttctgatccattactgtgtctctttacatcatttcagctattctcctgggttaacttttcaaagtaaggttgtcttcccccacctacctacaacagaattgtctgctagaaatgaaggatgggggccgggtgcggtggctcatgcctggaatcccagcactttgggaggccaaggcaggtggatcatttgaggtcaggaattcaagaccagcctggccaacatggtaagaccccgtctctattaaaaatacaaatattagccaggtgtggtggtgggcgcctggaatcacaactactcacaaggcttgaggcaggaaaatcgcttgaacccaagaggtggagtttgcagtgagccgaggttgcaccactgcactccagcctgggtgacagagccagactctgtctcaaaaaaaaaaaagatgcaggataaggaatgaatatgcattttaacaagcacctcggctgggcacggtggctcacacctgtaatcccagcacttggggaggcctaggtgggcagatcacgagaggtcaagagatcaagaccatcctggctaacatggtgaaaccccgtctctactaaaaatacaaaaaattagccgggcgtggtcgcgggcgcctgtagtcccagctactcgggaggctgaggcaggagaatggtgtgaacctgggatggggagcttgtagtgagccgagatcgcgccactgcactccaacctgggtgacagagcgagactccatctcaaaaaaagaaaaaaaaaacaagcacctgaagtgattcctaaacacatccaagtttatgtatattcaagtttagttctacaggcatatttaagtctcagctattttaagatcaagcctcctgattctgttgcctcctgttgccatcttgtctctaactttcccttcactgtcaaactttttatatagtctgtcctcagtattttccatttcctcactttttacctatttctcgactgaaatctggcttgtaactcacaagtctactgaattgctctcactgagcacacacaaatgacctaattaccaaggaaacgggacacctggtagtccccatattatttgacttctcaagacactccatgggcaccctctgcttacccttccctttgctctcatcccgctgtctgggccactctctccatcttggcccagcttctcctccttcacttctaccttgaatgtgctgcccagggttctggcctcagctctatgatccctcctcccactcctggtgacttcttcttttctcatggttttagttctcacctgcactgccaactccaattctgtgtctccaacccagacctctctccagagattctccatcctcctttccatcgacatctgcaagcctggtcctgtctgtccccatcggggtctgcgaagcagattccctgacacggggcctcattccttctgcacccattgagcttgtgtgctgcctttgcacccggcctctccgtgagactggagctctgctaggacaggctgtgtcttaggcaaattggaacccaagctccattcccaccatatggctggcactaaagaaatcattcatgggccgggtgcagtggctcatgcctgtaatcccaacactttgggaggctgagacaggtggatcacttgagctcgggagttcgagaccatcctggtcaacatggcaaaaccttgtctctactaaaaatacaaaaattagccgggcatgatggcatgcacctgtagtcacagctactcgggaggctgaggcaggagaatcgtttgaacccaggaggtggaggttgcagtgagccgagatcatgccactgtactccagcctgggtgacagagtgagaccctgtctaaaaaaaaaaaaaaaatcattcatgaatgcataaatgaaacccaaagaagaggtaagaaaatggtaatactgtagtaaaagacatccatgaatacgattgcacctctcctttggcttcagttatccattcagtagacacttgacaacctacttggcatggtgctaggtgcttttcttacactatctccctgtatcatctctttcttttttaagaagaccaacaagtaggcatcaatattcctattttgctgattcagaatgactagctcagagaagtgatctggccaagctcacactgcactgttagtaagtggcggagctgggttgcaacccaggagaagctgacaacactacctataccttctgccacactgtggaactaaaggaaacactccaggaaaaaatggaaatgagtatcagttcagaaatgtcccaaaacaaacagattctagacttgtaaacattcaggcaaactctcctttgtgtcctagccaagagccaccaagggggacaccaagtcccacaaccagtgactactcacatttcgacaactttatccatagttgtgccaactggaatgacatttggatatgcgttcacaggacagaggtagctcaagaaatctttaatctagaaaaaggaaaatcacatggatcaacaatctctacgatgaaacaggttgttaggggagataaagggaggctggggaaagagaagcagaactctcttatggctgtggttctcaatgctggctgcacgtggggatcaccagggacctcttgggaaaaaaatatccaatgcctgggcctcactcccaaagatctcctgaacactgagtactagtgggcctagaaatcagtacatttaaatattccccaggtgattctgatccacagtaagagctgagaatcaccaatgggactcaaagattcttttttttttctcttttttaatatattgctttccttgtccaagaaggtcagttgcttatgtttaacaaatcccttttcaaataagttagaatttagctgggcattaactataatatacacaaaaacccaaggtctcagaattgcatttcttagctgggcacagtggtacatgtctgtgatcccagctactcaaggctgaggcaggaggattgcttaagcccagggatttgaggccagcctgggcaacacagagacacctcatctccaaaaaagaacaacaaaagaattgcacttatttactcctaccaataatcattaacgatgccaagagaattacacctttgaggttacttgatttgttcaaatggttcattctcattgggcagaacaccatgcattcgtcactgattccagggaaggatccaaacactgcccattgtaccttggtgttggagtcaccaaggaaaacacaatgcagtcaagcactggagggagcaatgcttcacttactgagaaaagaccaagcaagatcaaatccaacaatgtgcactggtctccagtgaccagtgtgtctctccctgcagccaacacagggcaacctgcctacatgcaaccctctcctgccacacaggaaggaacccccatcatgctgtctgaaataaggacagctggggtgtgcctaagggccattgacacacaggcttaagtagaacaaagggacacacatcaagtacgaagcagagaaagatgtttccacacaaggtactgagctgccgcaggctgtgtgctcacgctaacgggagtgcttgctctctctcactcgcgtgcgctctctctcaataaggaagtgtcccattcttatgtggccagtgagggttgaaagactgtgcacatagactgcctctcccaatgattaattctaaacaaacaattacatgcaaaaacttcatgaataccttgactttttgcaaagttcagaatgctaaacagaggaactctgtcactattcctcaaaacatctctacaacctagaggaacttcagctttgtctcttattagacattggtgagcttgtgatctcagtcaagttacctaatgtctctaattttagattcttcatttaaaagtataaatgagattatgcatgtgaagtgcttagcttggtatctggtgaaacagtcaataaaatcatccaggccaggcgtggtggctcacacctgtaattccagcactttgggaggccgagccgggtggatcacaaggtcaggagttcgagaccaacctggctaacacggtgaaaccccgtctctactaaaaatacaaaaaattagctgggtgtggtcgtgggcgccgtagtcccagctactcaagaagttgaggcaggagaatggtgtgaacccgggaggcggaggttgcagtgagccgagatcacgccactgcactccagcctgggcaataaagcgagactccatctcaaaaaaataaataaataaaaattaaaaaattaaaaaaaaaatcatccattactaagttgataatgagaacacaaagacttttatgcccttctgcaaatggacagactagaacccaatgtaattattagtatcccaccaaactgaaagaggcagaaacccaagaattgccaataactctacataaaaataaaagggctactttaagacagtggaaaggcaggaagatctattctttaaatagttttcacaaacagtatcttttgtaccttcacaggaggcatgcaaatagaaatcattacctgcccgcccaacaccgatttgatttgcacaaagctgaggctggtagaaatctgagacttttgaagggaataaaggatttaaaaaaaaaaaaaaaaaaaaaaagtaaagtcaagcctataccagaaatggttcactactacttctcagagatgaaatggccccaaggagataagagacacccaataaaggagcaccccctctcatttatataagttgactcccttttatcaaatgcctgccttaaaataaggcatcaatagcgccaattctctttattcacagtagttatactctataaattatagtcaccataaatgctgaattagcaaatactgagccattgctgctagggaaaatacagggttcctgccatcctttggtgacatcgttttcaccagccaattaatacataaccttgttttatgtgtgtttctgttgaaagacaccttatttaatagacactttgatccattaacattgaactcatggtcaatagccctataacccatgcctatctaacatacatattttctctagaagccacgttacagtcctcccgtgcttaggaacactcgataggacttcagtattatgactggtcaccatttaaataagatcaccaacaaaaagcacaaaaatatgaaaaacatggcacttaatagatggcaaaaaggaaactttcgatatggtttggctgcgtccctacccaaatttcatcttgaactgtagcttccatcatccccatgtgtcggagggaccagtgggaggcaatttaatcacgggggtggctacctccatactgttctaatgacagttctcacgagatctgatggttttataaggggcttttccccactttcactctgcacttcttgctgccgccatgtgaagaaggatgtgtttgctatgattgtaaattccctgaggcctccccagccctgcggaactatgagtcaattaaacctctttccttcctcatacccatctcgggcatgtccttagagcagcaggagaacagactgatacacttgttgacagagtaagagctgaaagaaggcagagcattgccttgttctacctgagccgagaacgtgcacgtcaggtgattcaaaattttcaccactctccacaagtccacaaaggatcacaaaagcactgtaaatattgatactgaggtcacaggtcagtttcagtgagtaggccaacacataaaaatagaatccatgaagccaggtgcagtgacttacacgtgtaacccagcactttgggaggccaaggcagacggattacctgacgtcagttcaaaaccagcctggccaatgtggtaaaaccctgtctctgctaaaaatacaaaaattttagctgggcatggtggtgggcacctgtagtcccagctattcgggaggctgaggcaggagaatcacctgaacccaggaggcagaggttgcagtgagccgagaacacaccactgtaccccaacctgggcgacagagtaaaacactgtctcaaccaaaaaaaaaaaaaaaaaggaatccatgaataatgaggatgaactgcatttaggaaaaaaaaactaaaaggaaatgaaacttacatagaaacagagatgcttctgagagtcaggggactacctgtcaactaccaaggctgcagaacactgagcgataagggttatgagtatatgggatcctcttacctcactgtaggaggagtgaaaagaaaaacaagctctgtatgaactctctccagtcctaaagggaagtgaaaacacaaaataaaaagatcactgagcaaaactaaaactaagcaaagctggcccttctcatttaggctattctagcatgaaaccactctaatgggctcgcttcagcagcaagtgtcgaaatcaccctaaatcaggaatttcttcttgggatagcagggaaccttttccagaagtggaaacctgttgtagaccgcgtgtggtggctcacgcctataatcccagcactatgggaggccgacgcgtacggattgcctgagctcaggagttcgagaccagcctagcaaacatagtgaaactctgtctctactgaaaacacaaaaagttagctcggcatggtggtagtacatgcctgtaatcccagctactagtgaggctgaggcaggagaatcacttgaaccgggaggcagaggctgcagtgagctgagatcacaccacttcactccagcctgagtgacagagtgagattctttctccacacaaaaaaaaaagaagggagggagggagggagggacctcttgcagatattctgaacagccaaagttaaggaaatgttgctaaaatattaagatcattatagtcactcctctattccaccaagggttctgttctctctgacatcagtttttcctcttagccaagcactcagatgggagggagggagtggggggggagaaaggagagggagggaagaagggatggaggagagggagggagggagggagggacctgttgcagaaattttaaacagccaaagttaaggaaatattgctaaaatattgtgatcatgatagtcactcctctgctccaccaagggttctgttctgtatgacatcaatttgttactctaagccaagcactcagatgccttcagtctccaaccatctcatcaacctacccagagggaacctcaggatacaccagctgatgggagtgtaactggtttgggagtagcatcccctccatttaaataaaatttaaatttaagaaattaattataatatataattatattcttgggcttaggctagactgtgcttaaatgaaattaaatcagacaatttactcaaagtttctctcagaagacctatgatattgctctcttacctcacaattacatttgtttttctgctcctttctccaaaccacatggtggatggcttaatgctgattatgtggagtggaattctatttctggaagtaattccacagggtaatttgctccactgaaaatattcctctgcctaaaaaagataaaaagcatagaaaaacagttctacattttctacaaatctgttgtaggcagagtctcaaaaacaaaagtagaaaagtttccagacacgaaaaaataaaaaataaaaaaaaagcagcaaaacaatgtagacatgaagaaacaatcagataattccaaattggggaatattgtgcaaaacaactgggctggactcttcaaaaccatcaatgtgaagacaagcaaaaggctagacaaacgatctatatatcaaaggagaccctttagacctgactgaacgcaatggacgaccctcaaataaatcctggatgcccctgtccccctattctacaagctataaaggacactatgggaagaactggggacatctgaacacggactgtgtaacagctaatagtactatatgaacacaaaatgttctgaggaagggtattgtactgtggttatataggaaaatgttcttattctcaagagccacaggctgaaggatttggggtgacgtaccatggagtctgtaactactctcaattggtttggagtggggagttggttataagtacagagacagaggaagagaggtgcaaagtgttggcaacgcagcaaatccaaacgaagggtgtatggtgtttttttttttttttttagacagtctcgctttgtcactcaggctggagtgtggtggtaccatctcaactcactaaaacctctgccttctgggttcaagcaagtctcatgtgtcatcctcccaagtagctgaaattataggcacacaccaccacacccagctaaattttctatttttagttacaggatttcaccatgttggctgggctggtctcgaactcctgacctcaagagatctgcccaccttggcctcctaaactgttggaattacaggcgagagccactgggcccagacccttgtaccagtcttacaactttactgtttaagaagttttcagggccggttgtggtggcttatgcctataatcccagcactctgggaggctgaggcaggtggatcacttgaggtcaggagtccaagaccagtctgaccaacatggtgaaactctgtctctactaaaaatacaaaactagccaggcatggtggcgcatgcctgtaatcccagctacttgggaggctgaggcgggagaatcgcttgaacccaggaggtggagattgcagtgagcccagattgcgccactgcactccagcctgggcaacggagcgaaactctatctcaaaaaaccatttttttttaattaaaaaaaaaaaaaagatctcagcctgggcaatatagtgggattccatctctacaaaaaaatgtaaaaattagccaggtgggtggtacacaactgcagtcccagctattcaggaggccgaggcaggaagatcacttgagcctggggggtcgaggctacagtgagcaatgattgcaccactgcactccagcctgggtgacagagcaagactctataaaataaattcattaattcaaattaaaaagttttcaaaataaatttggagggaaaaaaactaacaaatacaagtgttttcaaaaggttgaaaaaaaatgggacaacttttccaaagtcattattttgaaatccagaaccttccaaaccattaacgttccatcccactcaaatttctttggggtgcctttggtgctgtttcttaggaaggtgcagattagagttaagagtggactctatgagctgtggacctacctgttaatattctaaaggagtgcgtgacctaaaaaaatcttttaagcggctagaaatagcatctcaaggaaagtagccctgacagcaaaggaattactaactaagctactttgtgggatgtgagaaaattcacagcaaaaagaaatttgccaattcaaggatttatggggcaaggggcccaatactatgagtccaacagaaaaagggacaaaaaggtgtatgttttatttatttacttgagacggggtttcactctgtcacccaggctggagtgcagtggtacaatcttggcttactgcaacctccacctcccaaactcaagcaattctcccacctcagcttcgtaagtatctgggactccaggcatgcaccaccacactcagcaccttttttttttttttttttttttttttgtattttttgtagtgacggggtttcaccacgttacccaggctggtctcgaactcctagactcaagcgatccacctgccttggcctcccaaagtgctgggattacagatgtgagccactaagtttatgggttttgtttgttttttttgaggcagagtcttgctctgtcacccagactggagtgcagtggtgacatcttggctcactgcaacctccgcctcctaggttcaagtgattctcatgcctcagcctccctagtagctagggctacaggcacacaccaccatgcccagctaatttttttatttttactagagacggggttttgccacactgagcagactggtttcgaactgctgacctcaagtgatccacacgcctcggcctcttaaagcactagcattacaggcatgagccaccacacccggccggtttacgttttatgtatacatttttatccatccaagaatccactggacgtgtctgtatatgtgaatatatatgtgtatttatatgtgcatacatgcacacaaagtgaagaaataaatccctgaatgcaacatagaatatgcagcttaccaatcagcaaaaataatttacactgcagctctcaccgtggcctacaggaaaacattccatgctgtggatcagaattctctcttgtttgaaattatgctttatcgtaagggctaggcaactaggcttttggctaatggaaccattattactacaataatagtgatctaaatgaataaatgcaatgtttactttaaaaattacacaggatttaatgctaaggtattttaaaatttagagaaaaataatgatcactcaaaccactacatttaaagatcactaattagccttaataattttaattgaaacaatattttttaaagcaaattcaaaatgaaagtcttgtactcagcgtttgacaagagaaggaggttctgtgttggcattagaaaacgaatgaggctgggtgtggtggctcatgcctgtaatcccagcactttgggaggccaaggtgtgtggtcacgaggttaggagttcgagaccagcctggccaatatggtgaaaccctgtctctactaaaaatacaaaaattacccaggtgtggtagcgggagcctgtaatctcagctactcgggaggctgaggcaagagaatcgcttgaatgtgggaggcagagcttgcagtgagccgagatggcaccattgcactccagcctgggccacagagtgagaccatctcaaacaaaaaaacaaaacaacaaaaaacaaaagaagacaaatgacatgtgacttgcaaagacactggaaacatccattagaaataggaccatcaagacatgaaactattttaaagtgtgaaaaaaagttatgtctagatatttatctcaagtagaagaaaaagtttataaacacgctcatgtcatgagtctcaaaaagcacaggatgggcgcagtggctcatgcctgtaatcccaacactttggaaggccaaggagagcagatcacttgagatcaggagttcaagacccccctggccaacatggcgaaaccccatctctacttacaaaaattagccaagcatggtggtgcatgcctgtaatcccagctacataggaggctgaggcaggagaatcgcttgaactcaggaggcagaggttgcagtgagccaagatggccccactgcactccaacctgggcaacagagcaaggctcgtctcaaaaataaataaataataaataaatcaataaaattacaaaaattagccagaagtcatggtgcatgtcggtggtcccagctacataggaggctgaggcaggacaatcacttgaacctaggagatggaggctgcagtgagccaagagtgggccactgcactccagtctgggcaacagaaggagaatgtctcgaaatatataaatacatatataaatagcacaaatgtttaagttataagctataatatattactgatttcattacaaataaatttgaattatcaaacgtgtatgaatagatttcatcagaaaactataaagatctggttgggggtggtggctcacgcctgtagtaccagcactttgggaggccgagggaggcggatcacgaggtcaggagattgagaccatcctggctaacatggctaacctcgtctgtagtaaaaataacaaaaaattagccgtgcatggtggcgggcgcctgtagtcccagctactcaggaggctgaggcaggagaacacgtgaacccagggggcggagcttgcagtgagcctagatcgcaccactgcactccagcctgggcgacagagtgagactccatctcaaaaaaaaaaagtacagatctgtgtctatttactagtgacgaaaagtgtggtcatggaatatggcaatgtacagttccatgaccttgagctaacaacttaggattgcagcctcaggttttacatttgtaaagcgaagagcctataaatggaagccctgacctttcttctttttcatagattacacaaacaatacgagaggaatcacttgcacacgtaccttgggatgccggcatgcatggatctgagtgttgcggtctgttgtgagatgatgaaggatctcaggcatgttcctaaacatgtctagcttattcacatgaacctaaggcaaataatacatacatgcaaattatgtgaaatgtatttcctataaattgttcaaggttaattactcagggcaaaacacccagttagtgaattaaccctctcttctttcttgaaaagtagtttttggctattcagtgcactctggtattccgccagcatgtcaacaggcacaaggctgactggccaggatcgctgccatcactgacgtcagtgaacaattatggacactcggctcagggatgtcatttaatgatgttaatgttgtccttcagtccttcaagagaaattcagttaatattcctcgtacacctactatgtgtcgagctttattctaaatgctgggaataaagcagtaatccacacagacaaaaacaatcaagaatcatctaccctcagccaggtgctgtggcttatgcctgtattcccagcactttgagaggcggaggccggtggatcacttgaggtcaggagatcgagaccagcctggccaacatggtgaagccccatctctactaaaaatacaaaaattagccaggtatggtggctcaggcctgtaatccaagctactcgggagtctgaggcaagagaatcacttgaacccaggaggcagaggttgcagtgaactgagaccgtgccactgcactccagcctggacgacagagcaagacagtctcaaaaaagaaaaaaaaaaatcaagaatcaccttaaaggcatatacatgatgtacaacagaggagcatgtactgcaaataatccactgccatatctccttgttcaaatttattttcaatgctggtcacaatcactaaatttatttcatgacccaaagtttgggaaaaatactttgtctatgcggcatttcactgaaggctcttgtaagccattttggcttctgtcaattttctcccaggaggatgtgactgaactaagatgatatattccttcagagggcccgcgaacctctgctgcagacacgtcttgttagggtgcttccatctgtccctgtttgcagttatttagcaggcgaggagggggaggaaaggtgagctgggaggatggaagggagcaagagaaaagaatgaacagactgggaacactggctcaggcctataatcccagcactttaggaggccgaggcaggcagatagcttgaggtcaggagttcaagaccagcctggccaacatggtgaaatgtcgtctgtgctaaaaatacaaaaattagctaggcatggtggctcacgcctgtaatcccagctactcaggaggctgagccaggagaattgcttgaacccgggaggtggaggctgcagtgagccgaggtcgcgtcactacactccagcctgggcaacatagcaagactccctctcaaaaaaaaaaaaaaaagaaaaaagaaaagaaaagaatgaacagtcaccatacctggactcctaattcttcactaaggttggtgaacagatattcatagccataagccgctttgcagttcagccacacaacatggtacgggctccgagtgatccagcttcggaccagctctaagactccacttaaacactcctcctagacaggattttaaagagacatttaacaggtggagagccgcacatagccttttccttcccaacagtcccaggtactcacacctacggggacagttaggatatgacctgtcaccctacaaacttcctactaaaaacacgggcacacccagatgataaccctgttcctccaggcagacttacccgacttggaatttggtaaaatcttggatcacagaacgtagtatccaaatatacactttggatgtctttgactctgaaaagaaaaaaaattgatgttagccatccaatgtgatataaattatgtgtaactttttttgttttttgagatggagtttcgctctgttgcccaggctgaagtgcaatgtctgctcactaccacctcctccacctcccgggttcaagcaattctcctacctcagcctcccaactatctgggatcatgggtttgtgccaccacaccttgctaatttttgtattttttagtagagacggggtttcaccatgttgaccaggctggtctcgaactcctggcctcaagtgatgcacccacctcagcctcccaaagtgctgggattacaggccagaactcccaaagtgctgggattacacccggccagagcaataaaactttattcagtcatacacagaagaactgtacaagaggccaggcacagtggctcatgcctgtaatcccagcactttgggaggccaaggggggcagatcacctgaagtcaggagttcaagaccagcctgcccaacatggcaaaaccccatctccactaaaaatacaaaattagctgggcgtggtggcacgtacctgttatcccagctacttgggaggctgaggcaggagaatcgcttgaactctgggcgacacagcaagactccatttcacaaaaataaaataaaataaaataaaacctatacgaggcccagtacctgcccccggagtgcagaagctccattctagcagcttctccttgcgccaatctgaagtctcctgtgtacaggacagttccattattgccctgaaataaaaacctgaaaaagaaatatatcccagtgacttctgagtctcatataaactcccaataaagcaaatacatgtgagctgcatactaaatgcttcctgcaaacatatccattacaatacaatggtaatggaattccacagtaatttgaaccacaccaggcactcagctgtcacctcttccctcgggtagaaaataacagaatggagatgctacccagtttgtaatagatgttccttgtgatatgttagcactttcaattatatgttgagatcattcttgctcatggagagagaaatacacgtgatgataaaatacaaggtcactggggaaacagctgctgaagacttccatttatttatttttattttgagataagagtcttgctctgtcccccaggctgcaaggcagtggctcaatcttggctcactgcaacttccaccttctgggatcaagcaattccccagtagctgggactacaggggtgtgccaccacacccggctaatgtttatactttttgtaaagtcaaggtttcaccatgttggccaggctggtcttgaattcctggcctcaagtgatgcacctgccttggcctcccaaagtgccgggattacaggtgtgagccaccacacctggccatgaagacttccattttataagaaacgtttcaaatctgatcttcacctcagtccccctagttcaatttgggaacaaatgtgttttaaatgactagaaaaaaaatcaaatctccctctatgtattctttctttctttttttttttttttttaaaaaaaaaactcactgcagcctccaactcccaagctcaagcaatcctcccgcgtcagcctcccaaagcactgggattacagacatgtgccactgcacccagccccctattaattttagaccctaaaaatttatttctacaaatacaatatgtgtctacatataataaaatgacaaaataaatgacccccttacataactgatcccggacagtgaccagctggtaagagagtcacaacaatctcttccttctaaaaagaaaataaagaaaaaatagtaatggaaagcagttatcattaggacctagctcaacaaagccctccttcacagaacacatttatgtaccttttaacaatgtgccttttctcccaatttcctcacactccaaatcctagaaacaagtggaatccttgtccactcaacaaacagaattcccatgggactgagcaatttcaccactagttatagaaccaagataagcgaaaaccgatggccacacaaaaatgtgtgcctgactgttcacagcagcattcttcatactagccaaaaggtggaaccagttcaaatgtctatcagctgatgcatcaatcaggaaaatgtggtctagccatacaatgaaatattatttggccataaaaagaaccgacacgtgctgcaacatggatgatccttgaaaacatcctcagtgaaagaagccggataagaaatgaacacatgttgtatgattccactcatatgaaatatccggaataggtgaacccatggagacagagagtccaatacagtagtggttgccgggggttggggaaggagagaatagggagggattgcgatcgctaaaggcttcttcccttggggtgctgaaaatattctgaaattgattgtggtgatggatacacaagtgtgtgactcgatttctatctcaataaagctatttacttttttttttttttttttttttgagatggagtctcactctgtcacccaggctggagtgcgatggtgtgatcttggctcactgcaacctctgcctcctgggttcaagtaattctcctgcctcagcctccccagctgggattataggcgcctgccatcacgcctggctaattttttgtatttttagtagagatggggtttcaccatgttcgccaggccagtcttgaactcttgacctcaagtgatacatctgcctcggcctcccaaagtgctgggattacaggtgagagccaccaagcccggccactatttaacaatttttaaagcctgagccaggtgcggtggctcatgcctgtaattctagcactttgggaggccaaggtgaacgaatcccttgaggtcaggagtttcagaccagtctggccaacatggcgaaaccctgtctctactaaaaatacaaaaattagctgcgcatggtggtgggcagcacctgtaatcccagctactcaggaggctgaggcaagagaatcgcttgaaaccaggaggtagaggttgcagtgagccaagatcgccctactgcactccagcctgggcgacagagtaaggctcagtctcaaaaaaaaaaaaaaaaaaaaaaaagattaaagcctggatgaggcctggtcccgattcacactgcacatcatactgttcggcaagggcaagacctgcaggcactactgcctctccagccatcagtaagtggggagagctctgcacacaccaggtcactgctcagtgacagggactcctcatggaagtctccattcattctggaggaccctttcgagtgggtctccccctggttggagctggataaacaatgcataaaagtcatggcacacaggaagaaacataaaaaatcaaagtggtggcaggactgctcaaaagtcagcctgctgtcggcccccagttcagggaatgcctttcaccaatatccctgattgtgacaaggccacagaccaccacagtattccccggaaaagcagttggcagagtccaggatggcatttacaaaggttcacctattttttttttcctttttaatcctcactaaactggctctgtagtcctccctcaggataatttgatgggaagaatacttcaacttcaactgtctgatcttcaccaaagaagaaatatctgaaaaggtcagtttctgttcaacaacacaacacaccctcaaagttaaacacggcaaagcagtgtgctataatcaagcaacaaagccaatattaaccaaaataggaaaatacctaccagctgtaaaggttaaaaaaaggggggctgtatgtctatagtcctacttattaaaaccatacattcacaaaagtactacctcaaaatttaatgatgaaaaataatttttttccacttggcagagccccttttctgaataagggttcagaaaaaaagtacaatattcatgaattacctgcaaaaatattaatcaccattttaaattctgagcattataaaactcagtaaatgtgacaataacatcatgtagtaatatcaacaccagggttcccatcattagcatgtaataaggaacaaatgtgacaaaaaataagccatgcccaatcctttacaacatgggaaataaatacatcactgttaaggactaaatgttcgtgtccctccccaaaattcctatgttgaaatcctaacccccaaagtggttttattaggaggcttttgggaggtgattagttattgggcatagaagccttgtgagtgacatcagtgcctttataaaagacacccaggggagcttgtctgcccctttactatgggaggacacagggaaaaagacagcatctaagaaccaggaagtggccaggcacagtgactcacgcctgtcaccccagaactttgggaggccaaggcaggcggatcacttgaggtcaggagttcaagatgagtctgaccaacatggtgaaaccccttctctactaaaaatacaataattagctgggctctggtcgtggtggcaggcgcctgtaatcccagctactagagaggctgaggcaggagaatcgcttgaacccaggaggtggaggttgcagtgagccaagatcacaccactgcactccagcctgggtgacggagtgagactctgtctcaaaaaaaaaaaagaaccaggaagtgggccctcaccagacacgaaatctgctggagactggatcttggatttccagtctctagaaccctaagcaacaagtgtctattgtataagccactcagtctacggtagttttgtgagtccagcccaaatggacttacacaatcacaaagggatttttttgcccctaaaaccccactcaatgactagatttttatttatggttaaatgagcattcaaaatcaaagagaaagattgagggtatagctgaggggtggagcatctgactgcaaaatcaaagagaaatataaacaatcattttagcaccacatttttttaaaaaaatcaatatttaatatttagttacctctcctgatgcttcatccactaaagatatctgggtaggagtctcgatttcaatagatatctataaaaataaaataagagaccatgtatatagcagtttttcatggctttatatgcctttgctgtctgaaacacagaaatggggcaaagagaagtttcagactctctatataaacaattccgattacattgtaataaatattttaacagttagaaaaaattgtaaagaaaataatacctgtcttgaggcagatttggtaatacggagtaaacgccttgtaaatgcatataatcctctgacacaattctgtttccatgaattcatttttcctccttcatctccccatccctaccactcccattcccctctctctctgaattctgagtctttgtaaaaacgtggtcctgtgtcctaacttttgtgcctcagaacacagtctggatgggtctgtgacatggatgcttcatacacggttcttttattttttttttttttctcagatgcattctcgctctgtcacccaggctggagcgcagtggtgtggtatcggctcactgcaaccaccgcctcctgggttcacgcgattctcctgcctcagcctcccaagtagctgggatgacaggcgcccgctactacgcaaggctgagttttttgtacttttagtagagacagggttttgacatgttggccaggctggtctccaactcctaacctcaggatcaactgcctcagctttccaaagtgctgggattacaggcgtgagccaccacacccagcctcatgcactggttctaagtgctgccgaacgctccctggtacatttccccctgccatcaaaacagagactagcacataagaggcattcagtaagtatctgatgaatagatcaatgtgatttttcacctttttagtccactaatgtcctaaaacttacagtgtctaaggtttgggtgttaaagtatttttgcatttctggaatgaaacatcttattcatgatgtactatttaacactgctagattcagttactgtctttatgaggattcttacattttcatgtatgaaatgggtttttccccatttattatttttgagatagggtctcgctctgtcgcccaggctggggcgcagtggcacgatctcagcttgctgcaacctctgcctcccaggttcaagcaattctcctgcctcaccctcctgagcagctgggactacaggcacccgccaccatgcctggctaatgttttgtagcagagatggggtttcaccatattggccagactggtctcgaactcctgacctcaggtgatccctccacctcagcctcccaaagtgctgcgattacaggtgtgagccactgagctagtcctcttttctaatatatctatttaatgctatcaatttcccttcaaggacaaatttagctatgttccacacattctgacatgccacatttccattgtccatcagctcctttatttatttatttattttgagacaggctctcgctgtgttagccagcctggagtgcagtggcacagtcacggctcactataacctcaaacttcggggctcaagtgatttttctgcctcagccttctgagtggctgggactacaggcacactctactataccaggctagtttttaaggtttttttgtagacatggggttttgcagtattgcccaggccggtttcgaactcctggactcacacaattgtcccaccttggcctcccgaagtgctaggactacacatgagagcccccaagcctagccatatcagttctacatattgtatgttttctttatcgtacaatttcctttttaaccaaagggtcagttattgtatgcatttagtttccacgtgtatgggaagattttagctgtccctttgtttctgatctccaacatcattgccttcttttgtgacacagtacatggttagtttttgtaagtgtcatgagcaccccccaaaatactattttcttccttgggtttaaagttctgttcattagtccacattcacacattttctgcatcctgtttcctgcctccttctttcagcatctgggaggggcatgttaagctcttcagtgacaattgttgatttcctatttcttgccctgattctgccgtggccttgtttgtactatgtcaactcacctaagctggaactgtttcctagaacccctttccatgttgttgcccacagtaaacattaagaaggcagatgtgaactagtagggattttttaatgctctgaagggcgccagaaatggtaacagctagtgaacattgctgaccttctggcttaactcagagtctggggcagggccgcagcaacatcagcttctgctgggtgcccgtgtgcagctcctccgagtcctggggcaggtgcatgtgcttcagagccaaagcgggagaccagcactattgaggccagaggaagtgagagacagaagtgggtttcggtctgtcctagtgggccattctgccttccagtttgtctctgttcccctccacttctcttccagctttccttcctgactgctggccgggctgacctgtagtaacttcaagctgaatgccagagacaacaggaacaaccctgctgttgtgactgctctgcagagggaggacaaatccccttctcaatcaaaggtcagatgtggaggtggatgatatcatgcacacaaacacacgtgcacacactatgtgtgcatactcacacacgcatgcacatacacacacgcgagcacacacacgacagagaatgagaagaaaacttcagtcacatcacaggactttcggggagggcagtgcagtccctgagctggggacagaagtgtttcctgtggcttaagagagagtaggagcaagtagccctggtttccactttggtgcgggttgggcctggacatgcctggtttgaacttcgccttagtgctaaggcaggcatgggcctttttgtcagcttgcccaaatgtgggtaggagggaggcactggctgcaagcagcttaagagcaaacagaagcccggcatagtggctcacacctgtaatcccagcccttgggtggccgaggcgggaggatcacctgagggcaggagtacaagaccagcctcgccaacatggcaaaaccccatctctactaaaaaatacaaaaattagccaggtgtggtggttcaggcctgtaatcccagccactagggaggcggaggcagggagaattgcttgaaccggttagatggaggttgcggtgagctgagatcacgcctctgcgctccagcctgtgacagagtgagactatctcaaaaaaaggaaaaaaaaaagtaaacagactctttgtgacactgggacaaattgctctgccaactcccacaatgatttaagaactaatccatgtaatgaacccacattctgttaagtcattgtggttctcctcagatcaagcactgggtgacaggttctcgcagtttctacttcagctggatgctattttgtcaattgcacatacgtccatatgacccatggctccttttaacagtgacaccctcttcaaaccttgtctttctttgccttctagtctactttctgatattaaaaactgccactctgacattttggccttctgattggttagtaattttttcttcttcccccaaaatttcaaatttcaacctgtatttatccttctgttttatctatgtctcttatagactaatactcatgaatttgtctaacttttttgtttgtttttgaagatggagtctcgctctgtcacccaggctggagtgtagtggcacgatctcagctcactgcaacctccgcctcccaggttcaagcgattctcctgcctcagcatcccaaggagctgggactacaggcaccgccaccacacccaattttttgcatttttagtagacacggggtttcgccctgttggccaggctgttctctatctgacctcaggtgagctgcccgcctcggcctcccaaagtgctgggattacaagcgtgagccactgggcccagccagatttgtctgatttttttaacttaaactgagaatttgtcttttgaccaaaggtacaattaaatcctttcctatatatagtcatatataattggactttttctgccttctttgcattttctattcaccagactttttcctccccttgactacctcatattggacagatgcattttattctgccagaccgaaagttacccattctatctgtattcttctagctgtcatcccttccttatgacagcctgtaatttgtttatttttcttactctatcccacaatttaaataaaaggatttagcaattatgttaatgaacactttacactctaaaatattaaaatgtggccaggcatggtggctcacacctgtaattccaacactttgggagtggatccacttggaaccaagtgggtggaaccaaggtgggtggatcacctgaagtcaggagtttgagacctgcctgaccaacacagtgaaatcctctgcctactaaaaacacaaatattagccgggtatggtggtgggattctgtagtcccagctacttgggaggctgaggcaggagaatcacttgaacccaggaggcagaggttgcagtgagccgagtttgagccactgcactccagcctcggcagcagagcgagactccatctcaaaaacaaaaaatagaaaatattaaaatgcatcttagcaagagggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagc

SEQ ID NO: 1138 - DNA, 47224 bp, Homo sapiens; identical to SEQ ID NO: 1137

SEQ ID NO: 1139 - DNA, 47224 bp, Homo sapiens; identical to SEQ ID NO: 1137

SEQ ID NO: 1140 - DNA, 47224 bp, Homo sapiens; identical to SEQ ID NO: 1137

SEQ ID NO: 1141 - DNA, 13413 bp, Homo sapiens
cctgctcgcggatcccgagtagagaacgcaagcacccacgcccgcctgcaagctcccgggcgcccccggcctctcctgctcggcggaacgaggataacccagtagagccggacccaggggtgggtggatgcgtcgctggaggcgagggccctgcccgccaacccctgcgccccggccgtagccccaccccggaagttcttgccccgccttctcggctccgcagttctctgctgtctcctgaggtttgccagggagatcccgtggttttcatgtctcttccgtgatttttagggaagagggtcactatttggcccttccagaatctcagggtccggttctcccggaagtttccgggccgccccggaccccattggctttaggggccgcgtctccgagggctccgatttgggccctagattttggaatactgtgttttgtccgtcccagccttcaccaggcggatttcatctcccacacagttagtgatttatggcagaaaggaagctggagggatggggactgcaggttagctgtgagggccggaagggagcggttttgtgctgcacacaggcaggtcagcactcccagagcagggaccgccgggcgtgctttcggaaccgcttttgtctttcaaatgaacgcccagcgacagcagacgggagttccaggaccttagagaccggctaatgcttctctttaagttaggaaacaggcgcaggcgtgttcatggccttgcctaaggttacgtgctggttacagggctcctcctgctgcctcttaagaacagaaataatctaataggaggaataaaagggactattagggaggctaatgctcttgaagttttaatactactaaaagtaaaagcgcttttcagagtgaaagggaagtgaaaagggaatttgggtggctggctacatcagaagcttctgttccaactttagattgtcagggagttgagatggtgttttttgtttttatttttgttttagttttttgagacggagtctcgctctgtagcccaggctggagtgcagtggcgggatctcggctcactgcaagctccgcctcccgggttcacgccattctcctgcctcagcctcccgagtagctgggaccacaggtgcccgccacgatgcccggctaattttttgtatttttagtagagacggggtttcactttgttggccaggatggtctcgatctcctgacctcgtgatccacccgcctcggtctcccaaagtgctgggattataggagtgagccaccgcgccgagatggtgtgtttttaaaataacgtgcccgaggccgggcgtggtggctcacccctgtaatcccagcactttgggaggctgaggcaggcggatcacctgaggtcgggaattcgagaccagcctgaccaacatgggaaaacctcgtctctactaaaaatacaaaaaaattaaccaggcatggtggcgcatgcctgtaattccagctactcgggaggctgaggcaggagaatcgctttaacctgggaggcggaggttgtggtgagacaagatcacgccatggcgctccagcctgagcaacaagagtgaaactccatctcaaaaaaataataaataaataaataaaataacatgctcctcaatttaactatgggattatgtcccaatacacccatggtaggtcgaaaatgcatttaatgcacctagccaactttaaacgtcctcagaacacttagctcccctgcagttgggcaacatcatctaacacaaagcctattttataataaagtgttgactatgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtatgcatataaaccctaagtatttcatataattcagtttcacaaaccagaaactcaggcattgctgtttcctgtttgtggagctacaacttggtattttagatgtcaaatttatttatttttttgagatggtgtcttgctctgtcacccaggctggagtgcagtggtgcgatcttggctcaccgcaacctccgtctcctgggttcaagtgattctcctgcctcagcctcccgaagtagctgggactacaggcagccgccaccgcatccggctaatttttttttttttttttttttagtagagacaggttttcaccaggttggctaggctggtctcgaacccttgacctcaggtgatccacctgcctcggcctcccaaagtgctgggattacaggcgtgagccaccgcacatggccaaaacgtttatttttatttatttatttttttaacatttttttcttgaggcagggtctcattcttgtctcccaggctggaatgcagtgacttgatcacagctcactgtggcctcaaccttgggggatcaaacaatcctcccaccttagcctccccagtagctgagactacagtcatgggccaccacacccagctaattttattttttgtagagatagggtctcactacgttgcccaggctggtcttgaactcggactcaaaggatcctccctcctcagtctcagaaagagctgggattacaggtgtgagccgctgcatccagccattaaatgtattttttatcaattctttttttggcacaactgccagcaaagaaaccactcagtctgcaagagctaagtactagcagaattagaactgccactgaatttcctagaatcactgaaaaatttaatcaaggaattgtaagttgatctttcctaattttagtttcattttgtgtttttaataaactgaaagtaagggcaaaaaaaaagaatttccaccaccacttatatagcgtagttacagtagtcactagagttcctactatggtgaaatttacattcatattctctttaggtattttgggaaaataaaattttgaaatgcttaataataaccggaggatgtctatttctactgagaaaagtggtgatttcccccaaagtccaattgaatacagcatattttctgctcttctattaaatgtagcatttttatgtatagttgccataattttttgagctgaaagtgacaaaaggttacatagatggcattcaagaaaatacgtttcgaatgaatatgagcaaaaagtcaagcctaaagcaaaaagggcatagataagacaaaaattaagattgtatcactacatgtgcttcatctgtaaaagtcctgtaagtaatacagtcactaaattcatataaaaatatgactaatttggaattttttttttttttctttttttcagacagtctcgctctgtcacccaggctggagtgcagtggcaccatctcggctcactgcaacctccatctcccaggttcaagcagttctctgcctcagcctcctgattagctggaattacaggcatgcgccaccatgcctggctaatttttatatttttagtagacacggggtttcaccatcttggccaggctggtcttgaactcctgacctcgtgatccacccacttcagtctcccagagtgctgggattacaggcgtgagccaccgtcctgtcctgaaagtattttaatacagtgaattcactaacttttttttttctctcttaatttagacagagttttgctcttgttgcccaggctggagtgcaatggcacgatcttggctcactgcaacctctgccccccaggttcaagcaattctcctacctcagcctcctgattagctgggattacaggcatgcgccaccacgcccggctaattttgtatttttagtagcgacgggtttctccatgttggtcaggctagtctcgaactcccgacctcaggtgatccacccacctcggcctcccaaagtgctgggattacaggcgtgagccaccacgcccagcctaacttttttctttaatatttcttagaacctttttcctgtgtaatatatctatattcctgtgtaatgtttcatattatatatatgaatggattcttaggctgtatcacatgtccaactcacctctttgtcatagctggtatattgctattatattgtgcagcagtggagtagtgaacttcccactagaatgaatggcattaaaggacaaaggtttcactgaagcgtggcttatttgttttgccaggtgttccaaattttacataaactcgtataatactgtaaaactggaccgggtgcggtggcttacacctgtaatcacagcactttgggaggccgaggtacacgatcacttgaggccaggagttcaagaccagcctgagaaacatggtgaaacccatctctactaaaaatataaaaatttggcaaggcgtggtggctcacgcctgtaatcccagccttttggggggctgaggcaggcggatcatgagttcaggagatccagaacatcctggctaacacagtgaaaccccgtctctactaaaaatacaaaaaattagctgggcatggtagtgggcgcctgtagtcccagctactcaggaggctgaggcaggagaatagcatgaacctgggaagtggagcttgcagtgagccgagatcgcgcctctgcactccagcctggtgacagagcgagactccgtctcaaaaaaaaaaaaaaaaaaagaatacaatataaacactataatatttagaatgttaagtaatttaacaaaaatctaaataggaagagcattagaacatctttcttgtttttcatagaaaagagtccattggtacttgtgacttagcctcctaacagtcttcattatctttttttaccaaccactaagggaacatttaggctacatctttcatattgaagaaatatttgtctgaaattcagcaagtctgtctattttatttccatttcctatttttcctctattaaatccaagtgaagctaaatttatgtcttgtaaaagcatttattagaagatccttttaaataaaacttttaagtctatgttaattaatcgtatatttagcatgatttttacccagtatgaaggatggatatttctaattaatgtcatgcttattttgagttttcctttatatatatgtatataagagtgtgtgtgtgtgtgtgtgtgtatatatatatatatatatatatacacacacacacacatatatatgtatacttttttttttttttttttttttggagccagagtcttgctctgtcacccaggctggagtgcaacctccacctcctgggtttcaagcgattctcaagcctcagcctcccaagtagctgtgattgcaggcacctgctaccacgcccagttcattttttttttttcctttttgagaaggagtttcgctcatgttgcccaggctaaagtgcaatggtgtgatctcagctcactgcaacctccacctcccaggttcaagtgattgtcatgcctcagcctcccaagtagttgggattacaggcatgtgccaccatgcctggctaattttgtatttttaatagagacggggtttcaccatgttggccaggctggtcttgaactcctgacctcaggtctcctgacttcagtctccccaactgctgggattacaggctcgagccaccatgtccagcctttccctgttatacctttaatgtatttcttgaccttttaaacataatgagcatttgttattgtgattgaaaaaaattcataaaatattaatttatttacaggatctgactttaatgtgtttcagccaatagaaatatattttaatagaagaatgcattcaaggaatcatagtgaaaattctgtacactttatttcagttaaatgactgatatattttgttaataaaataagtagctgagaaaacaagtgtaagattatgcctttgaaaaacttgctatggaagttcggtgaatagacaattacatgaactaaagtcgtatattagactttccaagactattagtgacctcctacactgtttttaaatccatggtctcagtaccacgacagccacacagtgtgcatggaatctgtgttaggccattttctcacattagttcatcaaaagatcaggtactacagtgacctcagtaaatgaattgcagcaattgggatgtctccaagcaattaagaagtgaaaaagaataaaccatcccctcccagaaacaagaaagcgaacagagtgagaagacgggtcttacattccctttttgagagagagagagagagagagagagagagagagagagagaggtgcagctttgaatataagtaatggaatggtggtggatattttgacaatctactgagcatgttttcagaaatgtgcaaactattacctggaactccagtatttgcatacagcttttagaacatcactccgtaactccaactctgactgggattttattgataaagaaaaaaacagttttgtatgtatctttcagggacttggggttttttttgtttgtttcttacagttttatccccacaaaatagagcatgaatccttctcaatcttggaattgtatgtttaaaaactactatatttaatgggattctcaactctaagtataatttttaagtgttagttttatttattctttttttttttttttgagatggagtcttgctctgtcacccagcttggagtgcggtggcacaatctcagctcactgcaacctccacctcctgggttcaagccattctcctggctcagctgccccagtagctgggatgacaggcgtgcaccaccatgcctagctaatttttgtatttttagcagagacggtgtttcaccatgttggccaggctggtctcaaactcctgacctcatgatccacctgcctcagcctcccaaagtgctgggattacaggtgtgagccaccgcacccggccagttttgtttattcttaaagggaatttcaaaattgtcactattacattatccattaatgttgttttaacatctttcagatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtaagatttctgtctctacaaacctcaactcgaaatgtatttctcagatgctgaaaagtattttataaacaaccagagaataactgaaggaaattcgactccaactctctcattttatttgttttcttttatttacttttattttattttttgagacagagtctcattctgtcacccaggctggagtgcagtgacgcaatctcggcacactccacctcccggattcaagggattctcttgcctcagcctcgtgagtagctgggatcacaggcgtgcaccaccacgcctggctaatttttgtatttttgtagagacgggattttgccgtgtttggccaggctggtcttgaactcctgacctcaagtgatccacgcgcctaagccttccagagtgctaggattacaggcaatagccaggacgcccagccagactctctcatcttattaacggggagaggcccagaagaatgatttgcaggcagagtgggagaagaggtggtcgtttagctgggcacattcagaattttctcttttattgagcaactgtgctctgctaaatgaatcttttgcggtagaccacaaaaaaaaagcttttttcctcactcaggtgatttcattatcagataatcagtatgttgggtaactattatttccctcctgttactttttattttaaccatgaattagaaagaggttaaaatcctgtggtttttggggcaattataccttacaaacaaaagtgttagaacaactcgtgactttgatagtatatcccaggctttcctgagagggtagagacctagctttgctttatgaaggctagaccaaagtctagatttggctcccgtttatacagtgtggttcttcttaacttatttattctcttggctactaagatattttttttttttttttttgagacagagtctcactctgtcacccaggctggagtgcactggcgcaatctcggctcagtgcaacctccacctcccgggttcaagtgattcttaagagacgtgtttttacaaattcagttcacccctgaacaacacagggactaggggcttcaatgcttcatgccgtcaaaaatttgtgtataacttttgactccccaaaacaactactagtaacctagtgttaacagaaactcttgcccataaggtgaataattgatcaacccaggaatacactaatatcttgatatattttatgcattcatgacaaaccttttcttaattatttttgatatttatagtctgtgtggtttgcaacttttttcaaatcgttgcaaatctcaaaaaaaatttcaacaaattttttgaaaacaatccatgtatatatggactccccaagttcaaacttgcattggtcaagggtcaactgtattgtaaaatatgacatagtattcataaatatattttaatttttagatttgggattataacagtgtttattaactcagttgtttatttttattttttactaactcatcatttttcagattctaatgtgtagattttgcagatcactataagctcttctttttcttttattctattctttgacctctacttaaaaattcctttaaaagtacataggaggctgggagtggtggctcacgcctgcaatcccagccctttgggaggccgaggtaggcagatcacttgaggtaatgagtttgagaccagcctagccaacatggtgaaaccctgtctctactaaaaatacaaaaattagccgggcatggtggcatgcacctgtagtcccaactacttgggaggctgaggcaggagaatcacttgagcccaggaggcagaggttgcagttagctgagatcacaccattacactacagcctgggcaacaaagcgaaaccccatctcaaataaataaattaattaattaaattaaaattttaaaagtacataggaaaaataatggaggcaatacggaactatcatgttattacctctttaatagacattaatttaatgacattattgtggttaacaatagaatttaaaatactgatcaagtgaagattgattactgtgacttccatgtatctgtcttctcaaccattatactctatccccattgccaaggataattttcattactatatcatctatggcttttaaacagaaaaaacagaagcattatcatttttatgctgtttaaaataagctttgggctgggcgtgttggctcacacctgtaatcccagcagtttgggaggccgaggcaggtggatcatctgaggttgggagtttgagaccagcctgaccaatatggagaaaccctatctctgctaaaaatacaaaacttgccaggcatggtggcacatgcctgtaatcctagctattcgggaggccgaggcaggagaatcacttgaaaccaggaggtggaggttgtagtgagccgagatcacgccattgcactccagcctgggcaacaagagtgaaactccatctcaaataaataaataaataaaataagtttcataccctgccttaagattgggatgcccctaaagatacacaagcctcagactcataggcggccagctgtggtggcttacgcctctaagcccagtgctttgggaggctgagggtgaaggattgcttgaggccaggattttgagaccagtctgggtgacatagtgagaacccatttctacaaaaaactttttttaattagccaggcatggtggagtgtctctgtagtcccagctactgggaggctcaggtgggaggattgcttgagtgcaggagatcgaggctgcagtgacctgtgatcacatcactgcacaccagcctgggtgagagagcaagaccctgtctcaaaaaaaaaaaaagaaaaaaggaaaaaagaaaagaaagttgtcacaagaattaaatgtaatcacatgtttgaagtgcctgacattatagtgctcataatttgttgggctgggcacagtggctcacgcctgtaatcctagcactttgggaggcagaggcgggccgttcacctgcagtcaggagttagagaccagcctggccaacatggtgaaaccctgtctctactaaaaatacacaaaattagccgggcatggtggtgcacacatgtaatcccagctactagggaggctgaggcaggagaatcacttgaacccgggagggggaggttacagtaagctgagatcatgccactgcactccagcctgggcgacagagcgagactcccccacaaaaaatttgttgactgaaggaacagcaagtgtttagtaaatgataccttttattaatctcatcatcttagattctaaaataagtaacaagaacaataaaaccttacacaaatcgaagtatatgttccttaacaaaaagaagcacagggatttagaggaaaacaaaatcacttccttccagggacaatccccagagagggcttagtgtccccagtggcatttgcagtgggtcttcagggacggataggatggtgactgaaggcttgctttgggtgggatgtttctcccagtgtgcagtggtttgaggtttgagagaagctgtttttcattacctggtggtatagtgcttgctgaccttccctcctgaggggaaagtccttgaacttgaggatctcattccattccaccacaggcaagaaagtttcccagatcaaatggaaatgatcaagttgaaagtcaagaagaaaagaaagttcagagatgccaagggacatcaaaaggaaaaatgtctagaagtcaacaagcaaaggagcaacttagctgtcctaaggattgtcccatatcaagtagctcagctccagatgttcggaagaggcattggttgtactgttttctcaccggatcagatggctttcagataatctgctcctggccccaggagggaagagggctgtaatggagtcttgagaacacctcctttccctgccaaaggtattggaagccacacaggcaggtgtggcctcagtggtggaaaggactgctggttttctgtaatgtatgtcagaaggcctgccaaggcttctcagatatgctgttacctattctcgctaattcataagtaaatgagatgacacaaaaaatgaagatgtgttattagaaagtaaaagacatgtggacacagatggtatattcatctcctcttcctactgaaagctgagatttattcatggggaacagaaaaggtgcaggactacctgtatagaaggtgttgaagaacaggatttggagaaagggtgcaggactgcctgtatagatggtgttgaagagcaggatttggttttctacaacctagataatgagtttttggttatgataaagtgcatctcacaaaatctgaaaggaacatatttgacagtggtgaaatacattaacctggccaggaagggataacattgaagaggaagtggagagacagatctccaaattagatcaagccaaatgaaaaagtagataaaccaatatggtatacaagaaggaatggtaggagatgactggggacagtggctcacacctgcaatcccaacactttggaaagccaagacaggaggatcatttgagaccaggagtttgagaccaacctcggcaacatataataataatgataataataataataataataacaacaataaagaatggtagaagaaattaaaaaaaagatttttgacactttgggaagccaaggtaggaggactgctttaggccaggagtttgagaccagcctgggcaacatagtgagaccctgtctctacaaaaaaaaaaaagaaaaatagaaaacttatctgggcatggtggtgcttacctgtagttctaactactcgggaggcagaggctggaggatcccctgagcccaggaggttgaggctgtagtgagctatgatcacaacaccgcactacagcctcggagacagagtgagaccctgtttcaaaaaaaaaaatggatttcaaggtgaacttgaaattggggcagaaggaaatgcatatacacttttggatagttcttgagttgcttgctttattcactgtgtattcatcaacaatcagcaggcagcacttacaaaatggagcctgggcttagccctaatttcctcctgtggtattaattttagaagttagaatgtttaaaatcttttgtaaacataagagaaatgaagtttagattacttggaatgttttgtcttatcttggccacagtattgaaatttaaatctagaaattggagctgggtgcagtggctcaggcctgtaattccagcacttgggaggccgagctgggaggatcacttgactacagcagttccaggacagcttgggcaatgtagcaagactctgtctccaaaataaaacaaaataaaataaacctagaaattgggctctagagaaaagcactgaattagttgtcttttttttttttttccgaggcagggtcttgttctgtcacccaggctggagtgcagtggcgccatctagagtcactgcaacccctgcctccagagttcaatggattcttctgcctcagccccctgagtacctgggattataggcacctaccaccacacccagctaatttttgtatttttagtagaggcattgtttcaccatgttggccaggttggtcttgaactcctgacctcaattgatccacctgcctcagcctcccagagtgctgggattacaggcatgagctactgcactcggcctgaattagttatcttacagcataaggctgcaatgtaagatgtgtcttgtgggtatcatactttaaaagctcaagcattctaaaatctaatcttatactttgtttctgtaagtcatactttttaactatttgatagtaaaatatgagataaaaatcaaccctccattgtaacgtttgtactctggttcttgatgtgcaggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttgg

SEQ ID NO: 1142 - DNA, 591046 bp, Homo sapiens
taatttttaaatcaaagtaatttaataaacagacattgtatagttaattgaaatgcaggtagaattcaggtagtacatacattctgccttgttagtaaaaaacagccaaaaacctcaagcctgtggtgtttactctttcttatgcaattagcctttatgaaatcctatacatgcaacacttctatatttagaatgaacaccaagggtttaggattaaaaaaaaaaatacctgaggcaaagactttagagacattatctgtttaataaatatgattgtaaaagcaataaacaagagcaattatacattacactacatagtatttaacaaaaaatacatcaaaaaagtcattttaaaattagaagtagttccaatactataagaaaactttttttttttttaattggcttcctataaaaataagtcggcaaatgagagatttcaatgctcagttggattcctggaaaacacagaacagctgccaagcaccccactgctctcaaagttgctgtttggaacttctgaaaaaaaagcaaagcaaacctctgcattttggacagtgaatccaattaaaaataaggcaaggtagaaagtgttgcttgggtggttcagggtagaacatgcacagtttgccttctgggattttggaaaacgttgcagtatcggatttttagcttgccctgaatcttaccttccacatacatccctccctacacactcctctgaccttaagcccaccaaactccttgtgtgtttgcacctgcgattagcgagtaggtaggcacttaggtccctcccatttgtaggctctcattactgccttctgtttgagattcagctggaatggcctagtacaatggttctcaaactttagtatgtatcacaatcactgggagggcttgttaaaataggtggctgggcccactgtcacttagcaacagagaacaccactattcatcccctagagtttctaattcagtaggtatggggtatggatccagaatctggatctctaactagcccaagtgatagtgatactgctgatccaggtaccacactttgagaacaactggccaaggtcctaagaacaatgaggtcctcctctctgagcagcaccttgcctcactaatctcctacagatgggagggagctttgaggagaggcacatgaggatcctggagatgctgaatctctagctggccatctttggtcacttcccaaaatgccaggtatctcatgtcgacctctatttttaattaggatttacagcccattcttccctatgtctttccattcatttatttcttcaacaaatagttttcatactactactctaggcaaggcactgtgctagaataagagtgttatacctctttcatacttttctaattaaaatgaattgaactgcaactctgaggactccctgtgctggtttgagtgagcctcttttgattttccaacactttgtcttccacattaaatttgggagactccaactgaagaggatcaatgaggatgtttcctatgagataggaagcctggcaggttggggatcaattgagttctacaaataggtgactgcctcaggcctagcccatttcccagattcatatggggtatcctcaaccataaacatctctgcctgacaaacttctgacagcagctttgctattctttctgtgcctgaactacatgaagtcatggacatcaggatctttaggacaccctcattatcaccagggcctgtgttataccctgttggcttagggacatagcaaagaaggaggctgagcatactaagaggtttatcagaacttctttctcctatagtttatagtgggctttgcccagtccataatactaaaggggcctctgctgaacaggcttttgtttccctctttctctgagccttctttcatgattaccctgggaaaaatggggtttcttcatgctttgtgccaatcttttttgccaatcagtaactctcctcctttatacagacttaaatctttactttaatgatactatgatactcagaggtcagagagcacacatgaaatcactgggatcatcctaaataatcaaactctcaccctaatgtaagacaagacccccatttattctctcagactgtttgacactcttaaacacaaagtccattaacctgtttctccttccagttaaaatcagttttatttcacaaacatttctattctactgtgagagtggaaataccaggtaacagcaaccgtcacaggaggaaattgccctgcgaaattgtcacacattcaaaacatttctcacaagaatcttctggaatcagatcgcacgagattttcgttaaggtgtgagaacaccacaattcatctctatgctttcttttccaaagtacatggccaggtttgaattactttgcatatatcaactctttcgcatacagtatatgtttccaggtgggaaaaggcagggatatttgaaaaaggcaggttctagaggaaaagacaaagatacatgaaactgaaccctgctgtgcaggatgcagcaaggtccatgggcacagaagctggcatgcttgggaatgtacaaaactgacaaagggctcagaaacttgtgagtagtgggggcaggggcggcacaggccaggccagtatttaggaaacgtcagggttaatgtccagaatctagcaatatgtttgggaagaaaaactgagaacagttgaaggacaacttacttggggtttggagggaagagattcaaagatatcaacagatcatggtcacacatggatgacaaacaaatgtgaagacaggacaatgggtaactaatgggattccatttcctactgcagttggggcaggagtagggaaagctgcaaggggaggcaatcatggtggaaagaggtgaacaggaaaccaaggtccgtttctgacatgctttgcctccctgcctcccttccttccttattctaccggcacaaagggatcttcaactcgcatctttgttcctgtggccacagagagtgcagaaagcagccttgtggccactgctgaccaacagagctaccaaagctaacttagaagggaaatgacagtatggaaagtggaacagagaaacagctcagggtttcaaactcctgtgcacgtctttgtgtcttatgaaaggagctggggtagctaatccacccatcagcctttaatgctaaaatagctgataaatctagagccaagaatatttccaaaaatacatgcagatttccttggcctatatatgttatgaattttctacaaacacgaccgatcagaaaaaagagagagaagaagaaagagggagaggggagtgttttccattaaaatagagcacctgtacactgcccctccagacatgttctcagagtattgtccacatgcacaggcttaaagctaaaaacccttgttgtctgtgtctgaagaattaaaaagtcccgatgcagtgagtgtttgtttgtttgtttggattttgattgtttatattttatgttttgttttgtttttgtttttgtttttttactggcgtcctccattcaaacatttacataggtagggatttcttttgtgctttgattctcagcaactatggaaatacttcctggcaaaataggaaacagaacaacaaaggaaagaaaaaaaacacaaagttagtggtcatgaaggatgatgtacttgacaagagcgaaattctttcctgatcagcaggtcgcctgtagcctttgggggttttccttaaattgcatactgtgccccagcagatccccgctttggcgttgaaggcggagtggcgtgtcttgctctttgcaatcggagagatgagtcaccaggttgagtagaaggggagggaggggagggtaaagctactctcctaagagaaaacgtgtaacacttactcatttaatgacactggaaagggaaaggtgtcagagactttgcaatgtgctgcgatatcttcctggagaaggaggaattactactttaataaagcaaacagaggctgtgcttcataccctacggaaatgcgactgagaaccaaacgatccccaaaaatgcacttagaagctttaggaatgagtagacagggtgaatgcttctctggacttgaaggcagaaaagacttttttctttttagccccaagcaatcacacatttattaccttgcctctccaaataaaagaaagtgcactgtgaaaatcggacaccagatgtgactgcagttgttatcattatctatgataggagccagtcactgcatttacatttccccttaacacagccacagacctttcccatattcatttaaagagggttatgtttccgtttacatactcattgttttccaagtaagattaaaaattttatgtaaaggccttctaggtggtttggcattatcacattagagtggagcatgaatggttatataataatttattcactgttgtcagcaatgcaggatctagatgtaaacatataaggcttcaactcctaatgccaacagacaggaggaaccagacagagaaatggatcagcaatagtggcttcataggtttgtctagcttcctggaaaatttctgctgcaataaatagcagaatctagcaagtgaacgtcagattctctatacctcgttgttggattcccatgcctacttcacaggcagagagagagccattgaaatatgagaaagtccattttacaacttctggtaagggacagtctaaaaagaggaagaaatttgctaatctgctctgtaatagtctcacccaccagtggtctctctcaggatgctctactgcctggatgtctgcaaacattatgcctcttgtcctcaatcttaggttccaaatctcctgagggaaagttcctagactaccaatagatgtaaaaaaaaaaaaaattccctggaggatcaggctggccactctcattatgtcacttctctactggtgttccagagcagtttgccctccttaagagctgtatccagttgaggctaccatgtttcattctagtcaatacataccatgtcctgcaaaccctgcccagccctctggtccaccagccttagcctctgaggcctctccttcttatatactattaaagcaaatgctttgctctttgcccataaacatataacattttaacattttaagcccaatattttagggagggttttgcaaaaggaggaataaactaatgagagaaaaaaactagatagaagcaagaggtttgtttgtttttcccccatcccaatcagaggaagcagggaaaaagccatcttagctgtttctctcaggggtgttagagcaaaagaaagtggttatgtcaagccagaaaggggttagagagagagtcagccattgcctactcagccgaacagctggtggctactgggaatcatttacctatgagctgggattccaccttctcatctataagctggccaggcctccttagttcagtctgagggacattgggcctgctttcagagtgactgactggactgatcatctcttgttctttctcattctgcatctgggcataaacattaatccccgggatcttcctaaaatattaatagaaaccatcactgctatgcacatcactgtaacacatgcttctgaacctgtcagggagaaggaagaggtcaggggtgggggaacgtggatagagggacacgcaccttttaaacttgtagatgacgaacactgccagccccacaaacaccactgagagcagcatcagcatggcagatccactgtgggttggagtgaggtccaccaggggggcttgtgggggaaacagagcagagaaaaatgagcagagaactgggcaggtgagactctatgagaggctcaaatgtttcacacacaagcagaggtaagtcctggaaaaccatgtgggatatacacacaagatgcatgtcacatggctgacatgggatgcatctgagcccacccctactcccaccccaaatgttcctgctctgcagcagagcaatgaaaagcacagaccccagggccaggctgtctggattcaggtcccactctaactagctatgtggtcttgggcaatttgcttcaccttaatgtaccttatgtggtaaaataaaaataatggtatatacttcattgggttcttatgaggattaagtgagctaatgtatgttacgcattgagaaaagtgccaggcacatagtaagtcatgtacctattagatttcatttctactgctgctagtattagtattattaatcaatatttataatataataattatattttattatactctgagtgtaagctttttccacaaagcaaaacagattgccaataaaaccacctgcaggaatacatttgtgaattcaaccaccccgtcacccctactccagtagttgtcatgtgagaaaaataattggaaagttgtcatacgtgagagaaagaacagcaaagtgatggagcatgcttgtatttttgtacacaggaaactgatggccaagtgagtatttcacgagggtagccgcggagatgctgaaggagggatatgccacctggctgtctccacaatctcccaaaagctctgacagccctccccaagatgctccagcctctcaaacacagtgagtttttctctcagacaaaacagaagcctctgcctccatgaaagagtctccctccctgagtttccccttgaggtgcagtctggaaaacacttctcgccacctctccaccttcccccatctcacagtcaaacctgttgtacctgtagactttgcaattaatttctaccctcttaaaagttgacattttgcaaatgtagtgcagctcgtgcataaaagacaagccacatgtactccagggaagccttggtgctgacctttaccttccatcaacttaagcaaagcctgatacccagaaatacaggtgacctttaatcaccattttctgtggttttctctggtgtgagccgagagggcaacattctaatcacccaggtaaaaaagttcaagaataagtgactataatactgatggtctcagacaagactctcagttgcttctgctctgtctactcttttcaggattacatctcggccactctgtattgatactgggaagcatattccatctaaccacatagttttggtgaaaaatgaaagccaccccttccttctcagaaaatagtcatttcaggagagttggctttcaggaggcactgaatataaggaacccccccgctattttctctcccctgtaagtcaaacttcacctcagttttgaaatgggaatatgtaggtttgtgtgtaaaagatgggtggggtcccactgccgtggaacgcccaaggcaaattttcttttggttcaaaattagaaaacaaagctctcaatgccatcggcagagaggttcagaaattcttcagaactcaccctgcaactggtaggatgtcatcaggggaagagaacaccttccatttgtcatagacattatcacaattgattttcacaaatggaaggcagtgactatgatccccattaaacagataacaatgaagttctcattggttagtgttgttttaaaaggacttagtacttactagtaaatggaagaaccaagacttgaacctgaatcgtcatacatacacacacacacacacacacacacacacacacacacactttctatatactcaatcctgggctaatttcagtaaaagacatatttctgaggatggggattaggactaagactatagcacaaaaagcaaattaacaaggagcacaagttaaaatactaagttttaaaaggagcagtaggaataataaatcatgtacgcttacgtttggaagacaggtatgtgtatacatatatgcatatgtgtatatatatgtatggatatgtatgtgtgcatgcaaacacacacacacagaatacagaaatgaagcctcatgtacctaccactcagcttcaacaaccatcaaccaacagccagtcttattttatccagtccccacaacctccaaccactggattattttgaaataaatcttggaaaacttataatttaaccacctataactctaaaagataagatctctctctctctcatcattaccacaataccatcatcacatcaaggaaattatattaggaagatgttttaaaggcaatattctaatgcaaacccttaatttgtcagggaacaatggaggctcggaaggggccacagatgattgggatggttagaggttgaaataaagctaaacttttcactcctaactaaatgctctttcagcataaccagaataccagtgatatgaagcaactaagaatactgagcttgcttgaaaaggttggcatttgaaataaatggaaaactgagagaaaattactttgtccaagctgtcagcaacacagcaaactcgcatatgcatgcatgcacacacacaaacacatacacacacacacacacacacatgaaccttttcccttctctttccttcctcctatctctccccatccccaggttgtctttcgattctaaatcatttacacttaaatcatcattcttcaacaagcagcattaacactgttaagtaattagcatattattctgggaaaatgaacttctgtatcccagttctaaaatgtgtgttatccattcaccctccccatctctgcatcagtcagtcatttctcagaggcaggaagcaggaagcaggaagcagccagcagcagtggccagagactgactaccactgccctctgttccgtgggtggtgtctgcttgctgattggtgcctgagtataaagggacctattattgctccatacaacagcagctgcatttcttagtttgcccagcacttaggtgcatttgtgtgtgttttgctgagggatggaaacttgtgataaatgggctttagcttgttgtgtggaattagcatactttaatccctttccagttgcagcttaaacaaggtagacgtgtaggggaaagtgctgagcagttttttgccattattcatgcacaaagtaaaacatggataccagcagtactccaagtgactcaacatttttaagcctgcgtacttgcacatatcatttctaaaatcctctgaggaatttggaaatgcattgaatttttatattttattcatgaggacctggaacgataataatgggaacacttacaataataacaacaatcttcttgtgaaaagtgattgccacgtagtaagtgctaaataaatggttatagttgtatgtatgagaacaaattcaaaattccacatttggggttaagtaatgatatgagcccttttcagaatcaaacctggctctgtcacttatagactaagtgacttaaattaaatctcagtttcctcatctgcaaaatggagacgaaactagtgtttagtctagaaatttgtgagattaaaatgagatggaatttataaagtactgtcatagtatttgggacagactacatgcccaatatttctaacattgtcatattattgctatcatatttctgaaagtgtattcttctacagaaaaaaaatcctgaaaaatgatgacagttccctggtgagataatttggggcaatgatacatacaacattccccatatggagattcacaatgcacatcagtatattaaatgatcacagcagcccttgcagaaaagaacacatttaactttaccatagtctttcataaactcatttgaccacagaccctttgcagaactaggttccacataacactctaggaaatgcctctccccaggcactgctttccctgttgctgcagttttttcgttttgttttgttttgtttttagatgaagtcttgctttgtcacccagactggagtacagtgacacaatctcgattcactgcaatcttctcctgtgttcaatcaattctcttgcctcagcctctcgagtagctgagattacaggcacctgccaccacgcatggctaatttttttttttgtacttttagtagagatggggtttcaccatgttggccaggctggtctcgaacgctaaccttgagtgatccacccgccttgacctcccaaagtgctgggattacaggtgtgagccattgcacccggtcccccttgctgcagttttgccctttgctcggtttctttccaagttttaaggtcaataacatggtagcatcacccagtgaagccatgcagaacaatcttattgttgtccagtgttcactttcattctatcaaaaggacattcctggagaactgctacttgcactatgaccccgaaactttcaactctaattctaatccaagagttagtgttttcaggatgttgtagaagtaatttaccataccttgatattcttttttcctctcctgaccccaaagtagactcaattcaggcttgagttatatgctttgaatatcacaaaatccatgtggtctgaaatattttttcagaaattacagtgatatgggaatagcacagagaaagtttatccagaatgcagaataggcagaaaggcttccatttacagagcactttcagttgtccaatgggccttccctccatttagaaacaaatccaatcatcagagtcttaaagtttcctatgttattgggaaaaagccacaagactgcagactagactaggtgggaatttccagggaagtctcttgttaaagtagccaattgggaggccattagactgaggcagctctggcgtcctgggttcctatgtaaccaaaccaaaacccaagtaaagagtaaacagtcatattctaggaaaacaaaacttaagcttaatcaattagaaaccactagctaatatctaatgagagactttctactagaattatccaaagaaggctattcctccattttaaccgatcaaatattttctttgcctagctttcaccttcaccccataaaagcctcatgccttttagggagccctaaatcaactgtggtctagtgctaactgattaatgaatcattgtttgcccaaataaactctttaacattttaatgtgtctcagtttgtcctttagtagctctaatgacaagtgaagcattgtttctgaatttaaactgagggtgaatcttcagtaatatccagtgacagggagttgaggtcacttagccaagtaatgacaaacatcagtaactccaagaccaaccatcatcataataaacagacaagaggagaagaatgacttatggttttctaaggttggaaggtgatgattcctggctactatgtgaaatattcctcaaagtgtagcttatggactacctgaatcagaattacttggagcacttgtgaaaatattgttagctaggcttcacttgaaaaaaaaacatgtatagtccaaaaaaaattagccaggcatggtggcaggcacctgtagtcccagctactcgggaggttgaggcaggagaatggcatgaacccgggaggtggagcttgcagtgagccaagatcgtgccactgtactccagcctaggcaacagagtgagactctgtctcaaaaaaaaaaaaaaatgtatagtctttgagagtaggtctccaaaatccatatatgtgacaaggtacccaggtaattattatgtataacagtttgagaataccgcatagcaggccccagatattctcactcataaaacttccagtcctgtctttagggcatgcctgacttttatattttctggatcactaaaacaaagcaaaaatacccccctacacacacaaatgttcccctttgctgttgatagtagctcaatctggtgatggctccagaagaaagtttgttaaactacctaaaagcatctcaagtctcccctaagtgagcagtcagcctcatgtagatatggattacattgctggctcaatcctctacccttctctgtgtctaaactttgtgcaatgagtttgaagcttgtctcacctaaaaggcaagaggtaaaatctgtttcttcatgtcttgaatctgagctattattataatctgcatctggcaatggaatgcaatggaagcaatggtgtgctaattgtgaatttcacggccttgcatacctctgctttttctcttggaatcctaccactgccatgtgtgagcaagaccagaacagtcaaaggatgaaaggccatgtagaggccaggttaattattccaaccaaagcatgctagagcagcctgcaggcagctgacccgtaacatgtgagacagaccagccaagatcagcagagctccccaaccaacaacccatagctgattgcagacagacaagtgaatgtagataagactagacgcataagcaaaaataaatgcttactattaagccactgaacttctaggtggtttgttacatagcaatagcttatttactttcctcaaaagtctctttcaactggttaaacattcaattaccaattattacctttgagctccacattagccaatttttggtatagtcttctatccccactctcagggtggcagggtaaaagtaagaagaccatacatattattttcaaagataagacactttaagaatgaaagggggcgctattaaagcttacgctgatatagcatagataacccaggacagtcctgatcactctaggtatcagaaacttggtgtctaaagggtagcttgtcctatgttctggcatcttgtctgtattttatatgtgttatccttcccctttgctttactttttttttttctttttgctaatttctcttgactatctgccttgccttcccctgggatactgcatttctgacgcatgtttgtgcccctgtttctgttcatctgactgttccttgctgaccattctctgaccaagagtttccagacatatcctctagcctggctaactcagtctagttaccctgtaatcatttcagccccttttacggtcccccgtaatctcagaaaaaaagaaatggtgaagaaagaatttattagaagctaggccaggcatggtggctcatgcctgcaatctcaatgctttgagaggctgaagtgggtgaatctcctgaggccaagagtttgagatcagcctgggcaacatagcaacaccctgtctctacagaaaataaaaatattaattggatgtggtggtgcgtgcctgtagtcctagctactcgagaggctgaggcagacagatcgcttgagcccaggtgttcaaggctgtagtgagctatgatgtgcccctgccctccagactggaaaacagaactagattctgtgtctaaacgaagccaacgagcaacctcattgctgcacgctggtaggtagatgaaaatatcacatttaatcatattgcggggagggatatatttagatatatatctacatgataaacccactattgtttataacaccataatgattaaataactatgaaaagccgctgggtctatgtatctgtgcaactacctaattacttgaagataaaaaatatatttattttggggaaaaataaaaggaagaaaacatatcggtaccaaggctttacttaaaaaagacttgtaaatgattactatgtagataatacggtgaccgaaaactaaagagacagataaacttactggctgtggaagaatttcaccagtactaatttcatccctaaatggaaaatgttattgcaacaatttacttcactttacagttcagagttccacaactcctatttggcatctgcatccataatgttgtggctgagattatattgtagtttctaaaacttcttgacgaacggtaattctcccttcaagtggaaagtctttttctcaatgtgaaattgtagtgcagaattcatgatgtatcacgacctaggtcgaaatttgaagtttcttattccctcccaaatttactcataacacatccagtggtagcaactgaagcctggaaatattaattctctaatatctctgtgataacatctttttattacacctgcaaaagaaattaaaccagtcagcagcagccatagaggccaagataacacaagataacagttttattaaaaaacccacacatacccttgacaaaggacagttttcctgaaccgagcagtttaaataaggcaactgatagacagacaggaggaggtagaagcaaagttcctgtgtattttttttggggggggtcatgtttttttatttaacctgaggtttgaggctcttcctttgataaatattaaccctttaccatttttataatgtgcgtttatccagaactccagacgaacagcgaccaaactggaaagcccagcgtagggcaacctctgaattctgaaatatgtacagacatatagtgaaatgtagctgtatcattttatgctcacactggcacatgaacagcatctagataatattatttgtttaactctcataaaactcaaggctgttcaattacatctgccattaagattccagttcacactttaatcatgtttcaactgcttcatggccacagctcttggctggcctttgccattcatctagattatggatttaatatgccccagattcaggggcatgtttcattttctcccccttcctcattgtcatttgcccattctgccaattaggttagctccaaatattccaagaaattagattttaatatttattactaatttcctcctgtacttaatatcacaggctctccttatttaattcatgcttctgttttagtggatggcttgagttgtaaatcagatttattactggagatagtcgttcacctttccttgttatgcagatggatttctgtctgtgaaaggctgttgaacagtggttgttaagaccagtgaagaggccaccgtcgtaagcatcattagcagaaacttgctaaaaatgaagattcctggggccgggcgcggtggctcatggctgtaatcccagcactttgggaggccaaggtgggcagatcacgaggtcaggagatcgagaccatcctggccaacacggtgaaaccccatctctactaaaaatacaaaaaattagccgggcgtggtggcaggtgcctgcggttccagctactccggaggctgaggcaggagaatggcgtgaacccaggaggcagagcttgcagtgagccgagatcacgccactgcactccagcctgggtgacagggcaagactccatctcaaaaaaaaaaaaaaaaaaaaaaaaaaaaaagaagattcctattcctggctccttgggattcttcactgtgtgtggtgaggcttagaaaatctctatctttataaagcttcctaagttaattgcaatgtaaagtcacgtttgagaacagctgctatttatagcagatatctcccaccctgagttggaaagagttttctaactatggggcagggtttcatgtatctcaaatgctttgagggaactagtcagctccagctcttttagttctttgagcagaagtcccaccatccaaattgcagttcatttgcccagtacataacttacgaagggcacataatccctaaagggttgttatttgctatttaggaggtatccatctagttaggcttttgccttctcaaataaaagtcagtgttgccccttgcttgccctctttttactttctattctcatggaaaccttacctattctgtcttagaagagtcaacaggttttcaagtcatttcccactccctccttctccccaccaaatataaggactaaatttactcatgaccaagggttctcatgagaacaaagatacagggtttgatagagcttgaaagatttaaatcggcaattaaggctttaacttatcacctgtcagcagattcccctcacctgatgatctgctatgagatggtaaattaaagctcatagttgaatgtatattctggtcctggtcttctcacctgagtttccattccatatttccagcttcctgatggggtttttcacttatatgtttgatgacatccaacccaacatgaaccaccaaatttatcgtctttgacgacgaaaaaaaaaaaaaaaaaaaacaagctccacctcccaggtctccatctcgactaaacaaattaccatatcttgccacttgccacttgagttgtaaacttgtgtgtaaatactttgttaaaaatagaaatgataatggagttttgcccaaacctattattaaaggaaaaaaccccaaaatccttctagcagcctttttttcattttccaaattcattataccttatcatctcaaatttgcattaataaaatttcttcactagcgcacaatggatgatggacaacaaagtttataatatactagcatattatttttcctgaattttatccctctccctttgctcattattttaccctcagtaaatatactaattatgaatatttgagggtatatatctagaagccccaatccatgtcagacaacacataattttatacataaaccatataattccacctttctgtgcctttgtgcaacctggcctctcaacctgcaatgcttatttgctctttttttggtgaattcctattcaaccttaaagactcagctttactgaatcttctgcatagaacattttttcattctcctcatttagaatttagtaaagtttcatgcaactagtatttgtgcctcaggtctagccagctcagtgtgagtgagggccctcactcatctcatatgccctgataaactataggtttaaaggaataatttcaaagtaaggcatagagtcatgtgaagaataagatgataaatctaaaaatggatcctgcccttgagtacatttcaagttactagggtcaatgagaaaactattggcactttagggatattttcttaacggctcaggtttgttcttccacaagtaactatatggatcaaatggtgtgcattagattcagggccttccagattcttgctagaaaaactctccctaaaatgacatcatagctgttttatgtttttgtttttgttttgagatggagtcttgctctgttgcccaggctggagtgcagtggcatgatctcagctcactgcaacctctgccttctgggttaaagtgaatcttgtgcctcagcctcccgagtagctggggctacaggtgcacgccaccatgcctggctaattattgtacttttgatagagatgggatttcaccgtgttggtcaggctggtcttgaactcctgacctcaggtgatccacccacctcatgctcccaaagtgctggtattacaggcatgagccagtgcacccagcccattatagctcttaagatacacgatacagaaggctagggcaaatgcatacacgagagatggggaggacaagggaggcatcacagaagatgtgaagaaggtttggctggtttgttaaggtgaggagtgtgcagtccaaggtacgtgaccatgagctatgccatgaagtgaagctgctctgacactgaaaccatgtcttccagtggccagagcaataaaatagggaccagtgattcagtctcttttggtaacagtcgcctgccagtcgttctcccattctctctcagatctctctttctgggacgtagaactccaggaaggataggcccagttttctttcaactgcccattccccacaatgtgtatataaacaattacaatgcatatttaaagaacacctgccataagaaaaaaaaatacaaagattccctagatgcttattgtgtaaatgaatgcaagtctccactgatgagttatttgataagaagaagcatgtcatggggacaggttcacaaatgaataaactgaataaactggatctgaaggttaactgcgggaatgggattttgaatatatctctgcaggctataaattatgcatataattattcataaaaacaatatttgttaagcacctgatatgtgcaagttatctgctaggtaaaatgatgaagatgatataaagatatatgaagaagctgatataaagacatgatgaactatatccaaaagaaattaaataggagtgattcaaaaggtgatggtcatgatcatcaacatcagacagataaagatctagaaatccatgtgatttcagacaaggggaagatgttgtccaggcaaatgtctctggaaagatgtcatgcaaatgttggcattgaactgagccttaaagtacaggtggacaaggagaaataggtgaagaagtggggagaaatattccaatctggaatatcatgagtagacgtacactttggtcaagacagcagtgcttccagtctaacactagcttgactgcattctattcccttttccaactctttgtattgtttttgcaacatcatagcctttgtttgctaaacatggatgccagctgccatcaggtactaaaagtcaaagggagccactcaggccatgaccctccctcaaccttctggataacatgtttctcattctcccttattctcatacaggttcaagtctctcctttccgcaaagagaatttcagaaacatacctgtcaggagtggttagacccttaagaaaaactgcatgaaaaccaagaaccacaggaatggctaggaacaaaacaaggactacattcaaaatttagctcagcttagataccacagttaatgaattcccaaatggaacgtgttggtgggtggggggcagacaccatccagtctctaatgacattcaggtatctgcaaatgctttccttgtgttcccataaaagcaaacagggaagtgaatctgaaaaccaaaataaggctagtaaattcttgaaaagagacagttctttttccttggagacaaaccaaattatgcatttgcttctctcaccaacaacatactctggctcaaacatttttaaaagaaggctgctgaacatctgctgagcaattaatgggatgcaacagcatgttgtaatggtccctgggaaggtattagcaatcctgcttatgagacatgaaatgttgctaacaatggttcttttttttttcttttaatttttattttcccctgcctacaggggggatgagagaaagagaaatagagttgatgtggaagttctacatctaatactcctccccactgtttctcttttttttttttttcaggcttccttctccttctcttcctagccacccaaatattaatgtgttaatttcaacctaataaaagcaattgtggtggctcatgcctgtaatcccagcactttgggaggctgaggcagacagatcacttgagctcaggagtttgagaccagcctgggcaacatggtgaaaccctgtctctaccaaaaacacaaagaaacttagccgggcatggtggcatgaatctggtcccagctacttgggaggctgagggcttgagcccagggggcagaggttgcagtgatccgagatcatgccacttcactccagcttgggtgactgggtgagaccccatctcaaaaaaaaaaaaaaaaagaaacaaaactgtggcaagtgtgtctcggcccaccgataccctaccaaagtgccaagttttccatgagtgaagggggaattccctccactgttttttgtatatgtagggtctaccaccctattcaaatattttttttctttttttcttttaatcaggtagctaaaggtaacgtaggagcaatcaccaacaggaaacagatccctcccatattttacttccttatcacaattgctgttcccgttgacacgtttgtcttttgcataagaaaatcgagccctgagtgactgtgctcctgtggacaccgccagctctaatgcgttatgaccagcatagccaaactcaatatagcaaaagtttccaaaactcagttattccatcagcccatgacattatctttgtttacttatcaaactggagctaattatccacatataaatctatatctactccagttgctgaactagccatgacagaaaacttaataatgccagttgatcaggcttggaattatatagccgaaagaccctactatcaaaactaacaggaaagatttctacaatggttggaagtcaaagaattttctcactctctccaaattggtccaggctaagattgggcttttatttggaaatggatatttttttctttggtgactttgtgttacacatacctatactgcaaggggttcttctttaaatctcagtgtgcatatctgggtccccaaaatatacctcccttttgccagcccttcttcccaggagtcttagtcctgcttccgaaactcctagttatagaaaaaactacaaacatgaattggaaacatttttcagttcttcccaactttgcattattttttgtcatctggagtttttaccagtgggattaacatatcatggttatcaggaattgacttcccttcccacatggagctataaatccaaggacctttggatgcctttgctgtattcagtttctctggccaagccagctggccaaaccagtctcagctaattacccactttttgatctcaatatttcagcttggtcccagctctaaactatttgtcattgaagaaagtttccttaagtaacatttaaaataaggtttccttttttttacataccacttctccctaaagttaaatacggttaacatatcaatcttttaaaattttttaaattcacacataacaattatacatattcatggggtacatagtgatgctgtgatacataagcatagtgatcagatctgggtaattaacatatccatcatttcaatcatttatcgtttctttgtggtgggaacattcattatcttccaaaatgatctgaaccatcattagagcataatgcaataatcagttaaataaaaaccagacacagatggaggagaagtatggaaggaagaaaaagagtgaaatgtgaatggcctccagaattgaagaatgggagaaatagggttagttccaggtctagcttgacctccagtgctctcctgttcaacagagcaaggtctccggactaaaaaaggcactgtgttcggatacaccaaacctaaagatagtgttcattcaaaggctgcttatgctataaaagcaaattttgcatcatgaaggatagacaagttggccacatcccttcaaacccagacttcagtatggaatatccggcttagttgtttttaatttctaaactcaaagggaacaagtagtggctgatgaagttcagtctgctacctaaacaggctccatggtctgattagatgaaataaatcagtgaatctttttaaaacgatattcagtggttactttctactcagttgacatttgtcagtggcttggctattaggatgactacaactcttgtttctggaatttgatcattctcccatacaactagtcatgtgtgactctgccatgtgctacccccattcaccaaacaccaaagctcaacattttgggtaggaaaaggccagtcaggaccatcaaatgccctgagataagttggcagtggcagccttttcttcagagaattttcaccagcatacgattcagaaagtggcttttaccagcaatagcagtttatgagggcagagactctgtcccctatgttgacaacattgcttggcccagcgtaggcaggcactcggtaaatatctgttcaatggatgtgttagggtgaaaagatgcagaataggagatgtgccctactcaatcctccttgctccttacactcatctttttcaaggaatgctctgaatcagtcacacttctgttcaaaggtcttgatggcttcccagacctttgatggcttactcactaaagtaagtacaaacggcacaccctggcatgtttccaccctccacacctccatactccatgctgaggaacagtgactttaaatagtgggattgaaaaaacaacaagagcaataaaatattctatgaaatccaataaagaaaaaagataaaatccaagaaggtaagaagtcagtggtcagcctgcttggccttccgctagacctagcagagcctcgtgaaatctccaggaaaccagagaatggtgcttgcaatagctactttttgtcctcatttactcagcatccccaaagccctttaggctttacttccttggtgctttggtgcttagaatgacctcttgcatttaatgctatccatactttaaggttcttcctcgaaaccacctactccatgaaacaatcctgtatcattttgacaggatataactcatacctgctttaaatttcctatacagctttagttgctaataataataacagtaaaaataaatattaaagctatgtttcagacactatcctaagtgcattacctgaattaatcttcacacaatcccactggcagagatgctattaccatctctgagacatacagaagttaaatgtctttcccaggattccatagtgagtaacaaagccaagattgaaaccaatgttctgactggaaaaaaaaatccaagtgcttaaatatgttacgtagtctctctctctataagcatttatgcagtttgctcactgactactctccactgccaattcttcccatcccacagtaccactgccattgctacaccgaacttccccacaccacaaccaggttataagttttgtgaagatgaagaccactttgcactggtgtttgtactccatggagcaccagcatggtactctgcaaaaataagtactcaataaatattgttaatttattattaatacatcacaacaatgtctgtttctaagtgcttgtattatcattgaaaactatcctaagctacttgtgttatcatctattctaagttacttgtattattattgaaaactctccataagcttagaaggaggatcccccatcctcaccaccaccttctcagttgaagagatggaagctcaatgacattaagtaaattgtaagatcatgaccaattccaggttcaattcctgggtgtggccctgtaccactcctaagttcctgctatctctactgcgttacattatcctgaaacgtaaagaaagaaaattctttgtaatatgaatatgttgaaaataagactttgcagaaagacccccacaaatgtatttgttaatgttattttcaggatttctgatgagataaataaagcatgcttccatgtgagacgtatataagcggtttgctgacagtttttgccagagactaagtataaaatattaccttctcactgggtcacccaggttggagtgcggtggcgtgatctcggctcactgtaacctctgcctcccgggttcaagcgattctcctgcctcagcctctcaagtagctgggactacaggcatgcaccaccctgcccagctgatttttgtatgtttagtacagatggggtttcaccacgttggtcagactgatctcaaacacctgacctcaagtgatccacccaccccagtctcccaaagtggtgggatcacaggcatgagccactgaacccagctgaaagtgtcacctttttctgttgtttaacggttctccattaaggcagaaacaccaagcaagggaacctccaagatccgatgactgatttgatttctgattagcattgttaccatctagcctttttatgaggaaggaagcacggactaggattccctttgccagagccaccagccagaaccccgggacatggacactgacccgctgttaagtgagcagcatggacaaggactcggactcctggcttcagctcgaagtgtactgagttttggttgagcgtgtggatcagcaattctgatatctgaaaaaagaagcatagttagtgacaccaaaagtgtcatactgattataaaccaataagcttagaaatatttactattttcaccaaggtatcacaatattatacccgtgagttatataaataaggtttatatgattttgatttaattccagaatatgcagatacaattatttttaagcatgacctgtctttacgtgctaattgcaacaaaatagaagaaactattagtgaatgaaaataattatactctttaaaaattattctgtatgatcttagaaaacttacccccagtcttttgagagaacatttgttatgcatgaggacttaaaagaagtatatacaatttacacattccgataagattaatatatattcattttacttccattctatttcccaaaccatgtgattttcacaaaacactttatgaatatttattgtatggtaaatatagttctgctaaaatatgcaattgaaacaaagtacagccacaacgtaagtaacaaattggctaacctttatttcatgcttataaatattatctaaactgttcctcaggctgacacacggataccgggcagacccatggaattctggactatgaaatatttaaccccaagcacggggcaaataacttcatttgggtagaaatagtgtaaggtaaggttttatggatgaggtaaaatggttcgtctgtttagagtagaaaacctagctccatttgctgtgtcctttataatgttgaggaatttctgaaaagttacggggataacaacactcctattatattattattattattattattattattattattattattatttgagatggagtcttgctctcttgccaggctggagtgcagtggcacaatctcagctcaccgcaacctccacctcctgggttcaagcgattctcctgcctcagcctcctgagtagttgggactacaggcgtaagccaacacacccagctattttttgtatttttagtagagatgggatttcaccatgttggccaggatggtcttgatctcttgaccttgtgatcagcccgcctcagcctcccgaagtgctaggattacaggcatgagccactgcgcccggcccactcctattacttttatctggtctgctagccttatttttaatattctaataatcacttaatattttacttaacatgttatttaagtctaattagatgctttctgaccatcattctgctaattaaattcttaatttttttttccttttctatttgttgagttttatttccttcagtgagttgccaaaataacgcctttaatccctttatttgttaagcagggcctgatggcttagtttggaaacagacagtcacctgcagaagcccctgattggtgacagaactgaactgccccacagataaacttctctcctgaacaacaggaacagaggatgaccatcactgcccagtcgttgagcacctgggatccagagcaagcccagcctttcaaatgctgtcatttagcaaacaatgcagaaaaacaagattgtcataaaactatgctgaaaacaaaaacaactttattctgtgtattaggctacttcttttcttgggtgctgggaatcaaccagaatgattcaggtttacagaagtggatttctggccgggcacagtggctcactttgggaggctgaggtgggtggatcacttcagttcaggagttcgagaccagcatggccaacatggtgaaatcccatctctactaaaactacaaaaaattagccaggcatggtggtgcacacctgtactcccagttacttgggaggctgaggccagaaaaatcacttgaacccagaaggcagacgttgcagtgagccaagatcatgccactgcactccagcctcagagacagagtaaaactctaattcaaaaaaaaaaagaggaggaggaggaggagaaggaaggggaggggaaggagaaggagaagtggagaagtggatttctaacacagattgcatacaatggttttcctctgtgttcttatcttttaattggcagagtctttataggaatcagacagtggagtttttagaggtctatcacaaaggttttagctatgaaatacacacacatacatgcacacacacagatacagaatttcagaaaaaatattttttattcaaatatgaaagacttggtcaaaagtaatgagggaattagcctgttttgccaaatttatcacatggactaaagggaactacatgtatttgtgggagaaagactccccactttcaaccaggtgaagccatatttctttctttctttctttctttttttttttttgagacagagttggagtcttgctcttgtcgcccaggctggagtgcaatggcgcgatctcggctcactgcaacctccgcctccctgattcaagtgattctcctgcctcaacctcctgagtagctgggattacaggcgcctgccaccacatccggctattttgttgtttgtttgtttgttttgtatttttagcagagacagtgtttcaccatgttggccaggctggtctcgaactcctgaccacaagtgatccacccgcctcagcctcccaaagtgctggaattacaggtgtgagccactgtgcctggccgcaatatttgtttcttatcactgagaatgttttctcttcaagtgagatataccaatagctaaaccagaaaatggagtttatcaaaataacatatttttaatttataatctccaggagagacccttgtgaaaataattaactacttggttttgttttggtttacaacattgtttcattggctctatctgtgtcacttacaaaattttaagaaggaaatttaaatttaaaaattatctggtaacagaaagtacgtttcatatatttaacttgcatcaaaggacattcaacaatgaacacatgctttgtgagaaaaaatttgcataagaaaacaaaactaaataaaatttacattgcatataagaataatctcaattagaaccatgtgcttttctactgaaatgagtatgaaactgttgacagattttgacaatattttagatgttttccacaccacttgtagaagtgtttatcctgtattttttcaaaagattacaagttgttacatatattctaaaggacattatatatgctgtgaacactattttggtaaagttgcttgcttcttactatcttttctagcagaacacatcttaggtgtcagtgctggcatcttcatggaaaggaacatggagcttaaaggaaataccaaagtttattcagttaatatttgaagagttgagactagactttggctttgtttgactcctaatcctagggtatctccattaaaaatattttccttgaacaagctgacaaagagagagacagcagaagagagttggagagacgtctggcaggataggtttataagatgagaaaatacagcacttatattaattatgctgccttctctcattcatctgtgaagcacccgaagttaaaacatcagccccaatgcccagtgaccaatatgggctacaggagtggggatttcctaacaccatcctcagaggggccactttctgttcaccagttgcataattgggtaatgtttgggagagtcttcggctatagaaaggagtagaataaactgcattctactggaaagtatggcaacagcctaaatgagaagaaaaacacttgcctgatagagactcaagtgaaatactgtgtgatttctaggagggagactgaacctgctaaagcaaattgaatttatttctttttctttttctgtctggtgaaaagcgtgttgtcttaacaaatttcatttatcctgtatacagtcatccctcttctgctgctttccagcacagtccattttctattccacatcagctaaacaatcacgccatagaaacaacacattattcttggtatctgcctatttggtggaatatgcctattattcaagtgcaacctacatttcatttaaagtcccacttaaaaggacagtggaggctcaattcgaattttaggaaagctatcatcaaaaggatgtcttgggagggacctgtgacagggaaaacaccaatgttcctcattgtcttcttcacacaagaggaagattgaatgcagcactcagaatcaactagatatggctgtgggcagggccttcaatcaagaaaggtcaattttttgctcacatgtcatatccatggcagctatgcagtggtgttgggctccctgtggtcacacagggacactggctggtggagcggccatcacaagcatttccattcattacatacagcacaagagggaaaaggagctagcaaaattctacaatgtgcatttgaatactttagcttggaagtggcacatatcacttctgctcccacagtcctgaggctctgccccagcagaatagactcatggtacagtcctatcatgtaccctgaaagcagtgggctggaaatatttagtcacacagtgatggttaccacacaaagaacacattcaacatccaaacaatttctaatgaaatcaagagggggaaacactatcagatgatcagaagtaaagtggcaattcttgaaacatgaaaaaataaaagttttaaggacagtagagtagtttataaattcatagaacacataacccaaataagtggtacaaggtaaaaatgcagatgcaaatgggcttagacaaatgtattaatggcaaagctacactgggctaaaatacgaatatttattctgaaggtggtaggatgaatgcaaatcttactgaacttaatagcattctagtgccatgtttaaagagggtgttgcctgggatgacctgggagctggctcagttggtcagtcttgattctgccacactattaaagtctcttcaagtagcagttgaggaatattccttttgtgttaaacagaggaagatctttcccaattcatacattttttgcattgaatgacagggaagcaatggagccaaatactaaattctaattaacagtagctcaatttcattccttcataacacacacacacacacacacacacacacacacacacacaaacacacacacaaatttagcctgattaaagtgcctaaggggtctcctggataatggttcatgaagacacaaatccgtcataaatatgtgtttcctttggatttcccatcacccactttaagcttctctctacctcctcctgacacatttgctctggtccacctcttacctcctccacttttggttatagttctcctacttcagtgaccttccttgtaaactccagagtatttttgtaatttgactccccaagttaaaaagatctggactgataagcaaaatgtgtggatatacagaaaatagagattattaattccatttcataataaatttctattttcttaaaactgtcaccctgctccctatcgagatctgcctttcctttcttccttaggtttcaggctctgcatctgccaaccgtgtagagtaataaaaacagccaaggaagaaatatatatatttttgtggttgacatttttttcacatcttttttgttctttttagatgttctaatgtcctttaaggatcctgaaagacaacacacctaggctccttatctccccagcacagcatcacaaacaatcacgatagagcatggcggtctttcctccctacaggagagacagaaacaaatttattcacccctgaggactccgaggggagcaaggaagtgggatgcttgaggggcagggcttgctccacatctaagcagctggcctcaggacagcagcacgcgctccccttgatgaggccagctcagggcacaagagccttttctcactcaccagagatcccaaataaaggctggtggaaccctcccagacagaggtcactcgattaacccagcccgcctcatcctgataacagggtcaagtacttctcactgtgaagaattttcaatttatttcacagacaagatagctcgatccaagccagcatcgctgctccccaggaaggctctcagaggaagctaaggaaggaggactgagagtcctttgctggggccctgccctcccattctttagggcacctctgtctaggatcccagttctttcactgcagggggatctgtactgcacctttacaagaaagggggccaaggcgtgaaatgaggggataaggacagcccttctcaagtttccgctgagatttagagtacagccttcaaaggagggggttcatttctgttctttgggtttgctttgcatttgtcttaaatttctgtataatttatgataccagaagtcagttgcgtttgcctcccagcattccctctcccttccccacattgttctttgaggaatccatgtccttgtctagtcttggtccatttggttcagggagggtataaaacgtctcagttgtcactgacagcacattatccccaagactgcagggactagctaagagatgaccactttaaacaggtcagacaagtgaaaactgtgaacctgcaactctcgctggtgcaatcaggtgagaggtaccgtctttggattgggttgataaactggctaaatagaagttggggatgcctgtggccattcttgctttcctatgtgttggcttcattctcaggccaacttcccatatggtagccaggaaaacagacggagagagaggaagagagggaagtaatttggtgatacttttgagtggttctgaattcatctatgcctcaactgtacctctggacttctcaattaaattaattcaaaaactccctttatttttacccataaagttaagtgattaagtcagagcagagaatgaaaggacccctcctggattgaaaactatgggtctccaggagactcccctgtctcacagggtctagacatgcaccttggtttaataagttgatttcaggtgcatttttccatcagggtaataatgttctccacaactaagacactaatttctgatgtgctctgtttggcatttgtaaagtcactgtgtctactttgctttgagtcctggaataggctgatacactggcattttccttaaacaaatttacagtctctagcttggtaccttactttcttttcatgctataaatctgcataactcgcatgagctcatgccattcagatacattccttccttattgtccttgtttttctccattttgagtaactgcattcattaatgttttttcccttattcccatcatcctctcttccaatacatgcccttgactataccagtctatttaataggcctaaactcatttttttcattttccacatctcttcttaccatataatgaacatgaatgtaaccattatctctatatctccagtgaacattttactcaaggccaagtactttgctatatcatttctttaatcctcccagacaccccatgagataagtgtgactttggctcaattattcaacttttcttgtcctcactttcctcatcggtaaaatggacataataaatatcagaggtgaaactagaaactggttgatatttacgtaaacctgtgttctaacaaaatagacagactcttctacatgtgtgccaattctaagtcacacagccttcaagcaagctagttagtttcagatctctgatgacatggttcaccaatgactgatacagtctgccttgagggccacactcagctctctgagaatgcctttgcaggaaacacccagaagagacagagaatgaagggaaacaagaagtctagagaaagcagacagtcaaagcaagacacatccatacataagtataagaagtttcacagaatggacccctcttctttccaaatttcccctcaaataatgatgtagaaaatacaacacttttagaaaaaaacatggaaagtgtgagaaataaaagtgcacagatgatgtggtaactaggaaaaaaaggtgactctaaatctgtaccctcttccatacttgaaaagattaaaatctggatttcatgaaaaaccagtaagatttagaggaggtacaactgcaaatgttcctatctaaaggctttggatagggatctgctttccctctgggttcttgacaatgttgtgataagaaataatctattctttctcccaccaaaatgcagtgcagataataatttgtagagtatgatgggaagctgaggtggggagtgaggttagatgcaaatctgaggagttacctgctgcccacccttcacctccacttcactaggaaatggggttcaacagggctttccatgagagctctgctcttcattacttgcacacagagaaaattatacaggggagccttctgccaagtgaaaaagtggcagctgaaaagaaggtgtgtgctaggaggtgggccatgccataatttggggttgtttttaataagactattatagaagtttctcaagtcatcctggaagactaaagatcatggggctagattatgggtttagtaaacagaaaatctccaagtactggaagggaaacagccaatatttacttagtggccgagaggaatcttatttttaatctatttacctggaagaactgataaatcaaaatcatttcgtttctaaaagtgcaactaggccaaggctgatcattttaactgaatggacaaagaaggataacaacaacataattatccccactacagagacaggagagtcttttaaagttaaaaggaggaaagggaagaaaaaagaagactaaaggggaaaagagaaagagaatcacacaaatacacacacagatatacacacacacacacacacacacacacacacacacacacacacacacactcaaatgctccagaaggtagtggagatgaggaggaggtgaaccccacagggcagtagagttgctcgggagctaatgttactcattacaaacacaaattagatcatcaaaggattagtcatttgtataaaagttgaacctgttaaaaaagatatgcatgtcatgtcatttgcttctcacggcattcttgtgacaagtatgatattgttcagcaacttgcttttttttccacttgatatcacggacaattttttgtgttggtatacatagattaatctaattcattgtaaactccacagagtattccacactgtaaataatttagccgttccctgctgatatggtttggctgtgctcccacccaaatctcattttgaactgcagttcccataatccccacttgccatgggaaggacccagtgggaggtaactgaatcatgggggcagttacctccatgttgttcccacgatagtgagttctcacaagatctgatggttttatatggggctttccctgcttcactctacacttctccttgctgccaccatgtgaagaaggacaggtttgcttccccttccgccatgattgtaagtttcctgaggcctccctagccatgctgaactgtaagtcaattaaaccccctttataaattacccagtcttgggtatgtctttattagcagtgtgagaacagactaatacacctaccatgaatgctcttgcatgtgcttttggtgaagctgtagttaggatcaccagtttatgggtcagaaatggaggcttagaaagttgaagactccacaaacggttgaagctgaaaacgtctccttttccaggggactcacctgctccaggtcatcagttgaccttttgttttctccagctggatcctgatagggtaggacaaagagttcagcagtggtgggtaagccagggagcaccgccaccaggatgtgctggcctggaacccctgtggcctgagggacagacacaggggctcacattagtgctgcagagaagaaagctgagaagggaccaagtatttggtggggggatcaggggtaggcagaagacaccacaaggggcctgaaagcagaggcctgggcatatcaggcagggagtatgtgagagacagcactgggctattaggtccaggctccggagtcaggctgtctgtgatttaatcccagcttcaacaccgtgagaccttaagctcattgcttgtgttctctatgcctacattcctttaaatagaagacaggacagttgcagtacttgccttgttcatggctgattttgaggattaaatgagttacacatgaagtatttacagtagggcctggggattcaaatgttagctctttttgctagagagcatctccaaggtggtgaccatgccagtgagaagaccttcactttatcatctgcccctcatgccttagccctttctaacctagcttcctccttcgtcagcccactggagttactcttcaaatagacccaccacatcctaaccacctaacctaagaggacatccccatatcacaaccctcaggaggcccctgttgacttttctgcagcatcagacctgatgaccagccctgttccctgaagcaccctgagccctccacttggccacactgactcttctgttaaaattacagatatcactcaaggacttcttgtttatcctagctcactgttctctctcttgagcttataccccagggtttcccctgaatcctctctctagatgcttctagaatcaatagctataatcccagcttctctctccagcagtccaattctgatcatgttccttgtccaaaatgcttgcaagaattcccaatgctaacaggattaaggacatattcaaggccttctgcaatatggtcccatgcttcctttccaaactaattacccacaactcttacgcttttgccaaatgggatgatgtacaatttctcaatatttcagctttttcctgcaaatgttcctgtgcatgttatctccaccagaatgtcttttctctgcctttgctatttatccttcatgagtcatcttaaagcttatttatttcattatttcccaattaggtgattatttgtttttgaactccactgtgctgcatttttttttgaagtagcaagaaattccaggtattaggtcctcacctaatgttataagttacttagcacaatcccaggtacttcctgggtgtattgtgctaagtaacttatattatttgatgtgacctccaacaacgttactattataagtaacttataatattattttaggcaacctccaacaacaaccctttgaagcaaatatgattacacctcactctgcagtgagaacatatcatatgctggggtcctcaggaagctgactctgagtttagcatgcaggatgtttactaagaagtgctcttgggaacaacacctatgggagcaaagggaaggaaacaaacatggacaagggaaaacttgagctgccatgtaggcccatgacaacttcaagagaccccgaggggagacagaatggcccttcagagttgtcttaaattgggctgagatggccaggactttacataactgcaccagcctgtcatcagacatgagccaccctaagaagtgacacgacttggaacccagctggtgaagactctgcccatagccctcccagaaaagacaataagtgtctccctgaacagagatctgggtggtgcatctcaatttccactccaggaaagatggtggctgtaggaagattagacagtggctcaaggccatctaggaagtgactgctgatgcttttgaagcctggtctgactgtgaagtctgtgttgggacccagtgctctgtacctcccttctccagacactgacaaacaacagctcctattacagcaaaccccacactgttttatgcccttactagactgtaaactcagagattgtgcctgaataatcttcattgtacacaaaaatgtttataatgacattcaattaaagatttcattgtgaaatgtcaatagcaaaagccattttgaggaagaaaaggcaaacaatttaatactaaattttgtttcataatgaatagcaagaaaactgcaaataagctgactctcagttgtacctctcatagggtttattagtgtacacttgccaatgtggtcccttgggacttaaaaaagtggccaagtgcaattactgatctcaaagtcagtgcaaattgctaggaaccaagctctgcatcaactgcttcttgggattgggtgactagggagccttgaaaactagaaggtattaataccaccaccaccactgctataaccctgccctgagggataatgagtcaatctgtttattctgcatattcctgattatgctacacagcaggctagaaatcctgatgagcagtaatttctagcctaatggacagctggtagaaaggtggaggtacagggcatctgatctctaagtaataagtgtgaagagaaatcagcctggaaggctggacattgctgagctagtgcttggttgatacatcacctgggggagttggacagatagaggacctatggggacacaggtccctagaatgctgcagatgagaagagatggacagtgggttcgttaaagagcataagtcatccttcttggacagcagaggacaaaaaccagttgttaccctagagacggatggctcagagtagaaaggcctattccttttagggttgtagtctggtagtcgtgcctcctggtggtgataatgtgtaaccaccaatcatgtcacagatgctgaaagccatagagacagaggtgggtggcattgctcagaggcacatgaagataccccttctttaccccagtattccatctatccctgtttctccttggaataaggaagaggatggccctagagtggagtggttaggaaaccacaaaaatcaagattcaaaccttgatggtttgactccagaatctgatctttaagtgcatgaccttggatgagtaacctaatatctctgagtttcatttcttcacctacagaatgggtagttctgaaatcacggtttcaacatcgtaagcttatttgggggattaaatgtgttaaaataatgcaaagcactcaaaagagtatctagaatattttaagtgctaaccaaatattaacaaaggtaatgaagacagggaagaccagctccttgcaagaggctggatgtaagatctgttttctgatcaggagttatctgaatgcctttatttcatcatctttttgtgtcctgtggcaccatgtgttggaagcaggaaagaatgttcagcaaacctaaactgattttcattctgagctaagaatatgccctgggagtggataactcacttctgattttccgcgtttgcacaataagctcaagctgccccatgagcggctatcccactcctctgctcactcatgaaagtagaataaggggccgacgcagtggctcacgcctgtaatcccaacactttgggaggccggggcagttgaatcacttgaggtcaggagttcgagaccagcctggccaacatggtgacacccgtctctacttaaaatacgaaaaaaatagctgggcgtggtggcaagcacctgtaatcccagctacttgggaggctaaggtgggagaatcgcttgaacccggaaggcagaggtagcagtgagatgagattgagtcactgcactccagcctgggtgacagagtgagactatatctcataaaagaaaaaaaaaaagtagaacaaggaggggaagatgtgcctaaaagaaggtgtcttctctaattgccagtgacatttgctcagggaaggataaaacacaaccaccttgttattctctgagaaaccttaggaagctttgtcaaatacacaaaagcccagacattggactcaggcccttaatttcaattttgcagctccatcctctattagatatgagagtttaggcaagttacttaacctctctaaacttcagttgcctcatctacaaagtgtggataataattcctttttggggctgttacagtacagaaatttctttaaaaaaatgaggaaatagaaatatgactaaccatcatatactgaatgctcactgcactgttatgctcacagttgcggaagttggaacctgggaccactcttactaattgtagtcagccgaggacacttacatgctgagttccttcactggcaggtacagtagctggttttataattcctaatggcctaattgtgaactctgctacagaaatgtggacaaaggagtttaggatgtacttgtcctccttctctaagcagaacaagagtcacaagaggcaaggaccccatgtttgtccgtggttccatagttgcatcccctttagggcctttgaggtctctgcatgtgtggggctcagctttgcagacatcaggccagaacttcccatgggctctagcttcttcctgctgggttagtttgtttgtttttgtacaaagctcccctttctgtgaaattcttcaaggacagagagaaaaggtacccgggcaagagaagaaactgtgtgcactcacttccaccagggattttttgatgactcgaccgatgtccctcctccactcagggatgtccgggttgtagtcatccaggtttggagaaaaggacaagcgaagagaccggaattcctctggggatataacagtagatggagtactataagtcaaatagtcctgtcaagaggtttgttagactttatattttatacaaaatggagggtccttccccttcacttaccatagggacctttttagaaggcaagccactaccctgtgaatatctcaccagccccttcttttctttttttgtttgttttaaggagcggagagtttaataggcaagaaagaaggtagaagaaagaaggaagaagctcccctgtatagagacagagggagggggctacaaagctgagagaggagaccacccccccagactacccctggccccccttccccccttctcctttcctctgtctccccctttcccccttttctccccctcccgcccccacccccgcagcgtgaccgataccatccagttatatgaggaggcagtgtctgatttgcatagggcttagggattggtttgaccaggcatgtcattcatgatatagacagggaaaaaactggccctctcaccctagccttttagtatgcaaatgcagggtgccatgttgttctacacacagagggatacgtgggggcagccatgttgccagtcacatgtgagggcaagggcaagaacagggcagggaattgccatgtttggttggacccagtttctaatggccagcatttgcataccaaaggttgccagcaggctctaagagcccgtagccccttattttctaaaccaaacccctaactttgttccatgcctatctttgcagcctttgcctattattcctagttctaggttctgcgctcctggatagtaaatgatctggagcaacctgaatgcatggtaggtttatgaccctgggcctctttgcacacaccgttcttctgcctagaacgccccattctccccactgtccatgcacaaaatattcaagctctagttgaagcactccctggctcactaccctcccccggctcactaccctcccccatcacattttaattttcttttttatggcactactctgttttgtacatactttttattattattataggattatggaataattattatgattagatatttataattatcactgtaatcattctattgctatcgtttgtttgcatggaagtttcatttaatggaattttatgttattcagggattttcttcattgtctctgtagcacctgagttagtttggttctccaggaagcaagatggtgattacacaggcaaggattatatgaggggaattctctgtgcgagaaagtgggcaggaagccacaggagtcatggagaactatcgaccaccgtgcatgcatataggacagtcaaagagaggaagaaagagtgggtgactactctgcagtctgaggaaggttcagtaagcctgttcaggagtcttggagccaaagtcgctggcagaggagtcccctgcgttccaggaatggttcagccttagtatccctgctatactctgtcattggcagggtaagtccctggaaggtggagccctagccctagcttggtgataagcttcagagcacagcactggtggccttggtcagttacactctctggagttggaggtctgtgaagcccattcttgtggcttcaacactccttacccagcatagtgtttggcacataatagactcagatcatatggctcccctaaaacctgccagtgcctccacattgcatttagtataaaatttagattcttaccacagccttcctggccctacataacctggtggggacttcctttgtcctgtcctacctggctttcctgccctctctgtgctccaggacctgtacttccctgtgctcctcaatcctgctggctctgtccataccagctctctccacttcactggactgtagcaaactcccctctcatcattcagtctcaccccgagaggcctttccaaccacccaacctcaggtagcctcccttccaccatcccatgcacccttcatcactggaccctttgtctctttttcacactcagcgctatttaaattattttgttttcattgatatgtccttcaaactggaatataacctcaatcaggatgatggctctgtgttcctggcccttgtctagcacacagtaggttttcagttactatctatgagtcatttataattaataaacatttgttgaataaatgtatgcttaacttatggtgtagccttctcgaaatttatgcatttatttatttaataaacattttttatgttaagcatgcccttttgtttcattagggtccaagcgacattggggatgccaatttacattcaggaagcacaaaagttcacttgtacatttcctaacaatgctaaggagttatcaaacacatgtttcgaagactctgactttataaggtatgttttcgtggcagttaatatattccaaagaggtattgttcaaagcttgactattttatgagtcactggtcacctatgtgaatattacctgatggggaacaatgaaatgcacgttaactaaatagtgtggtaaacagcagtgccaaagaatcacccattaagtcctcacttcttgctatgaagatttaagtttatgtcattctcactttctccgtacctcttaccaaactgcagagacttcatccacaagggagaatgtttatcttagtaaaaggacacaaatgagaaaatgatgcagctccctccgtaattacttagcatactaaccagcatggcagggaggcagaatggcagggaaacgtacttaagttgattcaagaaataggggatgcgtgtgggcggactgaaaagggtaaacaccaataatataatattttttgcagctgttgagagagataaagtctatacacttgcgtatttttatttacaagcaaacttgtgccctggagcaaattagaagaaacaatgcaaactagattttctttcttttaattgattgtgtggctttgagtagacaaaccttcccctgtcaatttcccaaatgtgatgcttttttcagtcccatcatgacaataggacttcatgttcccatcaatctcactaaatttcaaacaagtttctgtttcttcctgactgtaagctcctggacttgcttttcttagagtattctggaaaacttacaattgtaaattccttctctgtcccttgagatgtaaaacttctacaactcatgaatgtctttctcaaggacctgggagccattcctttgaaatgtaatcatcaagaaagatagcacccctccctatctcccagtctctgcgggagagtaggagactgacttccctaagcagtgattaactcacacagatggtctaatcacactggaaacccacgtgcttcctaaagttctccagtattttcccactagctaaccccagcgtttacaaatcttcctgctttttctttcagctgggttcaatctttcctgtttaactttgcctgctccaacttttgtttaaggagtcacacctgtcattaaaactgtctgatcatggaaccaggtgtggttactcatgcctgtaatctcagtactttgggaggctgaggagggaggatcgcttgaggccaggagtctgagaccagcctgggcaacatagggagaccccataactttccgattatgtatatgaatctctggataactcaactgaccaaagacaaattaagggtggccgatggtgcaggaatttggttagaagaggaggagaaccttgccaaatctcttaacgaagagacatatgataacctatttttataaagagtgattcacccttgggtgatacctgtaaagaaattgtagaaagaggaagaagcaagcatagcaaggcatgggaggtgcttacaaacataccctctggattcagaattcttagctcgtttattatacttgtctcatgttttctcatccgtaaaatgcataattatagaatatttctcataaatctgagcagatttaataaagcagatcaaaccaaatgcttagaacagatgccagtggctagcaaagtcttcatcaatgtcaattactatcaccaccaccatcgttatgatcatatttgtcaccaatcagcagaatgactttaagccagtaattccctatgtctgggccataatttcctatctataaaatgatgggctggaccagataaggccaagatttaaggttttcttcatgattctaatgacatcaccaacatgcataaccaagaggacatctgttgggctaataggtcagtgcccattagtgcaacctgtgacatccaagagggagagaaaggaaaaaaaaatccagtgaaaataaatgagaatcagttaagtaggatagtttcagtgcatgggccctgagtctagatgggttgggttgcaaacccagctgcaccacttgctagctggggcaagttattcatcactctgaaaaaaatggggatcataatatcacctgctttacactagggttgttatgaagaataaatgcattcccagcacccagaaaggagatggagaagggaagagaggcagactttgccgcactctatacacagccactgtttggccacctcgtaccttgctaatgggacattggtaggaaaatcacagccctggtttatttcttattatctgggctgatcaagcctttcaggaggaagggagagagaagaaattataaaatctaacacccagccatgaaaggaatagtgtccttaaggccttttgatccttagatgtgttcaaagttgcttacaaattattttctgattttgaaggtcaagttggcaagatgagcattaacagaacctgactcctcacaggaaaatccagccccaaattatctcatcaaaatcaactgataagggaactgggcaattgacattatttggaccacgagctaggctgtctgtctctctcttgctctttcttttttttttttttctttcgagatggagtttctctcttgttgcccaggcaagagtgcaatggcgcgatcttggttcagtgcagcctctgcctcctgggttcaagcgattctcctgcctcagcctcctgagtagctgggattacaggcatgttccaccatgcctggctaaattttatatttttagtagagatggggtttcaccatgttggtcaggctggtctcgaactcctgacctcaggtgacccacccgcctcggcctcccagtgctgcgattacagaagtgagccgccgcacccagcctctcttgctctctttctcatcctccttccttcctccctccttctgcctcctcctctctctgcacagcatttccttctcctatctaatttccacttcttatatttcaaaagctaatttttcaggattcatatgtaccatttccatattaataataaacatttttgccatgtactagtaacacttagtgcatatccatatgactatctttctatgcagaaaaagatttaccaaaatgaaatcaatccatcaagtattttttttatttccagttttcaatcaatgactccatcttttcatttcagtacacattcattccatctaatcctgtgaccatattcaatttccccaactgatcacaaaattagccatttgttcaaatatcccgtctatggctatgtacgacatctaattgttatgacccttccatcactctcaatctagcagataattttttttatgatacagatttgtggaagaggtttttaaagtatttagacaatggcagatttcccttattagtcaagaattttaaagttgaacttaaaaaaaagagattcaacattagctattttattttgtaactggtattcaaatattactaacaatctaagtgaaatgagttagccttacacatcctaaaatccactttacactatgagtgagtgaatagtcactctacctctaagaaaaccctttctggatcccgtgacgctgttttaccagtgattcaaatttccctacaggagaagatgagactcgcctcagctctttctcaactactgccctccgttctccaggtaaaagtcacagctgggggatggtctctggcatcatggcacaagagaacctcctctgagcatgaagacagcagtagatccactgagatgggcactcaccatatactgcgatggtctttgtgtcttgtaggatggcattcccagctgagacctgcactgtgatggtattcattccttctgaagtaaatctgaaggatatgcttccctccaaggtgatcaaaggctaaaataaacaagggcccagagtgaagggaaagctctttagttacaggtgacacagccactaactgtgagccaacaataggctgtctaacccagcagaggctcttcctgatgtaccacaatggcactgagtccctctatgcctccctatcatctcaagcccaaagcagaaaagaggctattggagcaatgactccaagcaagtctgcctattcattgtgaattcctgatatcatcctgattcagggctggggagatggataggtcttgcttgctggtggaatgtatgtctctctttatgcatgacctactcatatcaagcagatccctaatacaaggaaatgatcaaagcaaatgagaacgggggctcatattaatccagatggaagcagcagtcactgaaaatctataagctgccatgtgttcatctccagggtgtacgatttctgtagaattacaatggaacatgaatccggtacaccaaaaccatacactagttaaacagcagtggccttgtgtgctggcccgctttgagaagcctcatcagcagtttcctggaagtagctgctgtggaaacaagcactaattggatagtggtttgaggattcaaaacagaaaaaaaagaaaaaaaaatttggcgtggtgcctgcaatacaatcgactgctagggtcctagaggaaaaaatattagcctactgacctcccttgacacactcctcacaaacatttatttcccatcttttcttaattaatttaaaaatcaaaattcatttaattccctgtatggcagaaagaagactaacgcccagcatgagaagccttttcaatggggtctcttgagaatctggttttcttttaaaaggaaaaataaaaaaaataaaaaacaatagggggtacaaaaggaagttgttcagtacattcaccttttagtactagttttcagggaaatgacatagattcctgctcttccgctatggatagagggcccactatgggctgagttcacacacatagtttcaggtgaaattaaaaagggtctcttttcagtttagttatggttgcagtagaggtgagaggttctttccactgtttaggtttgtcctgggcctgtgcaaaattatatctccagctaaagccaagtttcagctccagagcagaaaaatgtttttattaaaataagagacatcgtatttgaagagcaaagtcaccaagtgaaagcagctctgatggaagaagatggagtgtttcagtccagagcagttcatcccagtgtcctttggggcctcagctctattgcctaacttacatttggaagcactttaatttctgagaatggaatgagttcaaaactgaaatagaccatgcagcctggtgtagaggaaagaaacattagtggaggcatcagaaggccttaaatttggcctcttatgaagcagctggaagagatcaaagcaaaccactccagctgcaccaccctcacttttctcatgtgcaaaatgaaagacttagagtaaacaaggtgttaggtctctactagatttaaaattgccactgacttttgagcatagggaatatttggaaaaacatataaaagttaaagctgacctaaataaataagagttttgatttagggtaagaaggccattgggggtgggttgtaatggaaatctattgcttgcgcctgtccagttgcatccagttgcttcgttttcttttggtaatcacttctccccttctgtagttcacgtggttccgaggagactgacttcttcacctccctctctacccccagcactgtgatcaaggcctggccagtaagactcaatttcaggactgttgttagaactttcaggaaatagagtttaatttctctgctaagctagggctgctaagagtcactacaaagacaagtacagctggagaaaaacgtaaacatagaggaaggcagagatgaaatgcagaaggtggagaggggccagagagagagagagagagaacataatgatgagatacttgagcaccaagggagcttgttgtccttgaagctacaactgcttctacactctagggttcataagccatttcattccctcctttgcttcaggcagcgtgaattgagcttctgtccctagatcgcatgtggaaggtgaacccacctccgtgttgtttccgtaccaccacacgtaagtgagggtgcccacttggctgggccacagcactgccgtcgcattgacctctttgttctttgtggtgacaaagggaagagacaggtgcacgtgctccaagggacctgaggcacaagagaaagagaggccatggatggggaagagcttcctctgctctgtcctccctgctctgaagagatcacacatttactcttgaagcccccaaaacctggctgccatattccccaaaagaagtgttcagatgctttccccactttggagaaagaatacattgagcacaattgcatcttgacattttgcacttaccaatctttctaccagttctaacacctgagttaggtgtgtgtaaaagttaaaaaaaaattacaggtaacttatgaagtccttaagaacaggcatcatttgggatttcacaaggcaatgcagtctttccaagaggttgtatccctggtggtgaaccagagtcatgaagacctcatagaatccatattgatgaagggtgaatggacaaatcttcaaaccactctctatgtcattaccctttattatttattgggttttaaaggtctgtgtatgtgtgaatgtgttcgtgcatgtgtctgcaaagctgtctagttaggtaagcatggcacacacactgtgtttggggttgaattaagttaattcaggacagaggtgtgtgtgtaagtagatagagagctctgtggttctcagaagatgctcacctaaaatatagaatgattttatctacagaggcctataaaaactggaaaccttaattagatgtaccaacctcacaaagatatgaatgccctcttcataaagaaccactaggacctttccttcaaccctcaatcttctctttgagtcactgtttccaggcaaaatgcagcttcctatgcatttgccatccccatctttgtcccatgaggtagaggagagagcaataccttgggtctattcacctggtttattacctcctcttctgcttgccctgtaaatgtgtttcccagagtcctgtgttgagactttttcactctctacagacttttctactaggcaacaccatccacaccttaaccttcaaatatcaaatgcatgtgaagggctctaacacccctttctgggctctagactccttctgggggggtctagacttctttgcctccagcaatcaaatgttctcaaggaccctgttatttccctctcctgtattctctacagtttggtgattaacactcatattcatccaggagcccactccagaaacagaaagtcaatttcaatttcttttttgttattcacatccatttaggaaactgacgatttggtttcataaatctctctaagatatttagctcaccctccctaatctggcgccctggttcatactctaagcacgttctcacttatcttccagattttcctgcctgtaacctttcaccacccgaatccatcctccaaatggctgcaacagtaatttttctagaaagcgaagctgatcatgttactcatacttgttcaaaattaagattcccgtgattgggaatgtgatgtggtgtggtggctcatgcctgtaatcccgacacttttggaggccgagttgggtggatcatgaggtcaagagatcgaaaccatcctggccaacatggtgaaaccccatctctactataaatgcaaaaattagctgggcatggtggcatgcacctgtagtcccagctactcaggaggctgaggcaggagaattgcttgaatccgggaagcagaggttacggtgagccaagatcacaccactgcactccagcctggtgacagagcaagattccatctcgaaaaaaaaaaaaaaaaaaaaaaaagattcccatgatccaattatgataataatgatagctaacacacattgatttaaaatttgtgagacagaagacagaggctgaaaacttcttgagggtaagaattcttcatatttatcttcatacacaaagactagcagagtttctaagacattatagatgctcaagtattcactgggtaaaacaaatgatataacttcccatgtccgtctttgtgcatgctactccctctttagagaatgaaaagtctggtgatcagcatacagaatcaaactgatcttctggcctataaagcatatgttgagaagcagttgattataagccagagcagttcaatgaaataataaaagggtaacatttactgagcgatgactacaactaaatgttctgctaacgactctgtttttcttattttatcctcacaaaacaatcttatgaagtaggcactaatatcctccccgtttagagatgaacaaagtaacgtgactttccccaggtcatacagctaggaaagcagtttggtttcagagcccttgttctgagcagatggaagtgtttgaaagaacctttccagtcaaacaaaatagctattaagagttgctgcctcctcatcaggtaaatatgtcccaggcattggaaaatgcactttccacctggtttcatttattgcacaagtcttgccatttccctatcaaatggtttgttccagcaagccatgtcctggtccaccccagggcctttgcttctacacacctttcttatggcacctgtcagtcttcaaatctcagttccagcatcccctcctctgtgacattcttcctgagtccctcaatctgcgttaaatgaatacattagaatacaatgactagataaactatgctagaaatgctagttccattctaaagaggttcattttgtctctcatatgtgagctttttttttttttttttgagacagagtctcactctgtcgctcaggctggagtgcagcggcacgatctcggagcattgcaacctctgcctcccaggttcaagcaatcctcctgcctcagtctcccgagtagctagctgggactacagacacacaccaccatgcctggctaatttttgatttttagtagagacagggtttcaccatgttggccaggctggtctcgaactcctgaccttgtgatccgcccgcctcggcctcccaaagtgttgggattacaggcgtgagccaccacgcccggctgagcattttttaaaagtcataaaccagcgtaagaacaatgcctatatgtcattgtctcaatgaaaaattcgaatcttgttagtaaaacatggtaattcattcactcagtttttttatttttatttatttttttattttttgagacagagtctccctctgctgcccaggctggagtgcagtggcatgatctcagctcactgcaacctccacctctcgggttcaagcagttctcctgccccagcatcccaagtagttgggattacaggggcgtgccaccaaatctggctaattttcgacatccggctaatttttgtatttttagtaggtacggactttcaccatgttggccaggctggtctcgaactcctgacctcaagtgatccacccacctcggcccccccaaagtgctgggactacaggcgtgagtcactgcgcccaaccctcactcaatagtttttgagtcctgtgatctgttgggtattattctaggtgctggggatacctggcatttggtggagcttaggtatttctgaggaaggagggtgctgaatgcataaagcagaagtcggtgacagagtgctatttttgaaagtgtgatgatggaagacctctcagaagaaatggcatttgagcagcaacctgaataaagtgaaagacagcaccaagtatcaattttgaaagctccagggtgagggtagagtaagtgaaaagaccacgaggaagagggatgcctgccatgtttgagaaattgtcttattattttttcatttattttcacataatcacgttttggtcaatgacgattttttttttttttttttttttttttttttttgagacggagtttcgctctgtcacccagactggagtgcagtggcacgatcttggcttgttgcaacctctgcctcctgggttcaagtgatacccctgcttcatcctcatgagtagctgggattacaggcgcctgctatcatgcccagctaatttctgtatttttagtagagacagggtttcaccatgttggccaggctggtctcgaatttccaatctcaggtgatctgcctgactcagcctcccaaagtgctgggattacaggcatgagccaccatgccgggccaatgatgaattttctaagagaaattcaagacacatagtacgttggccttgtaggccctgaaatacatatgtgtttgtataagttcacgcatacatgcatatacattatatatgcatacacatattaaatttatctttcagatttccacagcctcttttattcatttacttttcacgggtttaaaatacctggttcctgctatccaaaagcctattctttgaccatctctgttaatcacagagggtgcagtatgccctatggagccacagaggtgaaactccagaccctggaggcccccagctggctggctgcgttaagtaggatgctgaactggcagatgcggctccatcagacaggtgcctgcaatgcacaaaagggacagtaggtggcgctgcatcattccatatgaatcttcctggaaaggtggttgagagaaatggggaattgtgtgaactgggtttcccctctcttttcttgtttatagccctcctgtgctgcaggaaacaactgacgcccgtgaggctgcacattgtgtgattctgtgtgtgtgtgtgtgtgtgtgtgtgtgtgtgtgtgtgtgtgtgtgtacactggctgctctggcctgcctgcagcatttatgatgtggagacctttggccacctaaatattgtgcacatatcatattgctatttgtctgcaatgtttaaaaaagctactagaagaaataagaatgattcaaactattaagctgagatcctaaaacagagtttctcaaatttcactgtacgttaaaatcatactaatctcttcaaagcagattatgatgccatacttccaggaatcctaattcagtgggtctgggataagacccagaacaccacatttttatcatttaatttgggggcaggtggctcattaagccacactttacaaaattctagtctgacgtttgctggtcaataaaatgatggtgtgaatggtcgaaaaactacgtgggttttcaagctacacagatcattttactctaagatggggccagaaagtcatctgcacatggctcctatataagggaacagataagggaagcagtttaggaaggactacaagatccaccttatcttttttttgtccccaatttctgttctgcaagtttgcagtcttcagtgatttttttttttctgcaagactggctgcgacaaggcagctttctgagcagaaatctgcatgctctctaaaacctctgccccatccgactgaaggcaacactggctgcagcacgtgtctcattagtttgcaaactagcagagcacagtgaatactatccccaaggaattaccaactgtcaggctacaggagattaccaggcgcccagcaagaccggcccactcccagaaacactatgcaggaacatcggctccatttgtttcagatgacctttgcaaacccatctttttttttcaaaccctctggtttggaatcaaatcacttttctgcactggagagtggtcggaatgtgtatgtgagacaggcaatgggctttcaagattgcccctgagggtaggaactggggaggggcagaggacaggcttggtgagctaagagttgctgctaattctcctcttcctcatgatagaaaaatcaagttttactaggtgccagggtaccatatattttgcttgatgggacttttgggaacgagatgtgcatctacttgacagaggagaaaatcaaggctcagagagatggagtgacttccccaggagtttgaaccaaaatctggacctagtcagaatgcccgactcagtccagtgcttttctttcccctataaagccacctctcactgccatatcatggcactttggcatccacagtcactcatgacaccctccatctttaagatgcctgagagtgtgactcggttatgttcttgttctgacttgctttgagcataaagtgatgccagagtcacagtgcttctccaatccttgatttctccatctgaaagaaaaggccagaagtctgttatggtatagatgtgaagatgagcaaaaagagtttgtgggcatagcaaagcaccctggatctttaggagggaggcactaaccaaacatgtcagaatctgctgaaacagttatatgagtttatatgtatgtgagttagcaaacagcttcaaacatgaacttgcttttaacacagttagtaccaaaaagccaggcttagaaagaagttccattatatgaggcatgcttatccaaccacttaacccaagatgagtctacaaaattaaaatcagaacacgaaacattccattacaaattatcttcctctaaggttaaggtcaaatatttggtccaatcaactaggctaatgaaatgaaagaattgcaaatgaatgaagaaactggtttcttttagaagggtttccgcagcccttaatcttaagcagagacaatctctgtgtgtgttgttttcctctccaggatttcgttaactagggaggagttttgcaggggagcagtagacacctcaaggggtatgatcacacacacaggaatgagaaaaaaacctacagagtgacaaggaggtgaagctatggaagatttaatgggagaccctgaaaaatttagatcagaagctgatactggcttttaaatcagtatttacatgtgattggactacggtagatgtataacaaatttgtggtatatggaacacaattataatttgtaaggaagctagctctctagcaaaatcaccccttatagaataagctatgagataataatatggtctaggtaggagccattcttggcaaatgtgctgtcatttttattgcaagttatttttgctactaatcattaatgtttgtgacgtattgttaaagattttagtatgatcatttctatgataccattgctatcatttccctacatactaacatatagggaggtgttatgtcttagtaagtggaaagtcctgaaagtctatataggacgagttagggatggcagttagatggacaggagcccccgtgatgagtactgaactatgtagttgtgtaacaagcacactgcttctaaccaaaatgtttatgtttcttcaagatgatctgtaaagagtagggagtagatagtaaaagctaatggagacagctcctccaatcccaagccgctcttggcactgacactgaccttagttatcaagagctaggatccttgcggcaggtggacctgagtctgaagcatggttctgctaggtagtaggtgggccacttcaaacaagtaacttaagctctctgaacctcaacactttttgtaaatagggttactaatagtgcctacttcaagggactgttttgagaagtgagataacatatattaagagcctgtttagcacaaagtctggaacacactgtaaactatagccaaaaataggcagattgagttggcatactgagaatcatgtgtaactttgtcagacccaaataaaggagtgcatgtttctttgaagcacctctgccatgagagtacaggagacagagatcagaattactgacatgttaggaagactcaacaaccaaaacacctttttgtcatcccctaatagtcttgccctctcactggaccacagcagctaaaaaagaaaatgttctaattgatactttctgtattcaattttgttccatgggcaaggtgcagaggagaggcatggagtaataatggctggccttgaggctcttggactaaaacttgatatttgaacaagaccattcatataaaggagctgctttcatttaaaggaaacaatttctttagtaaccaacacaagtcctatgactgggaaaccccttacacctaacatgttaatgacacatgttttaagcacacataacttagaagttattattgtctcatcatacttactcacatctttagaatccccaatgagggaaaagctttagcatttcttggaactgtttcctaccacagtttccttaacactgtttttatactctttctctctacaccaccttctctctaacaccaagtcatccacagatagaagcccaggaaaaaggagcaaaaccctaaaaggattattaatagcaacatattatgagaagacagaaataatcagatggggagaaatttctttacttgggctaattctcaatgcattagattgagtggtgcatgtggattgttttcaacaatttctgaccccagcaaaaccaaatttctttgtttcaaccaaatagctctgcaagttacttaggctcagcctccagattcaagtgtcatatcttcaaggcacccggggtaagcagaggaaatgcaatgagaatttgaagcaatccagagagtccaggattaatcaaattctactctttgattttcttctcactctttccttattttggtctcttaatcatttcttccccattccccttctgctaaaagataactagtgtacttcttctagatataaaattgtgaattcaatttgaaaaggacacaatatttaagataggtcataaaccaacaacagtaataacatacaagttacatgtaagtacaggacggcgctgtcagaacccagactgttgtccacctgcacggtcacacggaaaatgcccacgttctgatagacgtgtttgatcccatcttccatggagctgagattgacgtaagacaccgcgataccatcgccaaagtccacttggatgagtgtccgctgaacatcaccctgaaaaacaacccaacatcagaggaaatgagttagtattcggctgctcctgcctaggggactggggactacggcttgtcctagtccctggctcaggcatgatggcagccctggctcactcctacagctaggagcatctgcctgcctttgacagaatccctgtgacattccctggcaggcaagagtttgctacgatggatacactccaaatctgaaggacaccaactactgtaagtttcaggggtttgaaaattaatagtgcttgattatcagctgcaatgtgatattcaattcctccaaaggctttggtaatagtcttagcatccacaaggataaaaggtgtacacacacaactttaaaaatttagcttacctgggtcaggcacagtggctcatgcctgtaatcccagcactttgggaggctgaggcaggcagatcacaaggtcaagagatcaagaccatcctggccaacatggtgaaaccccgtctctactaaaaatacaaaaattagctgggcgtggtggcgcacgcctatagtcccagctactcgggggggctgaggcgggagaattgcttgaatctggcaggcagaggttgcagtgtgccaagatcatgccactgcactccagcctgatgatggagtgagactccgtctcagaaacaaagaaacaaacaaacaaaaacccaaaaattttagcctacctgactgacatggtaatggaccactccacttcctgtgtcttcaagaccacccctcaacctgaatacccctcgttatttcttgttccctaattgtatcataggaaggacggaagacactttgcctgatatctgataggacactgtacgcagccctattattatctgagataataatggttaattcttttatgctttagcatttcaagctatcaaaatgatctcatgttattcttcacagattcttagtctagtctggagagaggagtaggcaatcttctcccactttacagaggaagaagatgaagtcaaaaaagatgtcatcacttgttcaaggttaacacagctagtaagtggcggtcctggtattctaactcacctttctgcacttccaggtcattcattatagagagaatatagcactgtaggtaatcaaggctcccctggcatgaattctcatgtgccattaacaagctggaagacttcatgcaagtcattcagtctcctgcagtctcagtgacaaatctatgaactgggtataataataccttcctgtcttaaagagttgtaaaaactatgcagtaaattaattacagattaattagtcatctgtaaaacgctacataaaaatgactataaatcaatgtagctataaaagacctacaattgtccctttaaagcttaattgaaattgtaggattccaaatttcccatgggtaggcagaagaagatacattctgcattataaaatcccagacctgtaaaaaaaaaaaagaaatggcctttggaacaacagtttagattcttaaggaaaaaaagttgctcagaccccattgacaaaaaccagcttccttcacacacagtccatcctttaacaaattttgttgttgttgttagcctttcccactttcaggaaagaaaaaaacaaaaacctttgaactagaaatgtattttcgattaagtaaggttcatatggtatcatattttttgaaaaggccaagtttaaaatgttgacatttaaaagattaattcacagggaaaaagaaaagcagttcaaatcctatgaatctgtgtgacctactcctctgctctatgcccagccaagcattgtgtgtggggctcacagcagcagactcaataagtacataggcacaaattctcccctagggtaaacagagaaattccattcaaaactacaaaataaatatccaaagcccagacattgtgcacttacttgaattcccttcactaataaatataaatgtcaactattcttgctgacgtgtccttcatttaaacaaccaaagtggactgatcaacttctcattctgtttccagttagtttccacccctagttttcaacagagttgctgggaagccagccctaggtgtgggcaaggggaaagagcccacttttgaagcaagtatctgagggaaatagcaagggtatctggggttatccatggaataaaacaaggaatgcagtttccactagagaggggggaggacatgacggaagagggagacagacaagtttaaagtactttgtggtgacagagtgagcatcaggcaggggccatcatttgctaaaggacagaggggagattcacaccttcagtcaactctacttcagcctccattgagagacagcagacactcacacagctgggaagaatacaactttggctgccattgcttgagtctaccttgccttgccctttctgtctggtcttcatcacttccattttgttgtcctggatcaagaccagttacataaaaaccctccaatttctatctctcttgatgtctactgtctgtcttgctgggttttgtttcatgataggattcttcattgtccattcatggaatgctctctgtgtatataatgggtgaaaggatggagctactcaatgtttggactagggcattagtaaggtttccatttcagagtcaggttattagggtgttaggtcaggtattttatatataattatataacagatcatactttacatgatagaatcaggtattaggtttaacatgcacctgacagcccctgaagacaaagacatggaatactccaatcaaatgtgaagtccccaggacctcctgatattgggataggcctcttggcttggactctgcactaggagataagaatgtcaaggggccatgtatgacagcagaaggcagctgattatattcctgctgtcgctttccactaaaggtgaacaaactggattccatgccttttccttcaggagctctcaggtaagtggtaaggctacggccactgtaacagcttcacgctggggctcatctgtcatcagattccggtgttcctgggctcaaatgaccactggaagcaaggatgtcagccactttcagagaataagaaaccgagcaaagggaaggcagcccaagtcctaataactattgagtagacatactcaccctaccggcgctctggtcattcactcattcacccaacagtcagatatttattgactgtctatctcatgtcagtcaccaaatgggaaaatgttattaagcaagcaatagccaaacaaacaaaataaatatggcctgggctttcatgagcttacagaccactagtgaaacacatgcactttaattaactaatcatgcaaaaaaaattattgcagggtgacatgaaggaaaggtacatggagttgtaagcttttgtaatatgcaggactggagagccgatctgattgggaacttcaaagaaggcttccaaaaggaagtgatatctgagctcagaagacctgaaagaagaaggtaaattaaccaaatggaggagatgaatgagtgaggcacaagtgagagagtgcaggccaggggaacagagggaacagatgtgcaaaggccctgtggtagagggagatagtacggttgaagaaattaaaaaagaaggaggaaaaagagagagagaacaagaacatgttaccaaatgaggttaaagcagagaaaaataccttctgggacttgtgggtcaaattcctgatttttatctttctcctaagagcaatgagaagccattaaagtgttttactttttaaatgtttttaaaattttaattgataataatcacacatatttatgggggtatatgtgatatttcaatacatatatataatatgtagtgataaaatcagggtaactgtgatatctataaccttgaatcttttttatttctttgtgttggagacattcaaattcctttcctctagctattttgaaatatataataaattattgttaacgaaagttaacactgtactgtgctatagaatattcgaatttattcctcctgtctaactgtgattttggacacattaaccaatctctccctgtccagcctcttgtagctaccattctactctcctattctgtaagatcaacttaatgattcaagtgttctaagtaggggtttaagggaagatggcatgatgatatttttaattcaaaatgatcactctggctatgatatggagatgaactggaagtgtgttggaaagccaatttggaggtattctaggatagatgatagtagattaaacaaacaaacaaacaaacaaaaaatctccagcagaaaattatatgcacctttctgtcaaaattaactctcatagtttattggttttgaaatcagtgattctgggcctttgatatcaacatcttttttaggagttttatttcttaatctggatgtccaactactacccaagacccagcactgttttgaggcctctgagaggatgcccagtcctgctgcagtctgaggtctgcagccgatgctaggctgtagcaaaggctgaggccctctcattctgattgttgaatattaggtcttcttgtggtcggatacatctgaagatgaacactatagcacaagcagatgctattcttatctgattttaatatgatgaaaaagctttaccaggaagctttaggactgtaagtactaagggtgtattaataaggctgggaatggaaagactaaattcattgtggactgaagcataatcacaaacaaaagtgtcatgatacacgcagccaagattagcaaacttcgctaggaaaatgagttgctgggtggtactagggtagactgtgtcaactccggcggggctaggaagtgtcttgttaatgtatcttcagtgccttaatgcaacacctgcgaatgatcctttttagttccatataatttgaaagttgcacatttctattgtgtgtttgtcaaaatgctttcttacatattatctcatgtggatgttaggacatctaggagatagaaaggacagatgttatttatgtttgatataacagaaaaactggagcacagaggggttaagatgcataaagtcacgcagctagttagacacctgcaaaagggtttaagatgatctgtgctttgacttgacctattcagttcagttctctttgagtttctttaattgaaattactcgcaatatttctttcagaccaagaggaaggtggtaacaaagataaagcattattttcttttcttgcttgactgtattcctggctttgactctcttttcctctctaacgatgataggttggcatttactcaatactctgcttctgtctacccactagtaagacagtatcatgtttaagccgtaaagaagatagagaatatgagaaacaattggtattcataatcagtagtcaggaaagtcttgtgtataattaattgaaaaatacttcaatctaataactcaaaagaaatcatttctgaaactaaatccaggctggcaaacatctagactattataaaattcttcagatctaatgctctttagtcacatgtcctaatacagacacagaattgagaagactagttcaaaagaagtgcctgagaaaggcacaaaacccacatgaaatccacgtgatgattctattctccaagggcattgctgacgtctagaatagaaaaacaaatttatcaaatggccaccaggaagccaatattaacctgagcaatgaaaggtgtgtgaacctatcagttcctgtaacacagattcagagaacactgggacaataaatgctatggaaactcctcacggacagcctcagtccagaagtgagactccaagatgtcccttaaggcatcagagacccattgcagatagacaccaggctcgtatatcagaacctggtccatgcaagcatgacagtggccctcactcaagcttcatcaacatttttcttggaagaaagcagaaaccacattgcagaaaaatcactagtataacccatttttaataaaaaaataagcaacaaataacacagtaaatataccataaatctgtatgtgtttgtgcgagtacagagaaaggtgaagcaaaaggtaacccagactgttaatattgattaccctgggagtggagtgaagtgaggggcaggaagggatcagctggattcaaagaaaggaggagtgaatgaggggaaataaatatttctccaaatttaaaagggggtagagtactgaataacacaagaaacattacaaaatacaacactatacctctactattactataaatatttaaatatgggttaagtacattggaaataatcaatgtaacaaagactttgttttgactgatgatggaatacaaccaactgaatttgttgttatttttgtgttattttgaccacaaagtaagatttttcacacatcattaagcggcactgagtgacagaaaggaaatcagatatttcagccatttctttgtatgactaaggatatttaggcagagtagggattatgaaataaaagtagctcaccattatcctgcataccctactctagggaggtagactcaggttagcaaggtctcgacaaggagtggaaaaggaaataacagttcaacgtaccctggcgtgcagagaagagatttcatcagccagtgtagtaaatgcatggcatgcgactttgtatacaaagtgagagtgcaagtaagattgatctagttgggtgcagtggctcatgactatagtctcagcacttcacgaggctgaagtgagaggaccacttgagcccgggaagtcaaggctgtagtgagccatgattgcaccactgcactccagcctggataacagagtgaaccactctctcactaaagaaaaaaaaaatagaaaaggaaaacaattgctctacaagatcccctgggtggtcactaagggagaagacagagaacattttttgaaagtttactgtgtcagaaatagcaactactttctatatattatcttatttaaactttgtatcagtctgttttcacactgctataaagaactgcctgagactgggtaatttataaagaaaagagatttaattgactcacagctccacatggctagggaaggcctcaggaaacttacaatcatagtggaagggaaagcaggcacgtcttgtaggaggaactgtcaaatacttataagaccatcagatctctgagaactcactcactattatgaaaacagcatgggggaaaccacccctatgatccaatcacctcccaccaggtccttccctcgacactggggattatagggattacattttaagatgagatttgggtggggacacagagccaaaccatatcaatcttcaaccctaaaagaactcagacctgttcaaatttgcctagagtcacaagactagtttgaatcaggctgttcttaactccgagtccagcactcttacaactcgttcacagaaaacactcaaactactctgtggtgctcattcccagatgggtgctaaagaatgaattcactgatgtgtgaaaccaaagaactttgtaagcttcgctaactacaaccctttagaggaatgccaaagtgatgtaagatgatcccagtgtaatatgccaggctctgtaaaataccccagaagctacaaaatgggtttgtgaggattcctggtagtgtgagtgtttgacaaagtctgagatgactaatcaggaaacaactgttgaaactgtgttggaccttcttgtgtgacattttataatagtaaactgagcttttctagaacagttaaaaaccagtctaggataaaaggcagctgcacatgccctatcttctgttcccaagcaagttctttgtcctctctggcttctcttccaagaggtgctggcactgctgaaagccaaaatttcctcaccaaagcagctaggacagagtgttcccaggatgtctggtttgaatcatgctgtataggtgtttcttcactttcaaaactgagctctggaagatgactctaaaatgtccaaatccatgcataattacggagtattgtcagtcttctccccttgcctattcaaagatggttttctaaagcacacgtctttctccaaatgtgcagacctcctgagcttctgtgcaagcaaaacctacagtgaacttagatgctctgacctgggggatgaagagtcgccagtgaagaggatagtgcagaaggttttacaatttttctagagaactcagatctgtcaagaccatgaatttcagagacagcacactttgaacacatcaaatcatctgcctagatttatgacatttcactttctctcagatgaaatgaagatggctgttttttcaggcccttctaagaggactcagatccttgggacttgcctaactaaatacccaaatacttctggatctaatgcccagatcaaggcattccaataggaacatcacaaagtggtttggtccttcctttagaaatggatgatagtaccatgtatttgactgaatcccaaatttcccttttatgtcttctgtacttggtgtctggtttaaaatgcaacagaatacataagacaggaggaatacttagcttgtgtaagcagataatgactatgagctggggcctctgtactccctctagatattatggtacagagaggttcagaaccttgacccattgcactttggaagcactttttagataataaaggacattgctatactgttaccactgcatgatgtggctgtaggaattacatcagcaggctctggctagaaaactagggggctgccaaatgacataaatcttaaaatgtttttgagtgacttttggaattcactcataaagtaaagacattcagctatgtaattagaacaaaactatatatactttaaaaatggtaggaagtttcctttaggaataaatctctatagaaccaggtttcctagtagtaaaatatgtaacagaaatatgttagctttattagaataaagaaaaaaaaaggcacggtacattcattgggaaaatacagaaatacataaaataatgacaaagaaaattaaaatcacccataattatatcacccacagattaccttgttggtgaatatcattttaatcaatgagaatgcacatggacacagataccacccctataacactggaatcactatactatttttagcattatgcagtcaatatgtttaaatagcttaaacttttatacctagtatcacttggtggtcttcaccaagtcataagacctcttctatgaaatggatatatgatttcttgccctggaagtcacttcatcccccttctaaattattaggttgttgtgtaatttattttaaagaggtgctgtatgtgaaagaggtgccctacaaaagtcaggtggcaacctgggaattagaagacctagttttgtgtccttcaaaaaacattgtttatttggacctcaatttctctacctgtaaattaaagatggtaggacctgatgatcctaattgtcacttccaagtcagataatctgtgatttttacaattctattattcttgttattggcattattgtgcatccacatatacatatatatattctaacgtcaatttgagctgctgagataagctcagatctcaggtaaagatgcagaactgattcaagtgctgctgtcataggtagagacttaccactgcacattaatggtagaccagcttgaggactgagcggctgagcagagggtcatggaataataaatggcaaagtgcaaagccagaagcctgaggaagttactcactcaggcgaggattgcatggtgtggtgaaaccctgattcaggggtagtgaccacccatgtggatgaagtgggacattagtattgttagggcctcaagtaggcagactaggagattgaaaatccaaactgaagactatttcatgaatctagcctctgggatgtttgccgaactggaactgtcagtaatgagccaggtatctaagtcagactaaagttcttagcaaacatcttttctttgagaccctaaagaacagcaatattccaatatatgtggattagttttgaggggagtgagaagtggagacttagaaagagttgctaaccaatccaacttgaacttcagacattaggcttccggctaaagacaacctatattgcctgcctcatttccttcaacaacaaaaagcaagaagaaatgaagtggctcaattaccttactagagtcaaagagaataatgctgaatggagtaaggaataacataggagaaagcctcaaatctctaaggctcatcgaaatcagcttccactcctttgtatggagggagaaaacagttgaggcatctacgtcagaactaagctggcttagaaactgatacctgcctcacgaggtcaggagatcgagaccatcctggccaacatggtgaaactccgtctctactaaatatacaaaaattacctgggtgtggtggcacgtgcctgttaccccagctactcgggaggctgagggaggagaattgcttgaacccaggaggtggaggtcgcagtgagccaagatcacgccaatgcactccagcctggcaacagggtgtgtctcaaaaaaaaaacaagaaagaaaaagaaactgatgcctgcctcaacataacactgtttattaaccctttgtgccaccactaaaggctccaaatagccttttctccagatgaaaaagcaggtcaaattgtgtcatgaattcagacaagtgagtatcttgaagaaatttttatcaacagccatcttctctaccatctgatggctgacagcatcctgcaatacttatgaagtgttattacactgtgggtactttagtgctcccataagtctttcaatgtatgtgaaattacggatcattgaaacctgtctaatgaggacacagtcctcatgttttggagttaaatctcacaaaagtgataatcatgaattttccttattaagtttcagtctttgtatgtaaattgaagtattaagacaatgagatacagatcaaagttttaattttcgtccctagcctcagatttaatttaaaagtcttaaattatgcagagaattgcatctctttattcttacagctgcttaaaacagatttaattatcttccttaatatgcagatactacttctgcctaccagttctctcaaacgaatgcctcccaaatcagttttgttgagttcttcagactgattggggcctttgccatttatcctgtgccttcaggttcttgcattggatttctctgggaagctgagttattgtgttgaaagtctataggctcattaggttctcattagtggtccagaggacatccatcttgagtgagtctccaagcacagagatgccacctctcactgcatgcttgggtctcagtgcaaaacaccttcaatcagctttctaaaagtcaggcatggtttgaaaatgtccggcatcttagactcaactttatggacttctctactcctcttccagttggttcttggattaattgttctttatttttaaggccataatgatgcataaatgcattgtgtgtgcttgtgtgcgcgtgcatgtgtgttcttcttgcatctgccacagtgagtctgggatggaagtacgactgctcctttgccttctgctgctaatgaaggttctgtcatgagagtacacttggagagaaccctaaaagcagcaggaaatgaggcaggtggtattgatgacattggaatttttcatcaacctcagaatagctatgtggctctctgagtaacatatcaggtgagctaagttgtgggattttggaggaattgtgttatggaggtatttctgtcatctaggttttgagggtgaccccatatgctatttgcaggaaagaatcccatttcttgcacatattaaatctgtaattttctggcttgagtacatactactgtatgtaaaattgcaaactagtatcagtgtacctagccttttattattttctgtcaataagaagtgctcctctttgctacggttttagccatgttttcattgatattcttatgctagaattaggacatgcattctaatgcatgtctaggaaaggattaaggaagagatttagatttcagatgaagactttaccatgttttgactgtttttcaaatgttaagagtcttttaagtttcagttttatctctatgcttcttggggaaggctatccaaatccacatacatttattgagtttctatcaatatgttaggcacattgtacagagatgtgggaactgcaatcaggagtgacatgattcttaccttaaagatatgtatagtttactggcggatgccaaaaatattattacaaaataatgcaataaattattgcattataatttattatatttagataatttattattaatcttttttatttccaatggatataaggtgttaggcactttctacttcatgtcattagatttttacttaaaactcaatataacagaggtcctagtcaaaccaaaacatatattcccacaaactaaagtaagtccattaatgaatgaaaagtacatgatataaaattggctcttggtaaaatatttgtcaaagaacaaataaataaatacaaacatctaactatttgctgagacagttgattcctcaggtctctaatggtttagatgaaatgcagaggagatggaaattacatggagaggtttgtatgcaagtaactgggacaaagaaaagaggcttagatcagtccgtaagccaacctagctccatcgaaggaagacaagactgtaggagaaagttgaaccatgagttaacatggatagaggcacaagctctggtactcacatgaaaaaaatattgttaacaacttggggaggtgaatcttttgccctctctgcattaatcacactgtgatgtcatataagaacctagcagggacctctaggtttctttggtacctagaggacttgctctttacaggcatcagaagcatgatcttttgacatcagaagatccctgtttttataaagaattgatatcagaaatggggcaagactcaggcactattttcaaagtaaattcagaaggatcaaattcaaataagaaatgcactcatatggattttgaggagaataaagacaccatgtattgctagtaggggcacatgccagggattttttgtctttgttttggatttaattaaaaaatattatggcttaatttatacccaagcctctgaagaaatacacgtattctaaattccttgggtgctgcattcatatcctatgtttttgcaatattctttagaatagataaacagtgtcaggcacactaggcattcaacaaaggcatcattttccaaagagggggaacccagagaggatttcgcatctctctttgctgaaatgtttttccacaaatggatcccaagccattagtattctcagagaagccaggaggaaaattttggtagatttattgattagtgtctaagaatataagagccacaggccaaactggctttggtcattgatgatttggccttttctttctactccttgatctttgtgactacttataatcccagccgtgggtttctacagaggcttaggagctacatgaagttcttcttagaaaatggttccttcaccatagagagaagcaacagaaagacaagataccatagatcctggattagaccctaggctctaatagttagcatttgtgtgatctcaggtaagttacttgcctttctgtgcctcatataaaatgacaacaaaatgacaataacacctatttgcatagagttgctgtaagatctacgtgagataattcatgaaaagcactcacaaactggaacagtggtgctcaataaatgttggataatcacattattatcattgtgtcaagtgtcaattctcctcagcttttcagagacactctgtgtctcttcattctgcattgccaatcacgtgcacctcccgtgcctacgtatataatccagagggtcatagagaaattgagggtctttttctgcaaggaggagtctgaatcattagcacagcatctcacaatcacatgtgaggtcctcagggcctcctgatataaagaagatgctcttggcttggtgctctgcaccaggagaacagagtgtcaagaaaccagatctgacagctggaggcagcagatttcatccctgctgttgaagctttgcccactcaagtggagtgaactgacttgttatcttttttccttcttgtgcccagaaggcatgaattcacatatcttcgaaccagattccccaatctgttcccacatcactcaacccagtgtgagatgcctgatgatgatctttattacatggaaagcagagttgaacagatgagaaccaggcctctgtccctgaagtgtgttctctatcatttgcacaaaggttggagctaatcagaagtgaaagttcttgtttcagatcttgctatattgtgttcttagaaacggaaaaactttctgaactctgctatagtataaacatctgctgcttcaaaagatgacagttctctgggtatcaggatcaggtgtctcatgtctctgggaagagaactttcacattcaccttgcaggtaaacacagggtggaaggtcggccctaagcataccagaaaggtttttcttatttttcctttttttgcccaaatacctagatataaagtactatattttatatggatttctgaaatgatttttaagtaagctttttgttgagtaaaatatacattaaaaatgtacaaatcactaaatatacaacttgatttttacaaagtgaatgcatccattagctgctgcccagatgaaccaactgaaaactgccagtacactcaaagttctccaatcactccgcctccaaagttaacaataatttttcccttctattaccatgaataataataataattattattattattgagacggagtctagctcttgtcacccaggctggggtgcagtagtgtgatctcagctcactgcaacctccgcctcccaggttcaagcaattctcctgcctcaacctcccaagtagctgggattacaggtgcccaccaccacgcccagctaatttctgtatttttagtagagacggggtttcactgtgatggctaggctggtctcaaactcctgaccttgtgttctgcccgccttggcctcccaaagtgccaggattacaagtgtgagccaccacacccggccaccatgaattattaacagctttgactatttttgcattttaattaaatggaataatgcaacatatattctttttagtctgacttctttagctcaataatggatatgacatttatccaagttttttgcatatagctttagtttgctctttttcattgctgtatgacattccattctgtaaatatactgtagtttatgtattctactattcatgaatgtttagattgtttccagtgagggctcttacgaatacttttgcaatgcatattatcttacatacattctggtgcatatgtgtatgcatttctgatgagtatatacttaaaagtggaaacgctgggacataggtggtatacatgttcagctagagcagttaatgtcaaacaagtcccaaatggcagtatgtatctacactccaaatagcattatatgaatgaccagatgctccacatactcaataacacctgatattattagcatttttttttttttgagagggtgtcttattattttttttttttttttgagagggagtctcactttgtcaaccaggctggagtgtagtagtgcaatctcagctcactgcaaccttcacctcctaggttcaggcgattctcctgcctcagcttcccaagtagctgggactacgggcacgtgccaccatgcccagctcattttgtttgtagctgttttttgtttgtttgtatttttagtagagatggggtttcgccatgttggccaggctggtcttgaactcctgacttcaagtgatctgcccaccttggcctcccaaagtgctgggattacaggtgtaagccactgcacccagcctattattagtcttttaaaatgtaaaccttctgatggtgcacagtgatatattattataaattaagttgcattacatagggatgttccgaattttttcatatgcttattggctatttggttattctgagtcatttgtgcattttctgttgagttaccagtgtttcccttattagtttgtagaatttatttatactcttctaattatgattccctcattaaaattatgtttattttgcataataaaaataataaaaaacataacaaaataattttattattttattactgtaataataccttttcaataaggtattattacaaatacttttttccctctagggcttaatttaataataatagcttattgaaaacgtattattatagatacctttctcccctctaggacttaattttttatttttgaaataatgccttaaataacagaaattcttaattttaatgtagtcctatttaaaattagtataattaggctgggcgtggtagctcacgcttgtaaatcccagcactttgagaggcttaggtgggcagatcacttgaggtcacgagttcaagaccagcctgaccaacatggtgaaaccttgtctctactaaaaatacaaaaattagctgggtgtggtagctggcacctgtaatcccagctactcaggagggtgaggcaggagaatcgcttaaacctgggaggcggccaagatcatgccacttgcacttcagtctgggtgacaaaggtagactccatctcaaaaaaataaaaataaaaataaaattagtataattataaagagatttgttggtataattcctttatactaaatgggttttctttgctgttttaaaaaagtctttgcataacacaaggtcatgaagatactcttctgtgctttcttttagaaatgttagtattgttgggcacggtggctcacgcttgttatcccagcactttgggaggccaaggtgggaggatcacttgagtttaggagttcgagacgagcctgaccaacatggtgagaccccgtctctactaaaaatacaaaaattagctgggtgtggtggcatgcccctgtagttccagctactcgggagactgaggcaggagaatcgcttgaccccaggaggcagaggttgcggttgagctgagatcttgccactgcactccagcctgggcgacagagtgagactcaaaaaaaataaataaatacataaatgttagtattagctttcaaattttgattgacaatccagttataattatgtttgtatattatgtgagataaagattcatgtattcccatatggatattcaaaattgtagcacccatgtattgaaaagattataatttctccactgtactgcagtgtctcatttgtcataaagtgggtgggtgtgtgtctatatatatataatatatgcatgtatatatgtttcttgactctccttgttcagcttgtttatgatatacatacatatatatgtatatatatgtgtgtttgtatgtgtatatatatatatatatatatatatatatatatatggtaatgtcagtcatccaaatttgtgagtcaccttcaaaagtatctttgctattcttcaggtcttgaaattttgtgtaaattttgtgatcttgtcaattttaatacacaaaacatgctggagatttttattcagattgcttttaattcaagtcaatatgaagaaaattgatgtctttttataatactgagtcttccaatccatgatcaggatgcatccctccattcattcaggtatttttcaaaatttatttccaaatttgtgttgttttctgggtagtgctattgaaaataagtttttagatttgagtataaatgtttgttgtattttgatgctattataaattttacacacacacacacacacacacacacaattttctacttgtgtagaggatttatatgtccaggtatcaagactcaccctaactctagtgaaaatatcatgtgtttgaaattagtaattaagataggttttaaattcacaagggaacagaatagagtgcctagaaatggaaccacaaatagtcaattgatttatgacaaaggctcatagcaattcagcgtgaaatgaacagtttttcaatggtattgggacaattggatatgcatgtggatgaaatatagaaacctgaaagagctttattcaagataaatcatacacattaatgtgaaacctaaagagaaatcttgtggtatgacttttttcacaatgttggtttagataaagacttcttaagcctgacaaaaagcactgaagtgacaaaaatcactaattttcaaaatataattactgatatttgagtatatatctaccgttttttaattttaattttaatgtgtttgagacagggtctcgctctgtcagccaggctggagtgctgtggcgcaattatggttgactgtagctttgaactcctgtgctcaagtgattctctcaccttagcctcccaagtagctgggaccacagacacacgacaccacgcctggctattttttttaattatttttatttttttggtagttgtccaagctggtctcaaactcctggactcaaatgatcctcccaccttggcctcccaaaatgttgggatccaccgcaccattcctatatctaccattttagtatttgttttctatttgtctcaactgtattatattcttttttttctcttttacttgtcttactttggattaatgaaacccttttaaagttactgtaattcccctgtcagtagcttgatgataagattctcttactacttcttcagttgttactctagatattgaagcacacattttggatacgttggagtctaatatatattagtatttttatctctttatagatatatcatgaaccttaaactactttaactccacttaattcgctccacatactgtgctattattctgatgtattttaatgctacatatattttaaatcccacagctgattatcattcttggtctgcacagttattattaatttcaatttaccccctttcttgctcttcattccttctattattttgtgtgtgtgtctctgtctgggtcattttctttatgtgtgaagaattatttttagcatttctttttatagacattggtttacatgacagatattgctatggaaggaagtgctggaaagggaagggaatggtccctttaaatgatacagaagtgggggaagggcgttggtccctggctagggctccacccctgggcccctgccctgggacctaggtgagaacaggccctcctgcctttgcacccaaatgttgtgtttcccaagaccaccctagcctgccctgcccccatcctgtgcctataaaaacccctgacaccctagcaagcagacacacaggcagatggacatggagaggaatgcaccgacaggcaccagcatgccagcaggccaccgaccaggagaactatcctatacggagtttagctggggcactgagtggccggactccagtggaaaaccttcccactccatccccttctggcttcctccatctgctgagagctacctccgctcaataaaaccttgcactcactctccaagcccaggtgtgatccgattcttccagtgcaccaaggtaagaacccgggatacagaaagccgtctgtccttgcgacaaggtagaaggtctaattgagctggttaagacaagctgtctacagaccgcaaaacagaaagagcacatggtagcaaacgcctactggggcttcaggagctgtaaacattcacccctagacactgctgtggggtcagagccctgcagcctgcccctgtatgctcccctagaggtttgagcagtgggacactgaagaagcgagcaacacccccatcacacgcctgttagggggacaagggaacatttcttgtttcaatatctctattattgtttatctaaaaaactatttgtgttttctgcagctcttcaaaggtgtcattccattttcttctggactttttaaacacctctgtttgattttagatttcagcagtttgaatgtaatagctcagtgatttttctttgcacatattcttcttgagtttgctgattctgttaaatctataggttaatatgttgatatctttcatcaggcttggaaaattctcagccctgatcttttcaaaaatgattcaggttccttatctctctcctctccttctgaggctacaattgcatctgtgttagacctttttatcattttccatttgtctcttactgttttttctctatattctatttctttcttttatgctctagatggcgtatttcctgctgtcctttcttccatttaacttctattcatatgggttcaatttcctgtaaacctaagttcttaatatcagttattatatctttatttttacaatttctatttggtatttcttattgattaccactctggggttcaattttccaccttttctcacattcatgaacataataatcattgttgttttacaggatatcttaaataaacactatatatcatccaactgttgttcttttctgtttttcccccctcttggtcctatatcttgatatacttggatatttctaaatgcccaacattttatatgaaaaatattaggtaaagctctggtttatgttattttccactaaagaaggtttactttggtttctaacaatcattttagagttgaagagagtcactctaatcgattcagagactgaagtgatttcagattggatttctgggtacagagggcttgttctaatttgggtttgccttcactcctaggatagagatttccagaagttccaagaaccaagtctcagatagttcaccagggccctcctccttgataggtcttgaattcaaatctttatctccccgaagggtgatacttctaaaacctttaacttctcagcctcttattgagtgctttctatgtttcctgtgttacttgggtattatgaaatacctcagggaggaaaaaggccctgtatgtgtgctgcttccctgtgctttccttctccctgggacatgacctcatcagtcctagctttggaatatcctcaaagtccaatttttatctcccaagccttgtgagtttattaacacctgtttagccaacactttctactcggccttttactggaaatctgaaatctgaacctcctctatagtgtggcatataaattgctaaagttctcgaaaggaaaatatagcataaaatgttggactcactgcagtcaatttcccatctcttaagaaaggaattttagcttctcaatcctcctgatagttctcttaactcctagtcctccttttcctcctcttcatttttcttcttcttctctctctctctgtccctcttgctctaaatatatacgcatatatttggtttactgcaggctaatctgtcatagtctcaagcagaaacctccagagtttatttatgtgaaatatgagcaactccaatttgcctaaattggcctgtgtttttctagttccaactgaagaatttttgggcatcttagtatttagaagattggatataattgagaggcacacatcaaggagataatcaggaaaggagtatggggttacacagtctgtaaatggcccttggaccagagatatgcacatcgtttgagctagatttcaaactcgttatttcacagttatttttcctatgagaatcaaaatactaaaaattttcatcaaacctgacaaagcaatcataattgcttcatctttccaccttcttgtcacactccagagcctccgacttctctataccccagccttgccactgttttgtttttcttgaagcacaatgcacaatgcacaacctgtgaacttgttagaaatgtatattcttgggccctactccaacctactgaatcagaatctttaaggatgtggccaagaaaactgtgtttccaaatgctctccaggtgattttcttatacatggtaaaaactgagggtccctggactatcagcagaggaagttggaagtcaatgttatgtattttaatcctgggtgtcattgttagcctttaaaattccttcatatttacagagctttacacaatgataaccataattaggtacccagaaaacgtgactgaggacaggactgtttggtttaataatcgagatgatttaatgtaagtacttatcctttggagaccatcttccccatttacaagatgacagaattcctgtgtatgttctaaaatatataagataaatttcatcttatccaccatataaatttcagacatttcagacaaccataatctggcaaataataatgtatgcttttaatgatatccctgaggtgctacacaatacaaactcttaactgccaaagaaattacactcaattatgtttacattggcctcagtgctatatgcatgaccatcgtgttgcccttggaaaagaaaaccctgcaggctgagaggggatgaaagtattagcatctcttaggttagtttagtatatgtacgtattaaattatttcaggaatgttatttatgtattctgagaaaatggattttgctaaaagtgccaataaggcaagattaaatccaacagatcctccaagagtaagagattaagtatgagtgaagaataacttgcagtgaaatgtaagtaattaaagaaatagatcagggaaggtgaagtgataataaaagaaaaacaaggaactaaaagtaaaataaaaatttttaaatagcatctaaaatggagaaagttgaaaaagatatggaaacaaaaccatggtttattaagaaaaatcactggccctagaaagtaggggggagataggaatcagtcctacctcttctaattgcaccatgagagtgacgttgtgtccttgttccgctgtcagctttccatcagccgtgactatccgcagcccccgcggggctttccctgggcacttctgcggtttggcagtgtactgttcccttacgccatcagtgcaattattggaaaccaccttcctgtacctaaatggaaaaaagctcaagtcgtaaaccagctcattataatgtgaatcattcccactttttaaaattagacatagtgcctagccctgaggaccatcagtaagcacctaaccatctttcatgctactatgaggagtagggttaattcatataaagcacccaacagagagataatcatggtcacacattgtatctattactagcattgtaactgagttttattcatctattaaattaatgaatcacttcattttgaagttgtgggaaatgcacagaaatagaagatatagcccctactctcactaagtttataagctagttggagagacatagatggctaatctaggagataattcaaaggctatataattaaggactagaatgagtaataaatatcgcaaaggaatttacaattcagagaaaaaatagattatgatagatatatgactcaacattcacagatctcatagagactgctacagtaatggtgtagcacagaaaacactggctaaactggatatttctactcagtctttcatgagaggttatactggctaaatgatcaaacctcacattaaagagacttcagtttttgcagattgatgctcttttgcttatttcttgttttagctttaacagggaaaattattctacagaattaacctatataatttatcagattcatagaaaattaaaatgtacaattttaggatgacaaacctttaagatttttgaggttcagcgttatctagccattatcgttttatactgttgggtctgcagcaaccactttatgtatgtatatatttgatttcccaagtttatttgcctagagttagtggtagagcccaaataagatgcaatcaaagcttactttccactcttctagaccagaggtcagcaaactttttatataaacagccagatagtgaatgtttcagttttgcaggttatgtagactttgtcacaactacttatctctgcacttactgtatgaaggtgaacacagacaacacataaaagaatgtatgcagctggattccagaaaacctttatttacaaaactggcatagttttccaatgcgtttaagtctagtgaatgtcctttcctctgtgagaaagtcaaaggagatactgtctggaaaagtactttgaacactatagatcactacaatgtcaattattaatgcttatctcatatgttaaatgtaagaattaaatgggttaatgtacacagagtacttaaaagtatcctaatactctgcaagtgctcataaaatattaccaattatttctatttaatattattactatttttcttctctgttcaaaaccttcatggacttcatatgaccttaggatagctgtaaattctgtaggcctgggcatgaagccctgcactagctaattttattctgctttcctggactctttctccctcataagcccatgtccattctctttttaatcttcttgagagtacttctgttttcctctctctctttctgcttcagtgtcctcctgcatgccctagcagctgcctaaaatttgcccaccctttaaggtacagcttacttcttgtcttctctaagacaatttccctgaatataagagtaaaatggcaggaatttcatatttagagagtgcttactatgtcctagttattgtgctaagttctttacataaattaactcatttatcttcagaagtatccataataaggaagatgtaattattcccaataaacagatggaagaattgagattcataggtgtcaactagttttctcaagatcaaatagccaggacctagacaatttgtctctagcacacatcccctctttactactgcactgctactttaaatggagtaagattatccctcctctaaacccttaaaagaatccttacgatttacttgataggaattctttataccttgtatgattttcttcctggtgtgactgtgtgaaattcaagctccttgagggcctccttgtgttccagatattcaaagctggtaatcaggaggtccataccagtaactgtaccagtttaaatgtggaaatatctgcataataattggttattaccacatccccaaaccctccaagcatctcacttaccaacccagctatgctgatccctgtccttagagtccttgcttctcacaattaggaaacttatgggttaacacctagcctatgagggggtcaccaaaactccgctccagacataagataactgcccatgctggttggtcattgttatgcctaagcaatttgaacatcattccatctgattttttttttttgtttgagacagtctcgctctgttgcccaggctttacttggctcactgcggctttattatggctcactgcagcttccacctcctgggttcaagcgattctctcgcctcagccatccaagtagctgggattacaggcatgtgccaccacgaatggctaatttttgtatttttagtagagatggcatttcaccatattggccaggctggtctcaaactcctggcttccagggatctgcccacctcagcctcccaaagtgctgactaaagacatgagccaccacgcctggcctcatctgatatttatttttttaaaaatcctttgtagttgcttttaagtatatgtaaaagagaaaataagggcaggtgagagagagaaggaaataaaacacaaaatgcagacactggtgtatgatagcatcctggtaccagcaatagtagcaaaaaaatgaccagtgatgtcacccaggttaattgtggcatctcagtgagtttcaccatgcatcagagactgtctacaggtttcagaggcaaggcactgtgcaaactgaagtcaggttatgatttttaatcactcaacatccaagcacacctgtgattctctcttggtgggcagctatagaaacactggttcaccatcaccactagcatcatcagctagagaatattcttttgtttgtcactgttctgatcaatcattaccttaggctttcctgaatcctgcaataacaggagttctgcttaaatccaaagcacgaatccatccccccgggactatgccacagaaaaggctgttggtaatttttttaaatgctcattaaaaaccattctgaaaccattttatttcctgtatgaaaatggcatcacattagccctaccagacctgtccctgaaatttagaagaaaattgtgccgtaatacagagttcatttactcaagtaagcacacacctgctttttgcattacagaatggttctattttcatcccagcagctgtccctgggtctgagttacataaatgaataatgcatttaatatgttattaaatggggctgctacctccgtaataacaaggcaacttatgattatgttggacctgcgctctgaatattactgggatgcatttagttggtaaagcattcttcaatctgccaagaagaaaagtgctttgtaatggcaagggagtctttgtacaattactgaaaaggaaacattctgcaaatgtgcctttgatattaccgatggctcaccagtagataggatcttactactccaacaaccccaatttttagctattctcttcctccctattttgatatgcttctgtcacattttcctttttgcccctaccctctttgactttgcttctttgctacctggaagtcttaaaaaagatgaaggcaataggctgggcatgatggctcatgcctgcaatcccaggactttgggaggccgaggtgagcagatcatgaggtcaggagatcgagaccatcctggctaacacagtgaaaccttgtctctactaaaaatacaaaaaaattagccgggcttgctggcgggcgcctgtagtcccagctactctactcgggaggctgaggcaggagaatggtgtgaacctgggaggcggagcttgcagtgagctgagattgcaccactgcactcccgagcgagattctttctcaaaaaaagaaaaaagaaaagaaaaaagatgaaggcaatatttttctttgtgaaagtaaaactggaaggaagcattaaaagtctttgtaatctgtgacttttctatttagtaggttttttttttttgacattttgaggtggtgatggcaagatacagatgtttttgagtattcagtgtatactaaggtgacagtagcttagtagcttagtagatctcaaccccgtctaccctttggaattagctgggggtacttttaaaatagatggatacccaggctctgcaaacagaaatgctgatttaattgagaattatggggatcagtttgtttttgtttttaggttcccctggtgatgctagtttgcagccaaggttaaagactacaaatttaagaagtcaaaaacaatagatgttggtgtggatgtgctgaaaagagaacgcttatatatggggtaggaatgtagattagtacaaattagtaccacgtctatggaaagcagaatggagatttcttaaataactaaaattagatctaccattcaatcccgcaatcccactactgggcatctaccaaaaggaaaagaagtcattatagcaaaaagacacctgtacatgtatgcttatcacagcacaattcacaattgcaaagatatggaaccaacttaagtgcctatcagctgatgagtggataaaggaaatgtggtgtacatacaccatggaatactactcagtcataaaaaaagaatgaaataatgtcttttgcagcaacttggatggagctggaggccattattctatatgaagtaactcaggaatggaaaatcaaataccacatgttgttacctataagtgggagctaagctatgggtacacaaaggcatagagagtggtataatgaactttggagagtcagaaagggtgagggaggaaggagggtgacagagaaaaaactacatattggatacaatgtatgctactcagatgacggatgcactaaaatctcaggcttcatcactacacaatccatccatgtaaccgaagaccacttgtactccaaaaggtattgaaataatatatataataaatatatattatatatctcaaaaatatataacactatatgtgtgtgtgtgtgtgtgtgtgtgtgtgtatttttttcaagaaaataaataaacactactgacctgaaggttaaaactagtgttgtagaaccaaattgtcggagtttaaattcattctcttactctatgaatttgggcaatttacccatcctctctcaaatctttgattctttgcctacaaattagggataattatggaatcttttcctaaagttcttgggaagattaaatgagacaatgcattgaaaagggcttagcatagatttcagcacatttagaacgttaataaatattaaaatataaaaagttagaaaaaagtatttaagtatcaaatattaacttgctatgatatttcaagttcccccaaaataaaagtgacgttcttattgccaaggtcgtcttaagatgaaatccaattatgtcaattcctttcttaaaatcattcaaaatttcccatgggcttattctaaagagtaaagttcaggtttaaagtaaagatccacgacctgacctcaatgcatttttctagcatcatccatggcctgacatgcgccctgaaccaagccattctgtatactaaatgccttcttttgcctgtgctgttcattctgcccgggatgctctttcctactggcaaacttctactcatccttaaaaaaaaaaaaatcagcttcaaaatcatgctttttgtgaaacctcctcttcccttttgtcacggtagttatcacatgcaaccaaggtgaaactggaactctaggtcttcttgtaccccagggggtgttactgtcattgagcaacggtggtcctcatttgcactcacaataaaaaaaaagcataaatagtttaatttcttggcttgtgctatgtgcatttgctttcaagggaaaatactgccttgttacaatgacactaggcttaatgaagcaggaaatgaaggaagccttggggatggagaagggggctaattcttgatagagtatgtggctaagacttaaaatcttccaaatccaccaccttagtaatgtaggtgtgcaatgacaaaacagctatatgtgttatgttcatgtgtgtaaattaaaagagctatgtaactatagatctctcacatgaagatacagggctacgatggcatggcttaacaattagggtagagagagattcttctacccctgcatccagagaaactgcttctgaaaaagcagtagtggtggcagcctagatttcctgatctcctattatatataccagaatagggattataccagacttccaggctgacagacctcattggtggctgtatattaaccattgtgactcttcatcaatagacacaggcagccccaaaatggtcatttattctttaactgggatcccatgtgacaaagtatgctcaggagtgacaatgtgtccacatatcaacaataatcttatgtagcagccatagcatcagcaatcaggaatagacttccatggctggctaagcaggctttccaagtttctctcttcaaggcaacagctctttggactattcccctcaatggagtaaacagacctagaaattagcggataggcataagacagaagaccaggtaaaaagaagaaagcttctcttgcattaagcaggatggaagcagacgtcatttaatttgaatagtaataggaatgtgacttcattttgaacatgagcttgatgaaatggtgaactgggacatatggccacacacacttcactaaatcacttaatatcgagaatcatactgattgagaatggctcacagaatccactatctgagcctaccagttgtacgactaagttaatatgaatttgttttctatcttttgagggcctacagtccaaggaattctaatattgaatcctttcaattggtcatggaaatgttaaagcttgaaggggtctctaagatcatccaacactatccttttgcttttcacataaggaaaaggaaacacagtttagagagttgcacctcacacaggggatgactggcacgtctgggactctggactaagtctggtgttctcttgccactgtaccatagcaccaggataagaattgttaatgccaaggccattgatgtgggcaagaatcgccatgtgagaaagcaagtctccatgtacagtgatattcaccttttccttcatttcccaaccccagtgtcatgcatgaaaagatggaaaacctcatttaagaaaggttttcttaagaaagttttcttcagaaagttgactctgtagcaaccaacaattattgagtgtgtgcagtgaggctgtatggttcttggctagaaaacagctacagaggcccctgcagtgatgagtctgtaaataatgcaagtgattgcctttttgtggactttaaacacatgcaccatttttagggccaattattctccttgacgcacactgaaaagtatccttgagaggagatcagaccaaacatcaaaacccccacaaggcaaccaaaacagaatcacctggaaaagaccaaagctccagagacactggaaatagcaaatccaggaagtggcaggttagcagaatctaagtgttttatggcttatgtagagaggaagttttcaagtttttatttttaattgacatattatacatatttataaggtacagtgtgatgttttgatacatatatacattgtgtaatgattaaatccatcatatccatcacctcaaacatttatcctttctttgtggtgagaatattcaaacttctctcttctggctattttgaaatccacaacatgctattattaactatagtcactctactgtgaaatgaaacaccaaaagttatttataaaaagcatcttttaaaacattccaaatgtatcttgatagtataaacataactattttgctagaatttatgtgtgtattttttcttggacccactgtatatttgtaaatagatacctaacttaaactttttaaaaatgtctttattgtataaatatccccattggaatctcttgaatccaggaggcagaggttgcagtgagctgagatcacgccactgcactccatcttgggcaatagagtgagactccgtctcaaaaaaaaaaaaaaaagtccccattgcatattgagaaactaaccctgaagagcagtaagaactgtctttgtaccttcttccatgaggaattaatggcccctataaagaaactctacagatagaaatttctaaacgtactttataaagcacctctagaaatatctccagcttaatagcaggaagaaatctttcccttgagaagattatcttggtttcttagaataaaccaacccactgcccactttattttatatttacagaatcttttaccactggcatgaaacaagtaacatgctagttaatttagcaacttaaattttgcagtatgctccccggttccaaaacagtataaacaagatttaaccatatataagtatcactgaatgagcttgtgcttgtggatgtgcatactgagatatttatagataccgaaagagaaacaaagaggaataaatttggggttatttcggcactaacatgaaataaaatacaaatgaatactgctttcattttatttgagcaaaaggaactcgttcagtaatcagctaaacacattatctggcctgagtggcataaagggacagacgtgctttggtgtacagtgctttcatcactttctaattatgtaactttatgagccgcataggttactatttttgttttacaaatgagaaaacagagacttacattaaatatgtctcagatattattactgcagtgacaattaaacatcaaatacatgtctggactgtggattcataataaaagtaagttttttcccttctttctttactctagaggagtcttcagacaataactattggtgatgacacacattttgtaaggtgatgactatgtgctaggcattgtgctacatgctttacatacagtgtgacatttaatcaaattctgaaggcaaatagcaaaatgttataggttaaggaactaaggtcaaggaaacaaagtcacttactaaacataacagtaaatggcagaggttagattgaacatccttaattgtttcattccaattactcactttttcaccgaacaaaacatccccaattgtatttcactctcaatccctaacaggctaaggccccagtaccagcctccttgctttccaccttcatgtcaaatgacatgtagaagctgtgaggacagaggctgaatagaggcagggagccaatcgtggagaacacagcaggctctactgttccactgtgtgggtatgagaaaccctgacgccactggaccaaggagcaggactggtggttacagccacctggagggacattctgcaccaagttcactttttattccatccatcctttctaagtcctagccagcaactaaaacaaaaattgtgcaaccattcacttctacatagtaaagatgataaatattttggcatctcatcaaaatagcattttattgggcacaataataaccgatgccaggatttccccatcatggagaagcaggtaaacctgagaacactgccatatacacagggtaataagctgacagtgaaagtaaccatagacatttataaagtgagttatttaagaactttttttttttaaaggaatgatttcctgcatgcttccaaataaactctcagaaaggtgatgctgggaggtttggtcattcaccccacttaattcattttcccactgcatgtctgtatcatgagctatgctgtaagaaaagtgtgagacaaatgaggtgcccagggagcaacatttatgaaggggctcactctctggccagccctacacttgcgattcctttgcacttcatcccagccctgaggctaatacagattctgcactgactgagcatgaggtgaccatggatggcttaaaatggcactggacacagggttcccagtggctgcttaactctataagcatgcaggcattggcatctgggcttgtccttgagaaaactactattgtggcccttccccaggatcatttcttgttctttttgcatgaaatgaccttcctcaccttattaatttggctaaatcctacttctccttcccctcagctttcctttacagaatccactggcatttgaattttaaaggaggacggcacttaatacaaatgaatctctaatttttgggactcacaggcagcccatgagcaggaagccagtgttttaacccttacaagggagagatgtggcaatgtctgatacccaggtctgagacgtacccagttggctgagtggaatttgcattatgagctaacagaaacacctccaattgccaaaagagacttaattatctttgtattatttgtataacaagttttatgggatgagaatattaactgcagcattatttatagtggcagaaaaaacaaaataacccaaacatccatggaagaaggataactgataatattataataatacttaatactatgaaattaaagaaatgagaaagtgcccttatatactctggcttagaaagatgtttaagacatatttttgaatgaaaaaggaaaatagaagaacaatgtatctagtaggaaatcacatataaaaacaacctcccaaattaatttgtgtattttctcttgggacaagtatttactagcaaatgcaaagacaagtatttagaagtatgcatatcaaacagatcacagttgtgtggggaaagggggccaggattgggatgatgatgtaaattggcttttaaacatataaaacatacacatttattttgtaactaaatattttttaagtaaaaatctaaatgtatagtgtcagcattattagtggctacaagattatatactgaatctgcttataaaataccactgaatcaacacatagccaaatgacatctgtggtgaggggctgaagtgacattaagggaggcagaaagttcttttccatcttttccaagttcaccaacattttacctcttgccaactcttgagttggctacagacactgctaatgtgaattcagtggtgtgaggccttctttgtagatgatttcaggcctttgtcccagctaagggtcttcgtgttcctaatgcaaaatgtgtagcttagacaacatgctgatcagtggggttattattgacaaccactcccgtgactttagtgtataagaccctatttgggtattcactcctccacctgtgagcatcttacttatgagagcaggacatttaccatacccgctgatggctggtatttatcatatgttctctttacactagcttgctcaccaatgctgatgcttttctgcaaaatctttaaacggaacagacgaaaccagtggacgtggcaacttaacaaaaatcatttggggtcagatgctatcgtgtaatacccacagaaatgaacaggcccctgagagttaaggtggagtcctagaaggtagtgttgtaatttcgtgactactaaacataacaactgcattgaccaacatttatatacctggatgcttattgctaagtcacattttaattgacattatgattttaattttatatggcatagatggtattctttttgaatataaaattacttaatcgtcactgatgttttatttgatgttagtcagaatttataagatctcagatgggccaggcgcggtggctcatgcctgtaatcccagcactttgggaggctgaggcaggtggatcacgaggtcaggagatcaagaccatcctggctactatggtgaaaccccatctctagtaaaaatacaaaacattagctgggcttggtggcgggtgcctgtagtcccagctactcgggaagctgaggcaggagaatggcgtgaacctgggaggcggaggttgcagtgagccgagatcgtgccactgcactccagcctgggtaacagagtgagactccatctcaaaaacaaagaggaaaaaaaagatctcaatgaactgaagagtgaggggtcacaggtatcattcagccttggtctatgattgagtagcatctggaacaatttgatccctctgtgtttcagcctcctatcatcaataccaaagacagactaatataacttccttgactgattgagctggttaaaaaaaaaaatcaattcttaaattagcttgaggggtttccaatgccctttacagtatctaaacatgctagtaccagcaagtaataaaactcctgtcttttgcattccttccccattaagtttagttattttattaaccttttcatttttttcctccatggtactatgctaagacctcactgacccattgctataaaagtgttatttatatttccttggatgtcgtgttatcattcaaaaaaatcatagcttattcctttattcaaaggttctaggaatccctaacatcagaaataggaatcattacaatccttttctatgtgttttccttccttgaaaagaatagtatctattattttgataatcttttataaaaattaaacacatttaaaatttcaaatacagagtacataaatggaagtctcaccccctcaagtggattctctgtactgtagctggctcaagaaaggagaaggggctttgtcaagtaaaactggctgattggtaaggttcctatctccttacttctcctttctccttcttccttccctttttttttctctctctctttttttttttttttaatagatgggggtttccctatgttgtccagggtggccttgaactcctggacccaaacgatccttccacttcagcctcctgagtagcagggactataggcatgtgctaccacaatagcttctttttaactttttattatcagaactttcaaatatgcatgaagaaaagtaatgtaataaattcccatgtactcattacccatctccaaaaattatcaatacttatctgctttttaacacattaaaacaaaactcacaaaaatatgtatctctaaaaaataagacttatttttttcttagcctaaccaaaatgactttatcatgcctaaatatataattctttaatatcacctatgatgggtaacttaatatgcgaacttgactgcgccatagtatgcccagatatttggtcaaatgttacacttctgtgggttttttgtttgtttgtttgttttgagacagagtctcactctgccgcccaggctggagtgcagtggcacgatttcagctcactgtaagctctgcctcccctgggttcacgccattctcctgcctcagcctcccaagtagctgggactacaggcacccaccaccacacctggctaattttttgtatttttagtagagacaggttttcaccatgttagccaggatggtctcgatctcctgaccttgtgatccgcccacctcaccctcccgaaatgctgagattacaggcgtgagccactgcacccggccacttctatgtatttttaaatgagattaacatttaagtcagtagactgagtaaagcagattgacttctctagtgagggtgggcctcatccaatcagctgaaggcctgaattcagcaggttgacagttcccaaagtaagagagaattccttctgcctgatggcattcatattggaacactggcctcttttcctgccttcggtcttgaaccgaaagataggctcttcctgggtctcaggtctgctggcctttggactagaactacaacattggttctatggtttcaggccttcagattcgaactacaactatactgtcagctctcctgggtctccagcttgctgacttaccctgcagatcttgggacccacctacctccataatcgaatgagccaattctttacaataaatctctctctttttttttttttttttcttgagacagagtcttactcggtcacccaggctggagtgcagtggtgcaatcccggctcactgcaacctctgcctcctgggttcaagtgattttcctgcctcagcctcctgagtgtctgagactacaggcgcacaccaccatgtgcagttaattttttttttttttgtatttttagtagagatggggtttcaccatgttggccaggctgctctcacactcctgacctcaagtgatccgcccaccttagcctcccaaagtgcagtgctgggactacaggcgtgagccactgctcctggccaataaatctctttctaaataaatatacatcctattggttttgtttctctggaaagccctaactaatacattacctgaattagtatatgttcaattttcctcaatggctcaaatgtgcctttttacagatcatttgtttgaatcagaatttaaataggttctacacactattttaaagtttatagatacctactacatttgagacaaatttatgattttttttccttattatggtatttcttaaataatattgcataagccccatgacacagaatattaaataccaaatttcagaatgtgattctggatttacaaaggtcagaatgcatgtttaaatgtgtcaagactgaacataaagagaaagcaaaatacattcgtattaacactagtatacttttgaaaagtcagtgagttccttttgtgattccaggttccacatctataaaacagaaaatgcaaatattaaatatctatttggccttcctcatcatggatacaatgacggtaaaaggtaacttcacaggattaaatagcttgaaaacaaagtgtcgagaaaatgaagacacttttaatatcatcattgtgatcttcaatcaagaaacatttctcttttttcaatttgcaactggaatcttattctcacatgaaacttgcactattagtgcaaagttgtgcttcattgttaaaatgaacaaaagcaattacattgtgctgtaaggaaatatgcttggtccttgatcagaagtaattctgtcagtataacacgtgctgaaaggcagcaaaggttggcctctcaaggtcactactccagacacttacccagtactattgaggtaactctgtcccaagctgcaatcctttgacagagaggatggattgaaccaaaatgccggcaggcactggccattgctgtgtcgctcataaccatagtcgctgttaggaaagagccgagaaaaacctttcactaggtggcaaaattactgaaaacaattctacatcagtccacagccaagttccacactaatcaattagtcataacaaacaaaaataaaaacaaaaaaaaaaaacacaagcattccctgaatcaatgacttctcaaaaatagaacttttttcatagaatatctatcaattaattattcaggaaaatatcctacacaactggtcattccatttaaacactctcaagctgagagagtagattgtgctctcattagaacgatacacaatacaggtggctgggcccagagaaagctgtaatgagaaaacgggtgtggtggaactcaacccttggtgagaaattcatcgcagagtttaacacggccacatgtggcacagtcctcattactggtgatgtctttgggatgctcttccaagacatctggatctaccaagagaactgagccaggtctctctgtgtacactccatatgcttcaaagttacagccaaaaaggaaatgtccttcaggagtgtctcgagcattcccctaaggaaatgtttcacactaggcagttagcgctgccacttgggactaactgttttaaatcctctctctacttcggaaatagccaaagacttccctctcagcctcctctcattcatgcttccaggagcctctgagttgcctgatattcttggcaactggcagatgaacctgggcacagagaatgacaacaaattgcacctccacatgcacagacaaattgcaggcagcaatcggcaagcattagtatgaactggcccatctgtgtaatggaggtgagatgctggcacacaagggtcagtaagggagaaataggctcagctcaggggcctgtcaccaggcagctggtacttagaattttgcacataccagcaggatttggtgctggttcaatgcagcatgggtaggaagacttcagaattgctgcctataggacaaccagtgtttgcttcaggaagttactttacgaatgctggagagggacaggcaaggtcatttgggggactgtccaggagagggccaaaccaaggagaaacactcagtgacaatcacctttcattacactacagccaggtgtaatcaccgaaactccagctaccggtagaaccccaacaaggttgtgatgagccttcccaaatattttcagaaatcatgcagtgacagaaatcccactggaccagaaaaccttacaatgaactccttcatgattcatttcccacttctcagaatgcatttcagctggtgggatgagtagccgattccaatcacaaatgaatgcagggattgggccaagactaaggggcacgagagacacgggagaggagaaatctaattgccttccttatctggtattcctttcattctggactagcttacaattgaaaaagaaaaacaacaacaacaacaacaacaacaaaagactggcttactttgaagcctgtagaaaagattcccagagaagcaaatgtttcaaggagaaatcaggacattgggacatctcatctcatctcatttttttttttctctttggttttctaccagagaataaatttgcctcctgctaaagaatggctgtttcttaaggcaaaagctaaaccactaatgtaagatgctaacttcctttgcaaatcttccttgaatacagtaaacgaagaagcagcagtggcttcagaaagagggatgcaatgaatgacttaaaatctcatggtagttttccctgtgaatgcatttcaggatgttagtcccaaagggtagtacagagataaaatatttttgtcattgtaataatattgcactgactaaaacagaagtcacactggggaggcccctgaagatttcgatgatttgagctccctgaagatttgagctccaatgtaactgaagctctgttgccctctggctgagcccaaagagatacttcattcgctcttggcttggcgtcctcaccaacaaggggatacagctgtgggttactggtctgacggctggctgccactcttgtcagaccttcttagtactatttattcagagaatatctccagatgtctaccataagagaaggcttaacttttctaagatatgtgatgtgtatgtacacagtatctcagttcagtcactgatattttaatgattcaatatgtaacctgaggttgctatacagctagaaataaattgttgaaaaatgactttagttcttatacgggtcaagtattaattttttaacacatatgtacatatttagcgattgtgttttctaaattaaaaacaaataaacgaatacatgaaaaccaaaaagaagagggaagaaaacaatggaaaatgagatggaaaatatcaagggagttaccacctacttgtcctcaatactttgtaagccttacctgaacaattaacattgacaacaagccaagggcttcacagtgcccacaagctagctttctgctgagcaaatgtctcaagaaggactttatggcactctgagtttagtttaacctctaaatgtctcagtacttctccagtttaaattagcttaatcctggtaaagcaaaaagtctcctttatcactacgttcaccgagttacagatttgcaatgccattgaatccatccttgctctgagttcagcaacatcttccatgaatctcataagctatggtcagctaactacgaatcgaaaacttgcagggacagaaaattttctgccttaaaaggctattattccactacaggaaatcctagattctagaaagctttcatcttgagcatagatgtttgtttgctccctaaaaagtccacttagtgtttccagtgttgctgtttgaagcagcacagaaagaatctgcccattttttttttttttttttgagatagtctcactctgacgccatgctggagtgcagtggcgcgatcgtggctcattgcaatctctacctcctgggttcaagcgattctcctgcttcagcctcccgagcagctgggattacaggtgtccgccactatgcccagctaatttttctatttttagtagggacggggttttaccatgtttcccaggctggtcccaaactcctgacctcaagtgatctgccccactcagcctcccaaagtgctggcattacaggcatgagccaccatgcccggccaaatctgccggtaatgaagataattaccagccatcttccgagtcctctttcagtctaaagaaactcttgattatcccacatacacatacacatagctagtaaactatgaggtaattttataagaatatgaagctggccacttagccctatgtatgttactattatttcaattctaagctttcattcaggcccatgtggatttgatacaccaaatggctccaggagataattgcacaagctcaccaatcaaaatcagcctcagtgcagacacagggttcagattccatagctcctgcatattttccttgcatacacttccgctctgattttcgcttcttatatatcctttttgctcccatgatacatgcttccccctgtaagcagagaaggatcacagatacttgggcacatagcttggactttctctgctccacatgagtgacatttagggagacatttgcacatcttagtgtaatgtaaactttggtagccctctttgtgctaacaacattttccttttgcggtctagagccctattatacaacctgactataaaggcaatcctaacaatcattgaagattattaaacaacatccttaattttgtgtgcacttatcaagcctttatttggcaaagtgttgggtgcagtgctatgaaggacacacagactcagcctgtacctagtgtattgccagtaaatctgcagtaattaagttcaattcccctataataaaagatgtatacagttggtcatttatgagggcatgaaagaggagcattgctaagaaatataaagatcaattttgcctcgatttattatgcctctgcccacacaactttacagcacagattttaatgttcctctaccagacaagcgagagagctaaattcagtgttttcccacaaaataaataaaagctttgaatatcacaatgcttgtgcatcccaaaggagaaaatatcagcaatgtaaatgaacgattctattgttaagcctctgaatagggtgggtgtttccagctaacgcagggcccactatcagacacactcctccttttgtgtttctgaaagatcagagtagaattttgctttatctactgtacaccgtctttcttgagcaaactcactttaactggcttcattatacatctacatttacatatattacttagtctaggtttgaggtatatgacgtttttctgcctgaatatggtgatggctttgcagcaggtacttctaccaaatcctttgagagatctgcggaacgacttgtaccttgggaaatcaagggagagacacttccatccaagcattttgatataagctggatatgtgagaggccaggacaaatgaaagtttcctattaataattctgcattctcataccagaagtaccttgcaaggaggcaaaaagtaccatatagttccaaggaatcaaggcaaaggggaagaaggatttctccggcaacactcacccagcataattttgttattttatgtctctgcttgcattgctagataaaattgaagatatcttcctcatccctgcccccaccatgcaaccatatgacattctcagatgaaatatgtttggatctgagtgctgaactggtatttcattttgatttgtaagcctaagccaagcacatttgaattttatctcattatatcctagcacaataaaaacagaaatgacttcacaacaagctattaatggtgagtttgttcactgctgtggaacacaaatgtgtaagaaaacagtagatggacattttggcctagagcatcctagttcctataccttagcaactagctttcccccaacaccactcatgcttcctgcccaggccttagtctcagttcttttcctcctacctggctgtgcagctgccaaggtctgtagtcctcttcggcacaccgtctatcaaaaatggacttgtaatctactttgaccagctgccattcagagcggtggctgaagtgtccaaacactctacagagttcatggtgataaaaataattacaatgataacaatgtaatgagtaataacaacagagagcatttgtggggcgttcaccctgagctaagcacattacatgaatcatatcatttaatcctcaaaacgcattcatgaagagggtacttttttttttttttgagacagagtctcgctctgtcaccaggctggagcgcagtggtgcgatctcggctcactacaacccctgactccctggttcaagcaattctcctgcctcagcctcccgactagctgggattacaggcacgagccaccacaccaagctaattttttctatttttagtagagatggggttccaccatgttggccaggatggtcttgatctcctgacctcatgatccgcccgccttggcctcccaaagtgctagattacaggtgtgagccaccgcacttggccgaggagggtactattactggatccacttcgcagatagataatatgagattcaatgagttttgttaacattgcaaaaacaaaatcaagtcataataacaggcagaaccagacccagagtatttaattcaagagcccacttgtacatattgtgccacaggattggttgagaaaatatggttgagaaaaacaatcataaatgctgtattctatgtggtccaagattagacttctaggttatcttgctaatgtacatagttcccatggtttccatgctattttactttcccaccagcccctagtgaaagtgatcagcagaaccaagtactaataatggtttcctacactgtacattctactctctttactcagagagacttaagtatttactgagatgtttgaattaccaaccataggtttgaagaaaagccatgaagtggcctgttgggtcagttttttaaaatctgttttgaaaatataaaaattgaagaaagacaaattatggaatgcattgctaatttagctacgtctctcattgagaaaagtgtagctattaggcatattagatttttattgttgttttctaccattaaaaagcagaagtggtaggccaggcgtggtggctcacacctgtaatcccagtactttgggaggccgaggcaggtggatcacaaggtcaggagatcgagaccatcctggctaacgtggtgaaactctgtctctactaaaaaaaaaaaaaaaattataaaaaaattacccgggcgtggtggcaggcacctgtagtcctagctactcaggaggctaaggcaggagaatggcatgaacccaggaggcagagcctgcaatgagccgagatcatgccactgcactccagcctgggcgacagagtaagactccgtctcaaaaaaaaaaaaaaaaaaaaaaaaaaaaagtagtagtggtaggggagagaattagcttaccaagtattgactttggcttgaaagttttcattgatgaccagatcaactactttataaccttccctttctactttccatgtccagttttccaaaggaaggaactctcacagtttcatacttgaaattcaaagtccatgtattgaaacccataggcagcgtcattaatctttcacaaattaatgatcatcacattccagacaaaaatgagtgtaaatgcaatttcacaataacagactgttctcatgattttcctaatatgcctcacaattgggttaggtaaagagccagggaaaaatacaatgctttgtggcattttgatgaaactatgctctgacttaaagcgaactcattcctatatacctgagattttctacatatccaggttctttattactgaagttttaaatgtacagctttatttcctattgaaatcatcacttctaatttctctaagcgcctcagtctgggtctcctaaaaactatcagagaaccaagaaaatagctgcccacatttttcttccctatttgctgtacactcttgcagtaagatgcaacaaccttgaacctaacagctgcaaatcaaacaggcttagctataaaacatttttgtggattactcttttctatgaaggctggaccacatcatacttttcaacttacgtcatgatgagagtctcttctccaggctcacccagaaccccatccacaaaaagtggaatagatgtgaaactgtatttgctccaagatctcccttcatcaaaactcaacctaatgatataaaaaatatcagtcatcagatctccaaaggaaaaaaaaatgtcatttcaaaggaaagatactctcaacccagagataatacattttaaaagtagctgagattttgtcaaaatgagcctttcatatgaataagtattcttaattatatcagaaagtagaaatacagttagccaagccaccgggacacagatgtattaaaacatcaataaaagcagagctacattaaatgagaataactataagtcttttataaaattgttgaaagtttggatattttattatatcttaggcctcaagctcttgaccctgtccaaaacctctctactgtctaacaagtcttacaggtgatcctgaagagcgatgaccttgtaagacttacttagatttcaaccaacccatctctaagtgaccaagtcctcagtgtgtccttcttacaaccataaatcctggttgaccttactgaatgaatgagtacaagataggctcttgaaagcaagagaagataattcttcagtcctgatggtcactggaatgctctaaatgcttgtgtcctctctaaaattcaaatgttgaatatctaatcgccaatatgatgattttagaaggtggagaccttgggaggtgattagatcctaagggtggaccacccatgaaaggaattagtgatcttttaaaagaggcctcagagaagtgccttgcccttccaccacgtgaggatacagcaaaatggtgctatctataaacccaaaagtggaaccctcatcagacactgaatctgccagcattttgatactggacatctcaacctccagaactacaagaaattaatttccgttgtttataagccacccagtttatggtattttgttatagcaggccaaatgaactaagatggccaccgaggaccttttctttgctctgcatttctttatgaatgcccttgcccaagcttagcctttcttttttctctcttttgcagctttcccttcagtcatcaaactgactaacagtagaaggaaaaccaggcttttgattttggacaaactcatatacggagagaaccactttcaaaaacacagttaaaagagcctattgataactcctctgggagttagtctttatacatccatctgtgggacacgcacaggcagaattgtggaatatcacctcaaaaaagaaaaataagaaagcaagatcaggagaaatgagactggagcagaactgtcatgcactgatcatctctgtgtggaatgcaaaaatggatatggatattaaactccaggagatgttatttgggaaaggtgactgcaagaagtcaagctattcagagactatacctgatcatgaacattgttctacctgtaatcgtgctgagagaataatatactggtgagggtgtgagggtgaaagtattatcacatttgcaaagtataatgcaatttctctctcatggagtaaaactctccctctctctctctctgtctgtgtctctctctctttcctacctccactgttctagtagaccttgacattctgaaactggcccaactgtcccatagaactgatgtttatggtttctttgaataaacacagaaattgatcctccttgtcttaaaacttgagaaagttacatttgtcttatctgagttcttctctcaggaaaccaaccatcaggcctcccaggtagtatcaaggagctgaaacttaccagataaagacatctggacaatgagaagccagactacttacccatcatgattgcctaattgacaacttgcttcctgttgaccacttcctcttcctcacctcctcttctttacccttccctaattcctgtttccttacacctggttacatttcttccctctatataaacccctacttttagtcatcagagagatggacttgggactgattgcccatatccttggctgcagcacccacttaaagctttcttcactggcaatatttgttgtctcagtggattggctttttgtgtggagagtaacaggacctgaaccaaacctcggcattttggtaacagatttactacagaaacagacacggtttgatagcctgactcctagactgatcttagcagttcaggaccatcaggtgcagatttcacaggcagcatgtgcccttaccaaagatgtcgaattgggagagatgtgtgtttcatagcaaccaggactccaccttgatccaggtacaaaacactgtgctcttcttcaaagatctggatgaggaaaacacatacatggacacacatccacatccacacatacccaggcttcagagaatcagtcttcacatgagaacaaaaatccttcccatgataaaaataggtttccctaaatctttgcgaaaataaagctatagaacagttcttcccaacatgggctattataccattggtgttgtacaaaataattttaggtgtgtataaaataaatttgaacaatgaatatttatgggttcatgcttagattccttcattttcatgataatttctattgattcccagttatgatgatgtcagaatattggttaactgtcatatattatacatctctagacagagggaaccttagaaatcatttactccaatagtctcattttcataaataagaaatctaaggtttagagagatgtggtaacttgcctgagatcatgcatacagtaatggatagagcttggacttgctgcattacagtgccctttccagatcttattattttgaagtttccaactgttatcaaagaaaactgttcttgtttaattaatagatgttccaccaaaatcatggtgagttctgttgtcatctttgggtacatgtgtcatttggtctttctccaaatgtagagaaagaaatttgaagtcaaatggagacacaatggaaacaatctctagatcctttctgtataagatgcatgctgttttctcgtcagattattagtgtagccttgcctggagttacattacagacaatcttcttccaatttgtttatttcttatacccaagatgcaacccaagactatagaagtaaagacttctttgccttgcttgcggtgttggaaagaagaaaatgggatcctggctctctattctccagaggaagtttacttagaatagtccaggtttctacatacctccaagatcaattgctatggagtttcttatgcaaatttcttcccttcctcctccgctcaaaatatcagaatcccactgaggatctatagagggtctgaagctaagaaatggcatttggaatataatgtggacacctctgactaaaatttaaaggagagtgctctcatcactaagtgtgattacctgtgcattagatttcaatttacagtgctagttattgtatgataattaaacgtcagtaggttattaaaacatattgattgaagtataacaaccaagcattaggtgcatatcttgttaagattgctaaacctcattaaatgcctgttttgtaagctatgggtatctaattttcattcagaagaaaggcaggaagcacttaagctaaacacactggtttaaagtattccatttctactttctctaacatatgcatcctgatggttattactctgtcttttgcacatgagatttaaacatctcagaacaccacctgggtaatggccatttctatatctgcattccttcctattctgacttcaaggcaaggggaatttatggagccaactcagcattagatatgtaatctacccttaaggctgcatattccctatatgataaacccttaggaattctggttttcatctgtgggaaaaatttagtcagacttaatttggtttcattgtgacttataaacacccttacatacaagctctgagtaaggaacatctttattaaatgataaaaaatcaaattccataaatatttgctacactccaacatttaagacttttatataaaaaggaaaaataaacatattcacagtcattaggatttatgtgtagcaccgctgaaaaaagttcccagatttgaaccaagctgggcaatttttatgttacttaaacttcagcgatttgacccagggtattttcttacctgtctccaggtgttccctgcatctgaagagacaaacatgctgatgtcagtgtctgacaattcagaacctatattacctagaaagagaaaggtgccattagtgaaaagaactttctgcaaaagcaacaatggactatattggcaggtgcactgcctgagaaagattttgactgcaagcattctgtctgtgcaggggttttctgcagacttgcttcaggtccaatggtttaggtgcctttcaaaattatttttagcttgctcattaagttccaagtacagatatctagcttcttaaaataaacttccaagtacagatatctagcttcttaaaataaacactatttaccacagccagcaaaccaggtaagcttcttacctgatgccactatgatgcttggagctgtgtctttgctggcaatgatccctgatgtgtagggattctcagagaccttcaggtgaaggtgtagtgagcaatagggctgaaaagagaaataataagtgccacaaaatcacataatcaaaatggtcatttgaagctcagaatcagatcatccatccatctaaccaaccatcccatttaccatacatccatgcaccactccaaccacccattgtatctatacctacccaacatcttccatcccccaaatatctagtgtccactaagtgtaaaacagccttcaagttagtaaagaccaccttcattttaggtataatctaatttggtctttgtcattacagagcttacaatttatatagagggcatgagatccttccattaattaccataaaaagagaatcttttaacagccataaaaaatgaagagacaaaatagtatgagattctagaaggtggagagactatgctgaactttgaatcatgaatgactccaaaaagaaaacagtgcctgaagcaaagatggataggctatgaacagtaggtagatgttcaagacgttaaagaatatttcaagcctgagtaacagcaataacaaagaaaaagaagcagaaaagctgagcagcacagtatgtcatcagaaaagactgaagaggagaaatgggatatgaagccaggagagaaggtcaagtcaagctgggaggattttgaaaaagtaggttggcatctcttagtcattctccatttgagaccttggtctcagttgtatagaaaaagtatgtgaaattatccaaatacccgccagacaactgacccagtatctctaccaggatattatcagaatcagaaatattcaatataaaagtcacacttgtagacaaaatgcactagtagtaaaaatttaactgaaaatgtaagggacttgtttgtgcagaaacctcattcaaattatctgattgaaatatcaacagttttcaagaaaaaaggataataaatcttatatgaattttgtttaaaatagttcttgtactgagttgtcaaaaaatataagtttgtgtttgagcccacatttcttttcatatctcaggaagattactttctaatcttatcaacttgagtttctggaatcaccagtgtatctctgttattacttttattctgctctgtaagtttcagccagcagacattcagacacctacagatacaatgattaaatttatataggatggagtaaatgacaaagtgaaaatgaaactcaggaataaaaacagccagaacgctggtgaaataaaacagcagatcacaatgggatattttctttactgccaacaaagtaaaactctcaaggtgcactaatagtaacaaatgattggttttgcataaaaatttcatgtaaagctttcaaaaaaaggagttttgactttataatgttctataggactaaagaagacagcccctattagaagaaatatcaggcctagactcttggcttttatttgtccaagaggaagactagaacagatataattaaatgctgtggatgttccagaacagcatagtacaacactcagatgatgtaagacagggtaaaccaggagtgcaaaaccagttttccatgaaagtcttcccgataactgcagcctatcaggctctcctctcctctaatccacaacaatttgtttcactatgcacaatcttgtattatctatttcaggtacatacaattatatctctctaagaatacactctataaataaagataactgattaagtactgtttcgcatcttttgtgaaacctagcatagaatctaaacaagataataaatagaagcttgcaatatcaagtaatgcttttttgttgggacatgaaagatatcactttactattttactcagagcaatgccaggagtatgtgggctggattatcaaccacataatctgaataatgttgtgagcatctgtatggcattccaagaagtagactactgcttgcggattatccctagacatatgagcttaacagaggactttctgcaccaccaaacagaggaggacatccctagccaggagagcacccaactttcaatcttaagccagttgcttgccactgctggaagattttgagttatttgccacctgacctaaggattatttggtaaggggcagttgccattacaaaagaaagatgtcaggccgggcatggtggctcacgcctgtaatcccagcacttcgggaggccaaggtgggtggatcacttgaggtcaggagttcgagaccaacctggccaacatggtgaaaccctgtctctactaaaaatacaaaaattagccaggcatggtggtgggcacctgtagtcccagctactcgggaggctgaggcaggagaatcactcaaacccgggaggtggaggttgcagttagccaagatcacaccactgcactccaccctgggtgacagagtgagactccatctctaatacaaaaccaaaacaaaaacaaacaaaaaacaaacaaacaaacaaaacaaaaaacaagaacaaagaaaagatgtcatttttccattggctacctcagcatgcctctgttgctatggctttcagagggctgggatacattaatctgaggaaaaaagacaccagttcactcagtaacagcaacattagaaatgatcttttggtgtacttttttctccactctcacatttgtagtactggattgcccccagctggtataaggaaaatattctgtggcttttttctttcattttcttcaaggaagtaacatagtctacacaaatatttaaggaaaaaacagtgtgaagtgattcatcttcacttttttaacttaagctgttgtactgaccagttttggacatttgtccaagttaagtcataaataattaatatagtttatattagtatattttattataatgcttatcaaacccctccaagtttctgaaggacacaggacaaagctctccagtccttatgcacattttgcccaggctgggggcacatcataggcccctctcttcatttctcttgtcttctgccttcttttctctcattagcaaatatgtgctgagtacctacatatgctaatagtcacaatagttatctccaagtcaatagagtcaaagcacagcctgttccaaaggcagttctctattttcctgacctttccacattaagaaaatgtagaaatgtacacccaaaccaccaatgccagcagctgacctacagaggacagaatgaccagcacacatgcttggaagctgccctttgcatcctcacacatagtcacaggccatggcatatcatcaattggtaaattctaggagcaactagactgttagtctgtaatcttttctgggtcaggtacaaagtttggggatctgatgcaaatgaaagaccaagaaaaagtgcacagacacaaccatacagagtttttcacttaatttcagggagtctgcaaaccccgaaacccataagtggacctctagttactagttacctttctttgcctgattcttttaaccaataaaatactttggctattccaagtgttcaataaatgtctgctgaatttaactgatccattattattgtttacttcaaatatttatcatttattcctcttgtctaactgaaacattgtaccctttgaccaatatctccctatttcccccaacttctagcctccagtgactaccattctgtctctgcttccatgagtttgattgttttaggttccacatagaagacagaaatgcagacttggtctttttgtacctggcttatttcacttagcataatgttctccagctgatccattaattatctactgtgtttctagcattgtggatcccactggggaattaccataaaatggaagacatttccccaccatgtaataaatcaactttaaaagctgttatattacttaagggtcaaccagcttcaaatcccaattctttctcctcagcctctgtatcaactgcctttagatgctatcttcatggtacctttatctccatggtatctaatctgaatattgtactgaaaggacagatcagagcttttgtaaagaacaagctcccaaatagtatccccaacactctccctcccgaaatacatactcatttgtataatttctttctttgagttggaactcaaatttattacatcttcaataaagagtcaacggcaaagaggaaggaggcccctggaacaactggctgggtatggggaattcagctccagcccaaatcagcaaaatatatagagtcacagacaatggaagaaaggtgaaaaacagattctccaatggaagaaaggtgaaaaacagattctcctggggcagctgtctgctcagctccagtagcaaactgccagataggccgggcacggtggctcatgcctgtaatcccagcactttgggaagccaaggtaggtggatcatgaggtcaagagatcaagaccatcctggccaaccaacatggtgaaaccctgtctctactaaaaatacaaaaattagctgggcatagtggcacacacctgtaatcccatctactcgggaggccaaggcaggagaatcacttgaatccaggaggcagaggttgcagtgagccgagatcgcaccactgcactccagcctgggtgacaaagtgagactcagtctcaaaaaaacagaaaagaaaagaaaactgccagatgaatccacaaagtcagcgcctctttccattaaacactgtgctttccctaagggcccaaggatttgtcacaggctcagttcagctcacatcttgccccttgggagcccaatcctgaggcattggacgcaggtggaccatgacctgtaatattctatctaattgtacaatgcagtcttcagaggaaagaaatcccagctgggccctccaggcaatcagtctaaaagtcctaaaaatatagcccaaattaccctagatgttttatttctatagcatagatttttaccaggaacactgcattcgggctgcaattctgaacttattccacatctgtaacagccctgctgaaaaaatctcttttctaatcactaggctgtgctttcagtgacactgtcactttccaagtactcacaatcgaaatcactttttatctcatctctgccaccagctcccaagcctaaagaaggtttttaacagtcttcgtctcctgtagctcaaagattttctttcctatttagtgcctttggcagatttttgtaaagtgattttggtctctcctccctgcttccctttgtcattttccccttctcacctgcagcctgctttctgaagctcaggttgaaactacattaaacaacagggttaactaagaaggaaggctggaaaactcccgagttccatacatctgtgtcccaataatccctctttcttccatcttaatgagcttcctgcttttgttaactttgggttccacttgagcccacgagcttcagaaggtagaaaatgtgacaaatcctccagtggactctcagagggaatgaacagcttccattaaaatccaaacgcgaaactgtcacaacacctttcgatggagtgcacactcccaacgtggcacccctaatgttgagcccctaccacatgggttgagcccctaccacatggcaggtatgattcctggagttgattctttggagtggtcaaaaacacaggcaccgtccctaggttcatgaagcccacacttcagcaggcaagatggacaagaaaattaagtagtacacctgctcatttcagataacaataaggaccatgaagaaaaaaagagttaagacaaatacaactttaggggatgctcaagaaagttctctaaaattaagataatgaagcaatgatctgaaggccaagaacaagccagacaaagagaagggcattttaagagaaattataacaaatgcaaagaccctaagagatacatgaacatggtgagttcacagtatgcaaagaaacaccccctcctccactctggcttacatataaggaagaaggggaggagggagaggctggagaccagggaggagaactacacaggggccagatcacatggggcctcatcggtcatgataaagtatttttatttattctacatgtattagaagccattagaaggtttaaggaaagaagggatacgatctgatttttcaaaagttcaagttgataacatttacacacaattttaaaaaacagcaatctgatatatagtaaaataaagtggatcattggttgtgctgggctgagagtgtgggttctaactgcaaagaggcacaaaggtatttttcagggcaatggaaatgttgtcttgattgtagcaatggttatatcggtatatacatctgtcaaaattcattgaactatactcttaaaatcggtatgtaagtatattttacctcaaaataaagttgattttttaaaaaaaatggtcccattggctgctgtctagagaagtgattgccaagtaaaagtgggaggaccagttagaagcctgccactgtggatcaggtgagcaacaatgctggcttggattagggcagtcccagtggtgatggggaagtaagctgatattacatttatattttggaagtacaacaataagagtttctgacactgcgttgggggtgaagcagggaataccttgctaagtgcttaaaagccatttttaatggttcatttatgatgccagagtccccaggcaagcccatttaggtgacatggttaattatctctcataggcatttaatctccaaagtgcagagtagagaccagcttaaggaactggcatatcccatgcatctttggttaagcagcactacgctccaacttgctatagctgaactaggaaggtggccctgttttttaaaatgccaccaaactgtgccttgcgtagagtaggtattcaataaatagctgctacatttacttactctgtcactggcattgtgcacttactataacaactggctttttcctcctcttaagttgccagtaataaggatagaagctgagtgggaggctgaattttagactgcttccctgatgcacagtgacaactgtgatatcctctgcaactaataaggtcaagctatggctgctggcatcttctcaactagaagggtgacccgcctacagctgtaagagatgaacctgcaaagtgactgtccagactttatgggatggaaggaagcaagctgagtgcggataacatcaaagtcagaaccgcatgaagagtgtgaacaactatatatgtgtagttcatacacacacaaccccctcccctacaagcccttcttactcaaatgaagtggtcctccctctaggcttacacaatcagctgtcctttttctaaatgtagacacaacttctgaagtgttttacagacattgatagtattaataatgtttgcaatttgcaatttgcctcttcctcgcctccttctgcattcactcattacttatctgtgtgtcaaaattggggcaggcatcagagctactaagaggaataagacgtgaccctgcaatcttccatttattaatctagacacattcaagtagacaagtagactgcaaactccttgaaagcaagattcatctttgatcctccttttggatgccatcatatatcaaatatataaataaattcatactaatctatatactgcccaaatgtaaggcaactaaaagaaagccatactttaaagtaggggtcagcaaacctttgtaaagggccagataataaatatcaggctttttttgtgatacagataataaataccttggcctttgttcaccaaacaaagtctctctcgtgactactcaattctgcctttgtagagtgaaagcagccgtcaacaatacatgaatgaataagcatgactgtgttccaataaaaccctatttagaaaaacaagtggtgggccatatttttcccacaggctatagtttgccaacttcagttttacggagtaagacataaatgaacagaatatattgtaaagaataccaataagggtataaatcagtggttcttaccttttttgagtcataaactcctctgaaaatatgattaaacatctccacaagaaaatacacctacacgactctgcattcagttcatcaactctacagctgaatttatgtatcattagttctgcaacaggttactcatgagaaaataggttgttcagtgtgtatcctcaccagggatagaaactgtcatattctccctcaaactaccatttgaggccctcatcagaacttgggcgggaaacaaggatcctggaagggcacaagaaatatgcccatgttctcccatctctttggcacatcacactaggcagtgctgtgagttttctacaccctttgccttcacgcccttccccactcccttttgttcatcaactgagcaaaagtcccagaactatcctcaccctctgttaaatatccatttccatccctctactgtgtgaggcattctgcttcaataggaagactcaccagcaagcagtgcacggggtccccccttagatccgtgtccggcgcctgcagcaaacgccagtctctgcctttgttatatgtgatgaaagtcttcacttggttgtcaatcttcttgttagccaagaacattccctttatccctgctacctgggaaaaattgacatggctgaaaaatacatcaatttgagaagggatatatttgtttactttttaaaaaaagaaggctgtcaaagtcagctgagagcacttgccttggaggaaagaaaggttgacgatgggggaaggaggtggctcaaggtataatgacttcctaggctactggacaaacaacaacagattggtgatccttatcatatgggggtcacaacaggagtttgataggggtttcttattacccctaacataggctgacaggagcccgcagttgccaagagataaattctcatggtttcagctctgttgcttggtaagtaataataaataaataggggctacttctattgtatgctagtgtagcacccagatctcacttaatccttaaaacactcctctttggtatcgtttattctatttcacagatgaagaaagctcaggctcatccaaacaaagtgacttgcctaaggtcacactgcccaagggcacacagtaagtatcagactcaggattattaacccacaactctgcggcttcacagctcatgctcttaatgcctacctcaattatcaagctatctgcaggcttgggcagttgaaagaggcagttaaagctcctgaaccaattactgttgctttatttctatgtaagatctctctgttaagccaccagaatacacggaacataagaggacagcttttaaatttaaataaatggtgatttccctaaatcatcaaatactccctactttgtttttataacatggttgttctcagcctaaacagatgctattaattatttggctctgaaaatatgattgtctcctcccttctatatgttaggtaagaagtagtaattagtaatttgtcaaactattacaaaagcaaataattgtgcattacatttttcttgtgttttggagtttatcaaacacattcatgcatattttaccctgcttgcaactgtaacagctcaggaaaactggagggcagtgaggaaaaggactgaaacatgttgagtaatgcattccaatgctgcatgtacattacctcatttaatactcagaataaccatggaataattatcattagccacattttgaggatgaggaaatagatactttgacttggtggctttctggaacacacctagggagtaagtgagcaggctagcaagcctatttgaacctacttaacttgggccctttataacacgaaaaatttttaagcagaatagtgaagcaattagctgtcacctctccagacctcgccaaacgccaagcactatgtccagcattttatttacaaaacctccaatactcactacaaacctgcacctgcagcttttaccccaattctacagataaagaaactgagatcacagaaagttgagattcacacccaaatctgcctgacttccaagattgtttcaacaaatacagcttgaatttgtcaattctaagaggttgggtttcaatcgatagaagacacacattttgcctttgcttttgacagtcagacctcattagtgtgtacctgctgatctggcatctgggataatttatagttgggccaaatttgtactcttttgaaacaacaagcatgttaaacaactaaatggtataaatgagctgcagagaggaatactttgaactatcatactcaggaaacaaggtgcattctgtgcaatcagtagcagccagaccaacttcttgtgcattgtctaaactcaacaaatgtggaaggcataaactccaggagcactctacctcacaacagcagtgtgttaattacaaataatatttagtaatttactacaccagctccgcaagggcttcccaccagggaattccatattggttttgtatatgttcaagaagctgttacatactcaaatatgaataaactgccagttctttaaaaaattaaattacgtaaatcagaatttcacaaagtcatactggtccttcctctataccattcccagaaatgacaaatgaccatgtcttagccattcaacactctaaagggtgacaataactgcagaaggaataaaaatgttacctattccagtagtttcattgcccattttccttcctgccctctccctcttctggcaagggtgccagcgcagggttatacatgtttgggagctggttcatttgattcgcagaagtggcgactttattggcccccgactgcttggcattatcaaatgccacttgagcaaagagctgtgctttgtaattcatctctggcagcttggccttcaggtttatcttgaggaataaaaacttggcaaagtaaagggaatgtgtatcgacaggggatagagctggagagggtctgcttattgcttattttcctcttgcagccaaggcactttgtccatttaaggtagggttttttattttgttgttttcttttgttgctttggcctggtctgcaaatgtagtcagccctagtcttaggtttttgtgctattcactgttcctttcactctgagcttgagaaatccgtctttctgtgtgtctcacggaaacccctaggcacgcacaagccaccttcttccagtactctattctaaggtctcatcctacgtttcttggaacctctaccctctcactgtaggactttggctatcaaggggactaataccaagcattagtgccccaaatgtggaatgtgtgtgggtgtacatgggtgtacctgtctatgcatgtagtatatgtctctctttgtgtgagtgtaaggtctgaggttccactgaggatgagggagcatgtttatgtttctagataacctctctgtatccatactgcatgcatatttatggaatagagtggagctaagggatggggtagggtggggtaaagtaatatttcctacggaagccatgtcttcccatagacacagaatttctgatgacaaacctcccatgggaatggtacatcccactgttggaagtctgtcctcctttgggaaaagaattgttgcctttaatgcccttctgaattctgcataaagatctttaagaattctaagtgtgctggaatgctactttagtccctttgcttctcctacagagaaatttgctaccagacatctcaaaagtaattaatagttatttcttattatttaatatcatataagtcaagatatcattttaattagactaaatatgaagtgttatagctcaaaccttaagcctaacacaaagtacatcggtgcatttcctgttgccaacgtgatggtctcagaacacttccttcccttctcttatctgactctctttgttcacaaaggccacccccaactccctgagaaagcctcctgatgtgcctctacctattcatccttaaagattcagctcataaaccttttccaaaaaccaggatctcttttcatcctgattatcccaacacttctctgttctttaatttgtctctcatacagatggtatctgtatcttgactgtcaagaactgtgggatcttcctaggggactcaatattcctgtaaacatctctagtactccttatgctctttatcataaattaattccaatttggtcatcccctgtgtgacctctcacattatggtctcctactctaatacaaccttcggattgtcattcactccaccaacctgctctttaaaattaataacagtaaagtaactttatacaaagaaccctgtttgtttgtttgtttgaaacagggtctctctctctctggcacctaagctggagagcagtggtgtgaccacagctcactgcagccacgacctcctgggctcaagcgatcctcccacctcagccttccaagtagctgagactacagttgcacaccactatgcccagctaattttgggttcttttgtttgtttgttttgttttgtttttggtagagacagggttttgtcacattgcccaggctggtctcaaactcctgggctcaagcaagccacctgccttggcctcccaaagtgctgggattccaggtgtgagccacagcgccagcccctgttttttttcctactgaaataggtagtaagagttctgcattagaaggtacaacacccaagcctctggtaaccacgactggggagaagatgcgaggaggagaaatggggaatgactactaatggttgtggagcttctgtactggacaatgaaaatgacctaaaattgtggtggtggctgtgcagctctgtgaacacactagaaaccactggattttacattttaagtgggcaaactgtatgatatgtgacttacatcttaataaagctgttttaaaggaaagatataacaatccaaatttattgattattaaatttcaggtaccagaggttgaacatccctaatccagaaatccaaaatgctccaaaacttggaatgttttaagcactgacatgatgctataagtgtaacattctacacctaatcatatgtgatgggtcacagtcaaaacacaatcaaaactctaaagaaaagaaaaatatttaaggtgatgaataatctcaagtatactaatatgttatttactaattatataaatgtattaaattattatatataccctgaaaatgtgtgcctattatgtaccaataaaaaataaaaaataaatttctagaatacaaaaaaactgtttaatgcacaaaattattaaacatattgtttaaaattaccttcaggctatgtgataaggtatatatgaaacataaattaaccctgtgtgtacacttgggtcccagttccaatatatctcattatatatatgcaaatattgcaaaatccaaaaatgtctaaaatctgaaaccctactggtcccaagcatttcagataaggtatactcaacctgtacatgaaaggctttgcaaacatgaacttgtgaatctttgcatgctttagaattcatattatccttattttacagaagagaaaactgaaattcagatgtggctaatcacttgcctaaggtcatcccattggagaatcttagatctggactccaagtcagtctgtctaactacagagtctacacccttaggcctgtggctgtactgtctcttcgaacttctctctcatcctagagtggcctgagagaaatatcgtatcagaatgttctactcaaagaaattgtattttattcagtcgttagtacatttactctagccattcaataaatattttctgagcatctactacgtatcatatgatcttctaggcacttggcagatataatatgtagaagatctcaacaactatcttttttgagagttagaatgtgctaggtgctgagaattcctatttctttggtgacttaaagaaaaaaacacaggtatctcccttgctttttaggtttactttctggatggttctgtcctgttcttatgggaatcagtcttcccataaatatctctagtacttcttatgctctttattataaatcaattcaaaggaacttacatatttgtgtaagaaaaccttttgtaagttccatgcagaggctaagttgggaagactcctgtgcaagagtttttgcttatttctgcctttaatgctgactaaaagatgaatactacctaccaccctctcagtctcagacttaaattacaaatcctaagtgccaaaatttcaaaaaaaaattaaaaagatgaaacaacgactgtggcaagaaagagaacatattcatggccacaatttctttgggctttgtggatgggatatttttctcgagaggacaacaggaaggataaacatgaggccggggtgccttcacaatcagggaacccactggccaagaaaaacctaaatgttctttccttctctgttgcctcaaccaaagagcactctcctcctcaaacagcactctcctcctctagagacagtagcctgaaataatagtacattcttttattattattatttttccttttttgaggaggagtcttgctctgtcgcccaggctggcaccatctcggctcactgcaacctccacctcatgggtgcaagtgattctcctgcctcagcctcccaagtagctgggacttcaccacacccagctaatttctgtatttttagtagagatggtttcgccatgttggccaggctggtcataaacacttaccctctggtgattcttctgcctctgcctcctaaagtgctgggattacaagcatgagccactgcacctggccaatagtacattcaatatcctgtaataaatgtatcttcaataggacagcatttttcttccctacctcctaaactagattgtaagaggcagtcttgctccaaaaaatcaagatgtatgctatattatcataaccgttgagttttctcttttaaagagagggtactcataacgtacagaagacactgtgtgtaacagaacatgccctggtcactggctgtccttcatgacacccaccagggctcactcatgtatgcacacattcttgtgtattctgaatttgtcagccaggtggcttcactcccaacacaaccctttgcactcagctggggtgaactgtcattgtctattaagccaaagtgctcttcatcatcattaattaatattcacttcccaaaggagagaaggtaccatccaaacctgtcaggctccctctcatcatccacactacacaaaaccatcaggcatcactcttctcacagacactcagcacattttttttttgctctggccaccatcagacatgcagcctgatgcactgcatgatgcacacgatgcaccggaccattcattctattcaggtgtgatggagttttaggacacttgtttccaggcttttcttacacaaatacatccacccgacaagactgtgagccatgtgtaaatatagcctgaacttagctgtaactaaggacttggtactaaaggtgctgcatagataggtctcgggcaatcaaacttctgattctctttacattgacttttccccagatcattttcttcttccagtcttctgttttcactggtatgcaaagtctaaccctatttaccctgcccttctacgttcttcagtcttaatgctgtcactcttccacaaccaaatacaagcccagatgctgatccttcaggaaaaatgtgacagtctatagttgagagtttgcacactctagggtttaggtcctaactctgccacttaccatctttgcggtcttgcaaaagttgctgtattccctctgcctccatttacttatatttgaagtgaaagtgacaacagtccctacctcataatgtatgtactgaatgggagagttatggaaggttctttacaccatgcctggcataaagtggcccaaaatattagccattattaatgatatcaattaatgatattaatgataacaaaattcatttctagtatttttgctctgtggccaactttcctggctctcatttcttggctctcttgaatggagtccaattgacactgatggaaaattctgatatttcaataactaaaccatacaagctgtaccctcaacactttgtctccagcatttctctctctcattccacacacacacatagttctagggtagagaacacagaatctgtagccaggttccaatgtatttgcaaacaaaatgcttaattttaatgagcacagtgcttccttctgcattttttagaaagacccgtcagcaatgcacatccttgatacacagatccatctacatgtttatacattatacagttcacctctgctaaaatagcctgaagagctcacaaaggcaggaatagcacataattggcatgaagaagcaaacaaagaacaaaggccatcctcttcagtcaccccaaatgtgagcagacatgcactccatgtatgctatctctgtaacccccacctcatgtgttgctcatctttgctccttagtaattcatttatggattttcttacttctcatttatctctaaactctcatcattcattgcaattctactgggaaattcatgctggatggctttcagcttcctgctagccagaacaatcagatttaagggaacatttgtgccaggctctgtgtcagccaatattctttctatctaggtaatcagcagatacggcactgccgttctgatcacatcaatttcaattcaagttgctgtgaactgtcaggctaataaaacaaagactcctctctcccagccccaggatgcagagcacctttacataatacagtcacatcactgctcaaaatgatgataataagagccagcagtttccctacagatagtcaactgcaagagaggcacaaaggggaaacacaagattaacaaagcaatgtttggcatgtccagaggtcgccttgtttcctcttttcatttcatacctgttaccgatgtttgaattcagaaaactagtcatgaaaatagctgcaaacaacaagacattgcaaagtcattcctgtctaaatttgtcattttttcatcatcaagggaccaattaaaatggtttttatttctggcagtaaacaaaatttatccagagaatcaattccatgttgacacaaaaagagggaagaggataatcaggaaggggaaaatggaacctgaaagtcagaatatgtttttgggagactaaggatagaacgagggctaggaaagaaaactggggattaagcttgggcagttgctttgacttcatgccagtggatgctcagagcaagaatccttccatttcaagtgttcagtcaaggcaagaaaatgcatggcatttcaacaaaacatacttcaagttaaaatgtttataatctatttacaaatgaaaagagaaatgttgcaatttacacttatttataagaagacagctacttggtataggccataatcccagcactttgggaggccgaggcgggcagatcacaaggtcaggagttcgagatcagcctggccaatatggtgaaactccgtctctactaaaaatacagaaattagccgggcatggtagtgggagtcccagctactcgggaggctgaggaaggagaatagcttcaacccaggaggcggagattgcagtgaaccaagatcacgccactgcactccagcctgggtgacagagtgagactccatctcaaaataaataaataaataaataaaagacaactacttggtataaagaatgtcacgtggctgcactaatttcagtatgggaagatgtaggaatccaaaataatataaatgttttgggcatttacacaatgcagggagatgttaaggctatgagagtagaagaacactgtagtggtgcttgaacacattggaaaataatattaaagccctgtgctccgtgctttgaaaggattaactcatttaatcctcagaaaaatcacatctagtaggtttcatgtttatctccatattttaagcaacgaaactgtggctcagaaattactggatttgtctcaagaatacatacaagtggcatcgctaggatttaagcacaagcaacctaaatccaaaatctgtactctaaattaaattttattcaacatgaagatgaaactaaatcatcacaatatgtaaatttcttctagaatacagtctgaggctgtcatacatgatattgtatttatctgaaacatgggcaggagaagaagtggaaaaacttatgaaagtatgaaaaagtttgcaatgcatttttctaaacatatacacataaactagaccctatgctagtctgccataatttctattacaaatacctgggctctaaatttggcatacagtttactaacatgcttttatacatacacagaagtttagatactagaagaaaatcactaagaacctctgaacgagaaggaagatagaacacatcattgaaaggaattacaatgataggttaaaatttcttaagtgaaattagtttctttcatactggatatacccttacttcttagacaaacaatctcttgactcactgctcttgttctcaactaaatgacagtgtcattatgactgtacatatctgaatccattttagatttttttcagctagaatataggtatattgttacacttcccaaattctgactgttttcaaatggcttattataacctattataaatctttcatagcgcatgataagagtaacgaatggctaaaatccatgccaaagcagcagttttctttctagctaactgtgccttcaatggcaattaaagcattggtatttatcatgaaagccaaccaatccaacatacatgattttcttttgaatcttggccattttgagaaataaagactctgctaagctctgttcttgatgttgtagttgtttattttatttttctggatttaggagacaagcacctgttaatcttatctcattctctggccctgtgagaaaaaggccattagccaagggagcttatttaaccagaaaggtcttcaagtccaaatggagtgtcttctgctggatgcaggagaccttatccccttcattctttcttctgagagacaagggagtgcatccaccatccctttactcacagccctgtctgcctttcagaactatgtccaaacatcacaagcagaccactctcatcaaaccctgtaattgactgcctccccagacattccgcaagtccacaaagccttcatgtcctatggagtttgtcaaaaaagaatccctcccagaatcccccagagatcttctgtggattgcaaattaactaataaaaatgttctgcaaatctttccatctcccaagagaaatgaggccacataaggaactgtattaaaatgaccaggaaaagagtccatgcggggcttccatcagccagctgggcactgctgtggcttaggaccacatatgcctcgtgacatacctcatagaggtcgatcatgatgttgccctcagggcctctgctgctctggacattctccaaggccagggtgaagtagacaccacgtgtgtctgagatgtagaggttgtacgtgtcattctggttccattcttggaccgctgcgaacacctgattctcatcggtgctgataacatgcatgtcctgtgaaaagacacaaggtcgtgaagagggaaaaagagttttatacattaacctggcaggcatccaaagagtgtggaatcaaatgaggaataccagaatgagcactttaatggaagatagcttccttttgcatatataagaaataatagttaagcattaatcatatatttcctttgtcacttgtggggttaggcaataaggtcatgagaaaataggatgaagggatgtttgatagaccagttttaattgcctcattacataattcgaaaaatgctttcttaaatatgtatgattcggagaatcaagcatcctgatatttttgccaagcacaaatatgatacttgctcagaaggcatatatggggtagatatgaggaaaagctggaggaacagagagaaaatagacaaaccctgcatgtctcagcatggctcatggaccagcagcaaggacatcacctggaagcttattaaacatatagaaccttgggcctcacctggtgaatcaaaatgtgcatttaataagattgctaaataattaccatgcatattaaagtttgaaaagcactgcccaaaggttcagcaacccctagccagtctcctctaccctcagccctaagaaaacattcaccagagaaacccaaagtactaaccctcatgttagtgtgttcaaagacttagctgcttatcaaaatctaaactgagaggttctgcaggaatcctccagtgaaaaagggtaaaagatagcctgcataactgatgatgttttcagagcctgtttgtcctggaagatagaattaaagcaaaggtagcgcggaggcagtaacaagtgcccctggggtgggaatttcaaattctttttcccccattcataactctagagaagtacaatggaagctaccacagtccaaagcttgctgactcagaccaaggcctgctttcttctttatgggatgtctgttcatatgctctagcctgcattttaccctttgcccaagatagtagtcataaaacaacttccaaaaaccaaaaaaattaaagctaagtaaccaaaacaaacaaacgaaaacaaagattgcatataaccacaaaggtagaagaacaacgtagaacaattcttgttttcggcatcacttagtgctctaatctttccagatgcaccatactctatttttgaaaagctttaggaaatctgacaatcttcctgttaacaattccagtgcggggaaattccacctaactactaacctaaatttcttattgtcatatatgcccatgttctcaatcaagcagcatttcagctctgactctcctctagacgtgtaggaacaagactccctatcctctttaccgtttatcacagtaaactcgtgatcccagagggagaagtccatatccaaagggctttatattcctcacctctactcaggttccatatgacatactcaagtttggtaacatttttgtagaaagaaccccaagtggataggtcaaaaaatgaatcctgcccattaatttaatgtgtgcttctatctgttgaatgtctatttacatttctcctggtaattattgctctctctaggtatctgcagggggattggttccacaattgccctcagataccaaaatccacagaagctcaagttccttatataaagtggtgtaatatttgcatgtaacctatgcacatcctcctgtacacttcagatcatctctggattacttacaatacctaatacaatgtaaaggctatgtaaatagttgtatcatttatttaatttgtattactttgtattttttttaatattttcaatctgatgcagaacctgaggagacacaggtccaagtgtatggattgatgttttttgaaaaacagcctcatccctctcagatatatttctatattaaatctaaactttttcctactttcttctaccagcagcacaagaaatgagcttttagaaccggctttcagaatattccatttctctggcaacagcaactgaataggtgatgggcaggtggcccacataaggtcaatatgacatgtttctggaatgactgcggagttattagggagagacaaaattagtatctcactattggtttttaagcagtaagaataaaaaagaaaactccagatctgctggagatatatcttggaggtaaaggatgaaaccaatcctgatgaaaacaggctcagcggatggagagagatggcccaatcctgtgacatttttttggtccctaaatgtggacatttaagaagctcatcccaccgccagacttttcagttaaagaagacagtctagtaaagtggctgaagaatggactttggagtaaaactagttgagttcaaatcttggctctataacttagccatgtgaatgaaactctgtgtctcataatttcaatctacaaaatagagacaaggataataggtcccccatggagtggtgaggatgaaatcagttaatcagtgttaagcactcctaatagtgcctggcacttagcatatgctctaggtatgttagctactctcagttaagtgagcccttacatcccttttgttgattaatctaggttcatgtgacctttctgtttatcgcaaatactcaagtcctaactatatacacgataagaaagtggttcacccaagtgtttttgttgttattgtttaaaataaaatttaaaattctttgaaccaggagaagctatacccaagtgtttggtttctttctaatggagagacttgtctgtggaaattagctccagagctgttcctgccttgacaaccaaacctcccatggctccccatcctatagggtaaagacctaaatccttaccttggccttgagaaacatcaaacaactattcccaattcatcttcccttctttgtcagtaagatgcagcatcatccctgaagccaagttaaaatatctcaacaataacctgacccccgcatagctaattcccacttctgtgatttacaatgaatctctgcactggtgaacctctgagtttctcacaatagacatttgattaaataatcctaggctggaagagtaaagtgcatcacctataccggccacttctcccaagactttattttgtagatttggataggaaaacacagatgtatcaaatattgtggtctaggtcacttagagaactaatcacacaatgataacagattaaaatggccatctctagatatgagctgagttccaatccttcctttgtttcatgtaattatgttgtacagccattttcaaatgatattggtcttaaatagtttaattgaaaagtttaaaatatttatatattatccttcttttttctccttccctaaatcctgtttctattgggagaaatgcgctttttctcccaatgtggcactttatgttgaatgctttaaccgaatcacagaatttgagagcaaggtgtgatcttacagattttgtattgaagcattttctaaagtctgctccataggacgacaatgttgttaggattttagtagacttgaaaaggaggaagggatcctttggtaaaacatattaattaatggtgaattaaagagctttcttgcttattggatgttctaaaccttcaacacaccagtgagctactgttactctctaggcaagaaacacagaatgaagtttattccttttttcagacatatttgaccacacaaccaaattctcaggaaggattactaaggacattttattctaagtaacacatatgagaaaatattgttgtgaatctaagctccttatttaaaaaaaaaaaaaataaagaaaagagacattgacaaaccagcccaaggtttcaaagcaagttagtgacagatctgggtccctaatccaggtctcctgctgcaaatcaagcagccttcacatcacctgcatcctggtccacatcgatcttccaccacggagacaactagatccatactaataataatattaccttgcttttatagagtatctgtcctccaaaatgctcaaagcactttcgtatgtattgcctcatttatctcacttgagtagctcagaatgggttcccagcaagttaaaagaaggaaaactcattactttcccctgtctggagggccacatgctcttaatggcaatggcaatattaaaatctccctacccactgtcattctttactattagtaaatatttttttgagcacagctcagggtgactatgatctttcaggagttgatacaatggtagtgggtgattaaagaaaattgagcataaaagtgctggtttgtctcaattcctttggtcggcatgaagctttgttcatttccagttgcaccagccctgacaggccatgaaatatatgcacctttgttgcagatcattccacccaagctggggtttctttttgaaggtataatgggattgtaataaagaatctcattgccttaaataataaacatccacccggactaaataatacattcatctgctgtactagcccctattttttctgggaacaagctaaattaatcactgcattctaccctcagaacccagataagactgagtaatggaacatgctcttctgggagaacaggaggaagaagacagatgcaaatttgggttcaaagtaaaactttttccttccatattggctagatgccactgcgggcaactgtcagcagtgatctgtgtgatggctatgaacaagcaatgcaaagtatctgtttcccaaacctccagcaatgagtctacaaacatttctttgattttaaactatgatttctggggctccttaagtcaatgggattttcttcttaatgcccctgacagtatatggaattttgatggggtgatgatgctatgttttaataacagaagctattaatttactaagaaagtataatataaaaaagtactaccttgagagtcaggagacttgagttctagcctcaattatgctacaaatagcatttgatttccaccaaaacttatgtcacttaacgagtttattaccggccaggctcagtggctcacacctgtaatcccaccactttgggaggccaaggcaggcggatcacgaggtcaggagttcaagaccagcctgaccaatatggtgaaagtctgtctccgctaaaaatacaaaaattagccaggcttggtggcacgctcctgtagtcccagctactcgggaggctgaggcaggagaatcgcttgaacccgggaggtggaggttgcagtgagccaagactgcgccactgcactccagcctgggtgacagagcgagattgtgtctcaaaaacaaaacaaaacaaaaacaaaaacaaaaacaaaaaacagtttattcccaagagtgcgcataagatgaggatatggtctccatttccacatcccccttgaacaacagcagcatgtcattacattgaggataattctttttttaaggtgcaaatcctgcaagtcaactacttcatttattagtcaatcaaagaaacaacaatttatttcaatgctcaagaggaaaaaaacaaaacaaaacctggctctgttgtatttattgagttaacatgttcatttctctgacagaccttcctaagagattatcagaggtaatttgaacaacactcagttttccttttacatagtgatgttatccaattctcatctaaggcacaacttaagtgttgtaaattcttgtcttactggagaaaaaaaaaacaaacacttaagccaaatcaagaacaacaagaacttaaatgtatccatacacagacatacatacagttctggataattaccacagtcattaatctctcagcagctgaaaataacaaccacgaacatagctatagttctttcaagttaatagtgcaactcagtgtgtgttattacctctaatgggctgaggcttacatcccacctttcactacgttagggtgagggaagggtggtagccaagaaagagaattcatcctggagaaaccagaacaatctgttaccactggctctcccgggagaggaggcgtgctgtgtccttgtgttatgtctattatatgacttcctgggcagctatctggtgttggttcaagacaacatacgacaaagtgatggatgaaaatataagagaaagaggcatggcaactcaattaaaaaaagttaggtatgttctttgtgcaacccaaaggcttcaaagttgagctataactctctttaaacctgcatagtccctttcttatagccacatgcatctcccttgctctaagattaaggcacagtacatttacagttcctagtcacttcaaatacatcacgatggcagcaagatcgcaaatacacagctctgagctcccgagtcagtttgacctccactaggtggcgctccatattaacgcagttcttcagcacttctggaaagacagcctggggatgtcaacagttgagggtctttaacttttgtttgcctctgttttccaaaggatatgcctttggggaagtctaaaaaattagctgcgactcagaactctaaagacaaccagtctcataagtttacagggagctgactggctgagaaagcaaaggctggtgccacgtcacggcatcactgctcagtaaacaactgataatcaaatgggacagaaatggacggcagctgttgcactgatacataacacatccaaaaaatattttctgtcttgttagaaaaccaatacatatggcttgaaaatctttactattgaaaagcaaatcaattattaaaattcatatgaatgttcctatagcaacaatctcagagacagagaagaaagaaagaaagaaaaaagaaagaaagagaaaaagagaaagtaagatgaaagaaagaaaaagagaaagagaaaaaaagaaagtaagatgaaggagaaagagaaagaaagaaagaaggaaagaaagaaaggaagagagagagagaaaggaagggagggagggaggaaacaagaggagggtaataggactgaccaaagagacagtaaggcagagcaaacttgggaaacagagatgagagatgtaaagaaaacatgactatgagaggctgaaagagtccttgggaaagggatggaggctggcttctgtgaatgagagtcaagagtgaaatgaagaaagtgatttaggccataccttgggcaaagcatatttcggaagcttcatttgggcaaatgcattccttcggtaggacacgtagtaatgtggccgccctcctgatgtcagctggatcataaaaacaagactgtaagaagctcgagctactgtaacaggcacaggtcacagaacagtcacctgaatggaaggaggaagcttccaacacaacaaatggcattaatgtctattgcggacaagtgtaaagaattggccttcagttcaaacacaacttataaagacatatgagctggtcagcggcccaaactgaacctactggacaaaaatacaattcttaagtttgcactgtgactcagatgccagaaaacattttgagttatttttttcaaatggggtacattggctgattgccatcaccagcccaggtctctagacccaagtctatgaccctacaagtaggtccctgtgccatatcagaatgaaatggcccaacccaaacagtggcagagctggaggctcacatctctgggcactgaattccagtttgatggtgttacactgatgattatgggcacatggcacagacaggagtgctggcatattagatggaaaaccaggctaggattggtgtccaaattcaatctaggtctcttctatttaatttaattttttttttttttttgagatgaagtttcactgctgttacccaggctggagtacaatggcactatctcggctcactgcaacctccgcctcccaggttcaagtgattctcctgccttagcctccagagtatctaggattacaagcccttgccaccacacctggctatgttttgtattcttttagtagagatggtgggggggagggtttcaccatgttgcccaagctggtctcgaactcctgacctcaggtgatctgcccgcctcggcctcccaaaatgctgggattacaggcatgacccactgtgcccagcctttttgaaaaaatttttaaagctaaatctcactctattgcccagggctagagtgcagtggcacaatcatagctcatgcacccttcaactcctgggctcaagtgatcctccccaggagctgagactacaagcaggtgccaccacagccagttcccctccaatcttgtccaaagcatgcagcccaaagaatcctggtgggtgtgagagagggcaggaaggtacagagggcaggtagagagggcaggtgtggtctccagccagcacatgagcaacctgcaggcacagtgtcaagggcaccaccacgtctctctctctctctcctacacagccactcttaacccctctaaatgcctggagtttcaatgacagctggagtctgcatactcagaatgtcaacaaatgcgcatgttcatcacattaggaatgtgacttggaaagttatcatcttcaccgtcatgtggccagatgacctcttaggtctagtgaggggttacaggatgttcatggtggcatgggtaaagactgtgtgaaattccaaatgcagaattgattctcatttgtaagtcatagatgtggatcacaaagtgttattagaaaccagaaaaggttcctgggagcagcactgatacagaaatgaattattatagacagaaccaatacatgtaactattcgaatgtccattgacaacttgatgctgaaattgtcagagtattaattactaatttccctgaagaataaagaaatggtgtgtgtgtgtgtgtgtgtgtgtatgtgtgtgatcatatgtgaaacattttataagtacacagggtggtaggcatttaaacaaattgcatcctcaaagcatgtaattaaatattccaaatcacaatttcttgtcgaaataaatgtaatactgtctagaatgggtctttatatatatatatgtatacttttatatatacgtataagctatttagtaattgtacctttgtcatttttaacatggaaggtggtaactgagttttaaaatgcattgtccaaacaagcttaaatttttccttgaatgctgaaaagcagtgcagcgtatttgcttcttgtctctactaacaactcaggaaacgtcagcttcttaaactgttctccactctcttgggggtgaaaaacctggctgaatacatctgctctgaagtgtctttattctaatcacagttggtgcatgacaataaaagctgattactctccccctggcctctgcctcccactatctccagccaccccacagcttcccttcccattcctgcttctccacttttaaggtgggtattggggagggggctgattggctgaccctttcccagatagaaagagactgacatatttgttcagtccctttgataactgggagcttctttggaatgcaggtgtgggggacagatcgtactgtgcatcatcctagagacaatctcactactctgtgcgatgccttcatgaccccatgttgataagatcctctggacacagcccaaagaaattcatgactagtctgttagtatagaagattccacactcactaattatccttttattgaaaagatagtgattttcccctctctccctacctccttccctccctcccatcctctctttttgactcttaatggagtgtaaagcaggcaaaagggacagaaacaaggaaaagaaaggtttctgagacaatcaacagaagtggatttttcctacctgaacaaacacataatgatcctgaacaatcaaagagtctgggtcaatgtagcctggaaaaggctgattcctgttggcctctgtacagttctgcattcggcaagttagataatgtgaatctgaaaaacaaaaacaaaaacaaaaacatggggttgagggggatatacagacagagatttacagtcagggtggacgtttgatatttcccttaccatttccaatttttttttttttttttttttttgagatggagtctcgctctgtcgcccaggctggagtgcagtggtgcgatctcggctcactgcaagctccgcctcccgggttcacgccattctcctgcctcagcctcctgagtagccgggactacaggcatccaccacaatgcccggctaattttttgtatttttagtagagacggggtttcaccgtgttagccaggatggtctcgatctcctgacctcatgatctgcctgccctggcctcccaaagtgctgggattacaggcgtgagccaccgcgcccagccaccatttccagttctttaaacaagcctcacagtctttgttaaatacgttattgtcattgttattattatttaaattattatcattattattttactcacttgctctcaataccacctacatcatctcctggtgcttccaccaagtcttgatatcctagaatactaaattcttgctaattatttttttccctcccaaacccaaatgaaaatattttcaaaaactggcaataatacttgggatttcatggtcaattttttctcattagtaggtttcaccttcacactttgatctttgacaaagaggaaaacacacatacatctaatcattcatcatctaatgataaaaatgatgtggttataagattctaggttaagtaagataagggtttttctttcataattcattagaagtaaaacagagccgggagctgtggctcatgcctgtaatcccagcactttgggaggccaaagcaggtggatcacgaggtctggagttcacaaccagcctggccaagatggtgaaaccccgtctctactaaaaatacaaaaatgagctgggcgcagtggcaggcacgtaaaatcacagctactcaggaggctgaggcaacagaatcacttgaacccagcggggcggaggttgcagtgggccaagatcacgccactgcactccaacctgggtgacaggaaaaaaaaaaaaaaaaagcaaaaccgaattgggaggagttccttgagttaagactttgcttttactttacaattgaatcagttgagaccctggatctcacctggtgataaatacaacatcagtaatgacaactcttacgtcagtttggtcgctattgctggaaatacattttatcagggaggctattcctgttttttgagcacactatcctggcctctatctaatcagattatgttactcccttacttaaaactccttttgcctcattgtattgagaataaattcaaactctccaccacccaccatgccaaccctccaacctcccccacttctcaccatgctaatctcttctactctctctgtgattcttctaatccaccctactttatgttcaggaagttggccaaactttctaccactttaaagactcttcatttgcattccctctgcctaaaatgcttctccccaggctgttctcaaagcacgttctagatttcagctagctcactgttacatctgaggatcttccatagttattctttatcacacaccatcctattaattctttctatggaatttatcacaatataaaattaccttgttatttctttcttactgagccgtgctcccattagaatgtaatctctataaagacaaatgccttttttgtttttgttgttgttgctgttattcactgttgtgtccaccagatcctaatactgttcctggcacacagtaggcaataaatgaatatttgttggaacatgccacttattgaaatatatccttttgagtataaaaaaggagttattttacttgtttttgatgcttaatgagtaggtgggtttgattttaagatatcagagacttatgcagaattctatttttccaaatgaaaatatcagaagatgattatttacaggaaatagaggtggggaatagtatgtagagatagataagctagatataaggattcactaaagatttctcttaagaaaactaggaaggcggaattgtccaggaccacctttacttaaggaacttatgtgtacctacctgtattctgcagagtgccactagggggcggcatgcactcttgctccctctgaccaatgactgatggggtttctgataacctctcagtagacaatggtggagagccttacacaccatcttccttcaccccactgccatttccgaagatggggatagctctcaagtgctttaacctgtctagtcctggtgaagccacctccaaaattaaattagagtcctctattcttccttcctcatctcctttttcaggcattcctgtaatttcacgttagagcagaacacaggatctttttccttaaagacagtttctgggactatcccttcccagaacgatcctccgtctagcacacaaaatctttacctcacaattttacactccaccagactgttttacagcttttaagtgacttctgttttccaaaatgtagcttgggggtcatagaaacaatggagatttatgacgataagaactgggcttgaattctggtgtggtttatttattagctgtgtagttcataagaaatcctttcatcttcctgagtcttgctgttactgcaatgctaaccaatgttccatcttggtttttctgttcatggtactgaaagcgaatcactgagacaatgagtattgctaaggaagaagacttgaatcagatgccacagctgaggaaatggaagatcagtctcaaatctatctccctggcaaactaaaattaggagtttatatagcagggaagaaatgtaacaatgtgtgggaaaataggaattagggggtgtaaggaagaagagctggtcaacagaaagcaagttgtcagttaggcaatcaggatgagtgaggggtctggtatctcattgtctagatgcagtgatctggtaagcttaagttccttgatgatacctgggaggcctgatggttggtttcctgagaaaggaacttggataagaactcggataaaacaaatgtaactttctcaagtttgaagactggaaggatcaatttctgtgtttattcaaaagaaagcataaacatcatgttctatgggacaactgggccaatttcactgcctccttcatctattaaaggaggatgccaatatcaactatcttgtactttagctgtaagaattaaaataacatatatgctaaatgttttgaaactcaaattcatacaaatgttagttgttatgattaagaatgataatatttctgttttctgttttgccacctttcataatgatgagaaattttgggaacacacttaaaaagactagttaagccaaatttaaatattccagttatatttctgaatcaggttctttggcgagctactgaacacccattgttctctggctttttgctgaaaaatccaatatcggatctgtcagctcatcttttctccatgtgactcagaagttcccatatgcaaggaggaatgttgtcactctaaacctactcaagccttccttctccacttgccattggttgttttagaagagggtatttaaacctagtactggtacatgagaagtgaggagagagcttttaaggggaatctgagagatatcaggagatacagcagaagatcttctgcctctgtaaacactgtgtctcaatgtgaatggctctaggtttctggttgcccaaaggagccagtcttacagtcaagcttatataacgagtatgacaactagatggaaagtacccatttcctaatgacatcattgagctgttgatggtactgagcctcaagctgccccaacctctgtgcttcttgttatgtgagataatgaacaaaaacaatggctaaacacaatgagagtttgattaggaggtcttgaccttcaaattacaaatacaatttccaactagaatttttaagactgacacctaatgaggacttgatgcatacacaattcttgttttatttgtattagtgtctgatggctcttttcttttccttaagaccctgtacaaacataagatggaaaataataacatacccttttcatgtttctaattcacctatatagaaattattaatctaaggaatttagggagaaaacaaagatggaatttaacatttgttgttcatctgtgagccaggcagtctgaagcatgttcacatagctatagcacgtttagtcttcacaacactgcagagtataccaactgactttgcagataaagagaatgaagctaaaaaatagtgatgtgtagaaacggcagtatgtggttgcaacgtggttagactgactccaactttggtttatttctagtatactgtgttgcatgaaaaatcccagtaagtttggggccaatttttgttaagtatattttggcttctatctaaggttcaaacagataccccaagatacaaaataagaacaccttaatatttttgtgtggtaatttggcaatatgaatcaagatacttaaaaatgcaggaccagcctgaccaacatagtgaaactccatctctactaaaaacacaataattagccaggcatggtggcacgtgcctgtaatcccagctacttggctgggagtctgagacagcagaatcactttaactcaggaggtggagattgcagtaagctgggatcacggcactgcactccagcctggcaacaacagtgaaactctgcctcaaaaaaaaaaaaaaaaaaaaaaaaaaaagataccctttgacctagggtttatttctgagaattctatctaaggaaaaaaatcaaggatcaatgcaaagattcaacaacaaagatatttatcagtgttatttataataaaaaattttggagaaaacataatggccaacaatagaaaaagaacttaataaactatggaacatttagagtttgctattaaaatcttgcttttatgaggaaatgcttaatatattttatattatagaagtaggttaccaattagtaatattattccaatgttaatttcctagttttgaaaaatataccatggttacataaaatgttaacattagaggaagctgggtataaagtacatgtattctgtactatcttgggtgacttttctgtgtatctaaaattattccaaaataaaagtttttaaaaagtaggttaccaaaatacgtgcattatggacctgagtttttttgcaagtcgtatatatatctataaatgtatgtttgcacaggaaaaataaataaaagatatatatgagatgtcaacaacagcggagagccactaatgtgaaagagttggcaatctttacaacaaatccctagtccagcccttctacagccgggcaagtaggggagcggggagtcaagatggacttgtgagatcaactgtctctaatctctctgcttgttctttctctacttcccatgcctcatattgctgttgagctgtgcaataagcctatctttggtctgagaattaccaagtttaaaatagggacacaagaaaagccccggaagaggtcttcaaaccacttcttgctctgagtggctcaaagtgaaatttgcaagctgaaggggaaatgaaccatcttgaacagtctgcccgtggtaaagtgttcctggtttgttccctttctcctcctaatggaaaacagaaagaaactggctgcacttcataataagggaccaagcactcatcccccttggggcttgctgtaatagtattaagtatgatgaactctttccatattcaattctggtgagtgtatgatgtgattccataggaagtatcttgtaatttggcattaattaatgtcaattaatgcatgcaactgctagacattagaattaatttcattacttttcctacacagatgttttccttgccataggtaattaggacactgtgctgttcttttcaagcatcttcactctctgcaacagctgctgcttagaataatgcaatccccatccacccaaaacctgtgctgttctagagaagggaagctgcttttaaaaaggtaggctttgaacagaggatcagaggtttaaatgcaggctcaaggcctgctagcttagtaaatcactccacgtctccaaacgctgatctagaaaatgggaacaaacaatatccatctagccagaagttatgacatttgatgaccttagtcttgaaatgtgttgagtctagcgccagattagactgtactcacataatgatagctgtagttggtatttaagtcctctctctgtaatcaccaatactgctcactgtgtctcaagctaaccacctgtaaagtgctaaggatatttctacctgaggcagcttctttctttttcttttttttgaggacagagtctcactctgtcacccaggctggagtacagtggcagcgatctcaggtcactgcaacctcccgagttcaaacaattctcctgccccagcctcccgagtagctgggaccacaggcgcatgccaccacgcctggctaatttttgtatttttagtagagacagggtttcaccatgtcggtcaggctggtctcgaactcctgacctcgtgattcgtctgcctcagcctcccaaagtgctgtgattacaggagtgagccaccacacccggccacttctttctttttatattcaatttttgtttgggttaaagattttttaagtacgtttttaaaaacaccatgaaaaaatattctccttatataataattaatacaaatacagatcttctgcataggcagcagacagcactgccaaataagtagggctacaaggagaatgtggaagtcatctctgcacccaacacacagggccaatcagcaggtgtggcaggtgttccgtcttcctgttggagctatcttctaggtcctagttccatctccagcatggcgtgtgactctgagaaggtcatcaaccaagctcagttttagactatttctttacataatgagagttattagaagcttagaaacaaaacggatgttaaaaatcagactatgactttaagatccaacaaatctttaccataaattatccactgaaacctgtttccttcccactgctgccaaaacaaaacaaagctctgtgatgttgctggcaagtctgtgtcttgagggcttctgctatttctaaacagcatgcttaactcctggctgattccctatgttcattcagagttctgctggcttgaacagccttttcctttcctgttactcagtccaaatacttcctggaccttcttctgtgaactttttcctggggcttagacaaacctttccatccccagaatgtcttcattgataacagcagcagcagcactaacctccaaaataaccagagcaacctttcctcggggtcaggaactgtgctaagtggatcacatgtttttttctctcttaaattttgcttaaaatccaggccgggctcggtgattcacacttgtaatccccaaactttgggatgccgaggcgggtggatcacttgaggtcaggagtttgcgaccagcctgaccaacacagcaaaaaaatatattacaggtctctgggactctatccatccattctatcattcaacaagtgtttatttagcaccaaatactttaattttccctaatattgtagacgtttaattataaacaaagctagaaacgatgcaggcaagcataagcactttgaaactcacctattcctcattgtttccacttggaaacaatttaaatcagcaatttaagcaatctgtttaaaagcagaacagattttaaagcccatacaagcgcatataacttttccttttgttctactgctctattacttattttgaaacttctgtattaaatgttctcactcatcacgcacgcacacacgtgtcaacacgctgctgttcatatacacttaattcctatcaggattctagtgccctctgtcacatgtaccagctagaaattgagaatgtcaaaagtgagattctagtcttggttccagaaagtctacacagaggacaagatacttctgtgaaaattatagacttacatcaaatgttctagcttggcatgatgagtgtgatttagcattgctttcttctgtgaaatttcttgatttgggaccagtgtaattgactaaatattgtattttattgttggccttcaggcattcaggagaccatgactactacagggaaaattctgggatcataaaatttagccaagcatgaaactaaaaactgggaacatgagagagaaaacaaaagcacactattaggttggtgcaaaaagtaactgcagtaattgccaaaaaccgcaattacctttgcaccaatctaataatataaatacagaaagttcactgtccaattacaatgcagcatggtgagcgcattctaggatgaatggaagtgctatgggcttgccggtgaaatatttaatcctcatacctctgcacagatgttttactctgtgctagaaacttttcctgtgactctgaatttatttcactttgtatcacacagagctgtggacttgttattctttcatggcctatttagtcctctttaggctagagactattttactattcagactatgttatagagtgaattactttcgtcagggatggggacatgatggaaaagctgagggaaagcctagaaggctgcctggaatgatgacaaggataactcattattccagaaagaaggagcactgggcaggagcagagaggcaagagagaatgtgagatgtgtttggggaacactggctgtgtgttttgcgagaaagtcctactggaaacccacactagaacctagtttagttgggtaaagacagaaaatcatatacaaagtcacactcaatcatggagaactgagaagcacatcacataactttctgtgtccgcaattggttccttctggtgggttcttggtcttgctgacttcatgaatgaagctgcagaccctcacggtgagtgttacagttcttaaagatggtgtgcccggagtttattccttcagatgttcagatgtgtccagagtttcttccttctggtgggttcgtggtctttctgacttcaggagtgaagccgcaaaccttcgcgctgttacagctcataaaggtaatgcagacccaaagagtgagcagcagcaagatttattgcaaagagcaaaagaacaaagctgccacagcatggaagggaacccgagtgggttgccactgctggctggggtggccagcttttattcccttatttggccctgcccacgtcctgctgattggtccattttacagagtgctgattggtccgtttttacagagtgctgattggtgcacttacaaacctttggctagacacagagtgctgactggtgtgtttttacagagtgctgattggtggatttacaaacctttagctagacacagaccgctgatgggtgcgtttttacagagtgctgattggtgcgtttacaaacctttagctagacacagaccgctgatgggtgcgtttttacagagtgctgattggtgcgtttacaaacctttagctagacacaaagcactgattagtgcgtttacaaacctttagctagacacaaaagttctccaagtccccacccaatccagaagcccacccagcttcacctctcatgtccaaattaagtttacaaagacagtagggagtaggggaaggagttaaagagcgacagagacagagagagaaggataaaaagtaggaagaaaagaagaaagcaagcaagaatgaaaagtggaaagtggggaggaagaaatgaaaccatttagctcatgaaggagaaagcatacagtttccagtttcttctccaggtgttttatttttatttttggaagggggagtgaggggagaaggtgtgcacatttacttagatgtgtctacacgctataagattaatttcagaacagagagacactgcctctaagacatgtggatatattcaatgaacagtttctttctttctttttttttttttttgatggagtctcgctctgtcgccaggctggaatgcagtggcaccatcttggctcactgcaacctccgtctcccaggttcaagcgattctcctgcctcagcctcccaagtagctgggactatagacaagtaacacagtgcccagctactttttgtatttttagtagagacggggtttcaccatgttggccaggatggtctcgatctcttgatgttgtgatccacctgcctcggccttccaaagtgctggcgttacaggcatgagccactgcgcccggcctcaatgaataacttcttgattatttttatcaccctccataccagctatcatacctgaaacataagagatgctcaacaaagaacagtatggcacagtccttgtctcagataatggaataaagacagatgacacgtttgcccgcccctctctctattccagccacctggccttctgttatgcctcagccatgctaagcatcctcatatccatatcctttgcatgtactcttccatttgtctggaatgctcttccaccaggcagacacacaagtctctcccatatttccatacagacttggcttaaataccaaatgccaccttatccgagatttcttccttgatggccctctttctctgatcactctctattctccctactctgtttttctcacacatttgtagctccacttctcatacaaatacttcatgcattttttataacatctcccctaactagaaggtaaactttatgagagcagagcctttgcatcaattcctaatcatccctcattcatgcctagaagagcatctgatgtggcgtagatgtccaacaatattttttgaatgaatgaataataggtccagagtgaaacagacctggctttaaatcctaactctgaaacaatggaaaaaacacttaatctttgtaagccccacttccccatcattaaaatgaggaaaataagaatagtgtctacctccaaggattgttataagtaaggcagctgaaaagtatctagtgtgctcacaccagataaataataggaatataatgcatgatcctagcatcactgtcacttgagaatttagaggacaaaggaagaaaatatgtgagtaaatgccgatgctactttttttttaagtacgatgctactttttttttaagccggagccagaaacattagaaatttttcacttggggattaccacacctgcatgttatatggagtgctgctattgtattctgagggataccaaggacccaaagcctagatctttgtcctaaagttaaggcctgtgagtgaaaagttttctgtgcacctttgttctctcagcctcagcatggaagataagggcacagagcttcatgcaggtgggtgggcacctgggaagcagaggaagtggcatataatggctacaaagaacccaatttgaaagctgcccagctgagcctgttgttgtactgtcactatcaggcttttcaatgctgtgctaggaggcccgtgttatcttatttcatgcttttctgggtggttgttagggctgtcttcaggctactaaatcagagaggtcaagtggatatcactagtcattgaaatcaagagccttttgcaatacgaaatatggggtcagaataacactgctagaaaaaaaaaaagcatagtactagattctggctatactagctaaaccttgatgctttatttggggatagaagagaggtgagaatgtgcattttctcagcatgtcaggaagtggtaaggatctgttagaatctgaagctgaccagaaatggaaacgtctaacctcttccaaggtctaccttggaagttattaataaattgactaaaaaaaagataaaggaagactatgaaatgcggggtctaataatggcaactgttgtgctagtgttggaactttggccaaagtgggggtagcaatctgatatttttaaatgtgtgtatcaatgccaaaggtttcatcttttctattcaaaagatttgattttttaaagttcactgaagaagaaataaaggtagtgacgaaaaacaaataaaaattctcaacctcactcctaattaaataaatacagattaaaacaataaggatatgcctttttaaaatttgctctcagatgggttatatttgaaaagtctttgataatgtccaagattgctgagggcttgcaaacacaggcattatgatactgatagactatttattgttgcaaatatttcagaaggcaatctgacaatgtttacaaaaatttgaaatgtatataatctctgacccaggaattttccttcataaattctctttccgtagtgtttgctgcttacgcgagcttgaatgcggactaaccaaataaataatatgtgtgtatgtgtatatattcgcattgtttgaaataaccagaggtctgtatatctacaaaggtctctataatttagtaattactaaatatagttgactttataatggagttctatgtatcaattaaccatgaagttgctaaatttatatgtgctgatatgaaaagatttttaacttatatttgtatgcacaaacactaaatttgccacaacaatttttcaacaagaacatgcgtgtaagtatacgtgtctatacatatacatactcatctgtataagcctaaacaatttctggagaaatatagcaaatatataaatacacacacacacacacacacacacacacatatatatataacaataaaaagataagagtttatatatatatatacctttttattgttatcattgctatttttgttggtataaaagtaatctatattcatagtaaacacactctgtagctgagatattgaagactttgagaactgagatctctattacctccccaaagcatttcagcagcgcttaccttatccagattttgacatacttactgttcaatacggaaactaggttggaaagctggtggataggaagtagaaaatgagatttccagttcttacccaagaccagaattagtgggatgcatagttatataaagttgtgagtttcttttatttctgcttgttaaaatgctagtttgaggttcatttcacagagttctcaggcagtcattttcacagttggttaaagggccaaggtttgttgttccccggtgaatgagattagtccttgggaaacttgttatgaggttacttattcatgaaaataaacactgggaccagtaattgtcccctgtcccctgttcctgctggcacagatcaccaccagtacagaaacattcaggttgcgggttgggccttttatttcagaagtaaaagggagaagcaataatggccaaaggtggtactgcaggttctcttacagatgaccataatatacaactatatatccatgtgtaattgccatgtgaaaaattctgataaaagttatgttattttcctccaaaatcaaatatgcataaaatgtggcacccagtttcagggaggtagtaagtctcttgcattcatctgttagtgctccaggactccacagacccagtggttaaagatccttctttcagtagatatacctaaacagtgacacattaatatatttattcaacaaatattaaatgtttcatctgggtgtggtggctcatgcctatcccagcacttggtcaaggcaggaggatcgcttgagcccaggagtttaagaccagcctgggcaacatggtgagaccttatctctactaaaaacgtaaaataaaataaaaaagaatgttttgggctctaagttatcttttggacatagaacggagattaaataagatacaacttttcacacagctttcaatccaacagtttggtcaacgttttctctttaactatatgcattacacacacacatacacaaatgcacctatgttaggtaaatcaatagaatgtaggtttcctttttagtattttaatgtactgggctcctacgatgcacacacacacacacacacacacagaatatttaaacaataaaagatctgcttcatggatgaggacctgtcaatttgtcttctttgaactcaggggccaataataaatgccacatccaataaatatgttcaaaaatttccagtaatacctcccgtgattgattgtagttgagcctgctcttttcagctcacctcccaaggcagaaagtaatacaataaagaataacatccttgtcacagatgtaaactacaagatatctacatattagaggatagttggtaagaaacatcagtgccaaccatagactctcacagaacaaaagctttctaaaggatctaagataaagtactagtttatataaataaccacacattcctatgcagacacttgttgctttgggagcaaaggttcagaatctgtgccatggaccccatcagcaatctgagaaagcctgtggacccattttttcagaatgtttttaatgcataaaataaattacccagaatagaccaaaaaaaactaattcaattaaatttaaataaagttattaaaagattaaaaaacaaatatttaatacccttgtatgtactttttaaattaatatattatatatcaagatctactggcaggtctgataactactacaattttgaggaaagaatgagcataaataatattttcagatgtaatgactgtattatgatataaaaatttctgtgatttctattgcaacaaagtcgcttatattgctaatactactcgagttaatttccaacccttacaattgaaagtaatcttgtaagttataaggtttataaaaataaagatataaggccgggcatggtggctcacgcctgtaatcccagcactttgggaggccgaggcgggcggatctcaaggtcaggggttcaagaccagtctgaccaacatggtgaaaccccatctctactaaaaataccaaaattagctgggcgtggtggtgtgcacctgtaatcccagctactcaggaggctgaggcgaatcacttgaacccaggaggtggaggttgcagtaaactgagattgcaccattgcactccagcctaggagacagagtgagactccatctcaagaaaaaaaaacaaaataaaataaaataaaaataaaaaaataaaaataaagatataattcttttttctcatgtaaaaaactaaagctttccagagctcacctcccctgaaatatgggaacttcaatggaaacagaaattaagtataacatgtaatctagggacatctgaaatagaccaaaactaaattttgaataacaaacccagataagaattcacaacacactccatggggaagagccaaactggcaagtgggggatttttcctgtgtcaaatgtctcagtatcttgactacaaaatatgtgaacacactaaaatcagaaaataatttctggttcaaagtcaaaaacatgatggccaggtgtggtggctcatgcctgtaatctcagccctttaggaggccagcgtgggtggatcacttgaggtcaggagtttgagatcagtctgaccaacatggcaaaacctcatctctactaaaaatacaaaaatcagccaggtgtggtggtaggtgcctgtaatcctagctactggggaggctgaggcaggagaatcccttgaatccaggaggcagaggttgcagtgagctgagagtgcaccactgcactccgggctgggcaacagagagagacttcatctcaaaacaaaacaaaacaaaacaaaataaaaacattatattattgtaaagtatatttggcatatactctacaggatgtacaacctagaataaaaaccatgggttccatatacataaacaataatgaatggggtcgggcgcagtggctcatgtctgtaatcacagcactttgaaaggccgaggcaggtggatcacctgagatcaggagttccataccagctcggccaacatagtgaaaccccatctctgctaaaaatgcaaaaaaccagctgggtgtggtggcgggcacctataatcccagctactcaggaggctgaggcaggagaatcacttgaacccaggaggcggaggttgcagtgagctgagatcgcgccattacactccagcctaggcaacaagagcaaaactccatcacatacacaaaaataaataaataaataaataaataaataataacagtaatgaatggatggagaaaaaaacagaggatctcaattaggaaatgagaaagaggccagccatggtggctcacgcttgtaatcccagtactttgagaggcagaggcaggcggatcacttgaggtcaggagttcgagagcagcctagccaacacggcaaaaccccatctctaccaaaaatacaaaaattagcctggtgtggtggtgcacgcctggagtcccagctccttgggaggctgaggcaggaggatggcttgaacccagggggcagaggttgcagtgagccgagatggtgccagtgcactccagactgggtgacagagtgagactctgtctcaggaaaaaaaaaaaaaaaaaataggaaatgagaaagagataacacagagatatgaaattcgtagtgcagctgatgagactgtaacctgattttgataaatacactgtcaaactttgcccactacatttgctgacaccttgctaccctgacctctctgtgctatttacttccaacctcctcctctctgtttattttgttgttgttgttgttgttttaactggagccttggttattgagacaatctctttccctctcttttttttttttttttttttttacactgtgacaggtcaggtgttatgcttggaccctttaaaacaattggtagattttttttttcctgttttgtttcgacagggctaacttttcaaattaaatccttttattgaattttcacccttggatagtttctgaagatgctgccttcgcaaaaaaaaaaaaaaaaaaaaaaaaaaaaagtaaaataaataaaattagaactgatacatttcatgctttgtgaaagctaagcctgagatgacagtttggcattatcaaccgccatgccttcagggagcacaggaataatgctgggtgtaagaaaatgtgcagatcacagagagtgatggcctcattgtttttaggataaagcgtcatgtgcattggatgccacaagccagaaaacagcagcatatgcccaaaagcttgaaaatgaaagcaacccgggatgctaccaattccatccagagcttcctaaactaggggtgcaatcatgggaaacagaccctcaagctctttcactaattttctgttgtggaactttgctactcaaagcatgtttcacagacccgcagcatggatatcatctaggagcttgttagaaatgcagactctcggccgggtgcggtggctcacgcctataatcccagcactttgggaggccgagacgggcggatcacgaggtgaggagatcgagaccatcctggctaacacggtgaaaccccgtctctactaaaaatacaaaaaattagccgggcgtggtagcgggtgcctgtagtcccagctactcaggaggctgaggcaggagaatggcctgaacctgggaggcggagcttgcagtgagccgagatagtgccactgcactccagcctgcgtgacagagcgagactctgtctcaaaaaaaaaaaaaaagaaaaaagaaatgcagactgtcaggcccctactgaattacaatgcagatcttaacaaggtccctaggtgggtagcatacatgctaaggtttaagatgtgaggctctagcattttcagacaacctggtaagtgaggtgagatagccactggtagccctgacaactggtcagccgggtatgccatcattcaacatatgcttagtgagatctctctacatgtagatgccatggcatgtgctggagacataatgtttttgttttgacatgggatctcactatattgcccaggctggagtaaagttgctattcacagttgtgttcacagtgcactacagtcttgaactcctgggctcaaatgatccccctgcctcagccttctgactagctgggactacagatgtgtgctaccattcctggctctggagacacaatactgaatatgatatacatggtccctgctctcataaaacttacagactggtggcgagaaacggttgtgatcgaataaacacgtaaaaagaaagtataatttcaaacagagaagaacatgataaagaaaaaaaatagttgtataaaagcaatcaaaataagaaactcatttagactgagagtttacgagaggcttttctaagaaataggcgattaacctgaggtctcaaccatccacagtaatcaattatgctcgattggtcagggtatgggcaagaaagaagggtattccagatagagaaaacagcatgtaccaaggctttatggcaagacacatacccctgtatgttccaagaattgaaaacccgcctaaaggcctgcaggcaacgagtgaggagagggcagactaagattaggctgagggaatgggcagacacaagttatgctggagctataggtcaagatgagaatttagctctttatcatcaaagcaatgggaagtaagcaagactttttttttttgagacggagtctggctctgtcgccaggctggagagcagtggtgcgatctcagctcactgcaacctccgcctcctgggttcaagtgattatcctgcctccacctcccaagtcgctgggacaacaggcacgcaccaccacactcagctaatttttgtatttttagtagagatggggtctcaccatgttggccaggatggtctctatctccagtaagcaagacttttaaacaatgatgtgtttacttttgcattaagaaaatattgatctgttatgtagcaagaactggaccttggaatccaagataacatcatctgctccagggaaatggagacgtcaccaccagagcgagccccctgaggaggtgggaaagctgctctgacctgttgagctcattctgtgtcaggcacagtgctgggcatgttacatgtggcagctttgcctgggttacagaggatgatggtcagccttgatccctaacctgtgccccaactgactctgtcaaaaaatatattcactcccccaaaagggaaacaaacctttagagatgagaaatctcatggtacatgcatagtaatgaaaaatgtgtggtttctggggagtttgggttatagggttgacctgctttgtttggctgtaagctggtaaagtgcaggaccttctgcctttgtgttcagaagagccaaggactggtaggcacaaacggcagtgattagggtgcttttgaattgtgagggatattttagaaactgggaaggtcttggaaatgagatggtcactctctgggccagcgctgggtagcctacaacagcctcattgctctgtggtaattgtggatagtccattctcttcctctcctctacatctgagacctcttcctttctccctgtcttttctcccctcaccctcttctatatacagtttcccccttttctcattttcttttaccccctcacctggagtgctctatcctaggcctagcggtacccctgcaaatgcttagcccttctgaggatcctctgtaccagagaaggggaaggaaacattcattgctggtgttagtaggtcaggcactgtgtgaagtattgtatatgcatgggtttcttgaattctcacctgaataggctctgtgagatagacatcactgtcctctacttatttaccatattagcttagctatattattacttaagctttctatgcctttgcttcttcatatgtgaaatgagaaaaacaacctacaacattgtcatgaggctacaaagtgtagtcctgtccttcactgcagcataaccacccggagttgataagaactactgacaggtgagcaattcactcaactgactctcctcctgctgcctctcatggggacacacagaaaaattctctctctctctttttttttttttaattctttccaagtgttttgtgaatctccaaacaagacagtgaggcatggcctggatggtatctgacaaaataaggagactgaagaaacaattcaacacaaaagagtagcagcagcaacaacaatgaaacactttaggaatcaagagtttggaagtattctctttacctggaaagacactttgattggatgagagggctgtgctggtatcaccactatcaaaatatgcatatttctggataacctatatatttatatttacaaatatatgtgaaaatatatatttatgaaaaattattaagactattttgtattactgaagacaggaaatgtcttcatgcctaaatcacacgattattgccactgtgccactgtgcctgcctacctatccttagctcttccgaacagaagatacctgcactttactagcttagagtcaaaagaagcaggtcacccctgcaaccccaaatcctcagaaaccacacatccactattactctgcatacaccatgagattattacacagactcagttcatgacagagtcatagaactaatattactatgagtattgcggcaaagttgatttacttacgaccatccacagttctggcctcaagatgcacaaggtctggttctttatttgaccccatcacagacctaaaaaatggagaaacatgaaaagaaacatccatattaatgacttcacatgtgccttagtggaactcggcagagcccccagactattaatatccacaggcatctaaacccacaatccttagaatatatctactctatgtatttatacagcctgacagtaaaatttccacttaaaataaaaatgataatgaaaactacatttgatgaaaggcaggctgcattctagcaaggatgttgcatgttattagctgggacttgcatacaggtcctacgcatgttgggtgtgtactcttgcaacaaccccagtgacagtgtattaaactttcaaaacttattaggcaggcatgctgcttcagctgggtgacttgatcagcgattcccatagcacactgatctaattaattttttcactgaaatttgccaaaccacctacgactgccctatgaacaaaccctgtgactcaaccaatacagcagcagttacagcagagtgatgattctctgtattgtcgaacccgtgtgaagagaaatagatgcacctcactttctgatacgtgcctgaaaccatatgtgtaagcaaaataaaagcctatttaaaatgccttggagacacatattattttgtgtaatcctgcagtaagctatattaaatagaaaataattattattctggaacataaataatatgggcaatcacgctttatctctaggatttttatacaatgagattaattaaacttgggaacatctgcactttttgaaaaaatcaggctttgcagaactttaatttattccatttctacacagaaaacagcgaaatgcctccaaactggtccctctgcctgcccccagccactcagcccagccactcaatcaaggctagaaaatgcagatgttaaaactacttatccctgggccgggcgtggtggctcacgcctgtaatcccagcactttgggaggctgaggtgggcggatcacaaggtcaggagattgagaccatcctggctaacacggtgaaaccccatctctactaaaaatacaaaaaattagccgggcgtggtggtggggtgcctgtagccccagctgctccagaggcatgaacccgggaggtagagcttgcagtgagccgagatcgcaccactgcactccagcctgggtgacggagtgagactccgtctcaaaaaaaaaaaaaaaaaaaaaaaaaaaaagtacttatctctccagagcctagtgcggtatccacgaccctgcacagactgggtccatctcacttttgctgcctcatctcctgccacactgaaagatgttgccattgtctgaaagtgccacactcatttcctcgcccctctgtgagtctctaagcttctgccttcaggttgagatgctcttctccagcttcacctaacccctgaatcatagtttaagacacaagtgaaaagtcacttcctctgttaaatatgtctcatttacgacagggaaaggcttttcctccgatcagcaagtgtttgttataaatcctgtaaggtccttatcagagtttgttataaagaattatttttgtgtttttccaatatgaaggcatcctcttcccccaacagacacacacacaacacacaaatacaaaagatacacacacagagatacccaataaagctactggaaggtcttctctttacacactttatattcatagatatagttcctggtatataacagacagtcaaatgtgaaatgaaagaaggaaggaatgaaggaaagactaaagaaaaggaaagaagttaggaggaaaggcagggaggacaagaggaaggaggtaaagagaaagaaagcgaaggggctataaaggtctgcgggttttctgaagtaagtacattaatcattgtcctagggttattcccagaactctacttacttaaactcatttttccaactcaaagaagctgagtggctagctggcttaatcactcttcatctggagaaaagaagtctccttaaagccctgttatcgctgtcaataagttttctctgattgatacatggcctgcaattcagagcctatgcttgaaacattaaatcctactttgttcttcccctaggaagcagatatttcctaataagggtctcataatttccctcatatagacatgggacatgcatttgcacattttaatcactggaatctgcttgaatccaggcagaaagtgaccctttcatcagaatttcagttaagtactgcagcgactactaggctttgggtggtgactctcctcacactgaagcattaactggatccgcaggtgaccttttctgacaagactgcaagtcatgagcattaaaaaagaaaatgagctgcttgacaagcctcaatccagaaagctcagcagttaactgttttatttcaaaatgggcagttacatgttgttcaactgtccaccttgccttaagtttcatccttgaaatgactaccaccacttattcccaggagaaacgcagtaccccagaaacacaaggttaaaactagcatgcaagcctatctacttggcttacggctagtgtcaacgggaggcaaaataattacgctggattcagtgtagctttccatgtgcgtatagtctcaaataaataatagcagtagtttttaaaaatcttgtattatctttaatggcaaagctgttgtttccagtgacatctcccactgccttatcaacaaacaaaaaacaggcaaggccaggtgcagtggctcacgcctgtaatcccagcactgtgggaggctaaggcaggcggataatgaggtcaagagattgagaccatcctggccaacatggtgaaaccccgtatctactaaaactacagaaattagctgggtgtggtggtgtgtacctgtttcgggaggctgagtcaggaaaatcccttgaacctgggaggtggaggttgcagtgagccaagatcacactgctgtactctagcatgggcgacaaagtgatactccatttcaaaaaaaagaaaagaaaagaaaagaaaagaaaagaaaaagaaaaaaaagaggcaagagcaaaacagagttctctgttctccccaaatctactgtggctaacaaacctccttattctgcctaaatgttttctcatctatagtaaaacaattacaactacaaaacaaagctttacatatgaaagtcaaaccacagtgtttccaatgatttttatttgatgatgcctcacccctagacctgtggtccaagagtatctctagcagttacagatgataaagaattattgctgcttttactttatggcctagtgagttcttaattgctgaggccaatcaatgctgaatgtctgtataagtgctgattttaacggtcctgtcattgaccagataccttagaaaagcatatcattgcagttgacccaaatgatatcattactctagcctatatatgctgctaaattttagctggagctacagagttaggtagcattctgtgtgttttaagaccaactatgtgtttcatcctcatcctcatcattaaacatcactgtcatcatcattataatcatcaaagaaaaacagcatcaacatagaatttaatacaaaatgaactcttcatggtcttacttgcagaatgagatcttgagactgatattcaagcatctctatccaaagacgttggtaaatctgacttctggtattaagtataagggattgggcacctttgttttatgcctctagattatccgacacatatcactgtcatagttcataatgatttgctacatgtctgcataaatgactctcttaatacaccggactcccaaaggcaagtgttctgtcttttatcactgaactctctctgcttgcctaagtacagagaagcaagttttctcagtaaatacatatacaacatttttgcaccagtcaatatttactaacatccaatacagcatgttattctttctgggactcagaacctctctgtaaatatatgataaaaattttgtctaggatattttaattatttaaaaaaaggcaataggtagatgtatcttgtgtacctttacactgcctttatgttgaactaggaaaatgaactcccttcttgaagtgaattttatggaagggaaagggagtctttctgtgtacatcctggtgtctgcctgggatctcctctcatccttcttctgccttcataactcttattgctgtggctcagctgcagatgactgaagttgaaaacaggcttctcagtgggggtgccacttaagccaagttggttatcctttctgagactttcagaatgatgaacatacttttgcacagaaaaaattaggccatgttataattggtgactcatttgtcaatctcctttattgacagacagactcaaacctttctgtacctctgtgccaggcacctgcatgccacagatagattagcaaaaagcattaactgaatggcttttgagaaaagagaagtacacaaaccagccatatcagcatgtattaatttatctgtatatgtaacttttgttaagttagttaacatctctgtgccgtcacttttttagtctttaaaataagttaacataattttttctatatttttcctataatatacatctttaagtacctagaagactcctggcacagagctagggctcaggaaatacagttaatttatttcttctctttttccccctttttatttcaagaaatgggtgggggaatattaatacctaagaaattaaaatgtatgctggtattaaaaaactcttgaccaggcgtggtggctcacacctataatccgaggatcacctgaggtcaggagtttgagaccagactggccaacatggcaaaaccccgtctctactaaaagtacaaaaattagccgggcatggtggcgggcagctgtaatcccagctactcaggaggctgaggcaggaaaatcgcttgaacccgggaggtggaggttgcagtgagccgagatcaagccagtgcactccaggctgggcgacaagagcgagactccatctcaaaaaaaaaaaaaaaattcttgacatatcatggatgccttgctaacagaaatgatctatcaaaattattgattgtcataagtcaatagacaaaaaatgagtcaatggctcagagatcaattatatgaataaatacaattcaattatttattcatttatttagtcagtgaaacattccaaacccctactatgaaataagaatgagggctacataattactgcacttaagagctttagaactacagaagaggcagtaacccaatgaagaaagggttctaacattcaaggtgctatttgaagacacaggaggaatgacctttcacctgcagatggaaacctggaggaaaagcaaggtccaggaaccctttggagtaaatgaatcaaatcttcaagtatatgcagcaataggatcaatggacagaaggagtgaagagcattccatttacagacaaatagcaggtactggggccctagctcaaagaaaggatgacccatatatgtatctattgtaagtcaataggatggatccagtgtttccaaagtagattagcaaaagagaactgaaaagacaccaggggcccaatcaaaaagcaccttttgtgtaatgctcaggttttgtatttgatcctaaaagccatgagatggtgctaaagaaaggtaagcgtatacatttataagcaggtgaaaagacttcagtcctggtctatgtgtggtcctcgctattgagggagtatgaggcgaagttgcacaggtcatctagatgagctttgttgatgaaaacaagacaaagcccattgcagcctcctacatctatacttccagtatcttaagtaggttttcacatttaagagctattttgaaataaaacctaaagatcactaaagacaagaatatgaataaaaacaaatcacactctgaaatagtataccagtgacatagcagcgcaacatcagccttctgaaatacaatcagccaaatgcagcctttgtagacattttctacagagaaactcagaaatgtcactagtttatcattcgcctggcattttgtctgagtttataccagcttaatatagtgcccaataaatgctgcagagccacaaaatgtcctgatgtagataaccgcagagcaagtattacaaaataaatatcatgatgggatagcacctatttattcagattcagaattgcagttaatggcatatgggaagaaacgaggagggacctgcagaggaacagaggctggaaggttggagacccctgccttcctcttcatgttcccacagcccctcttcataaacaaagtccatgagggcaacaggtcctgtctgctaccaaagtgcctggcaggtattggcagtgacataccttggtttcctctcctacagtcaagggtttccccttcacctgccactataattaggccctcagaaaaacatcatcaagataaccctggttaaaaaaaaaaaaaaaaaaagataaccctggttaaggccacagtttttgtttttgaatagatcatcttagcctgaggtctcgtctgcgtccaacacgggcaaatgggccagataatctacaaagcagccgaaggtgccatttaacctctccctttagcctaagaaacatgtctgctttctgcttttattcctctggcccccgacactgtcagtcacattggttctccagaaccaaaggtgcctactaaaaataacaaataaatagatcaatagataaacagacagataaaaacaatgcttaatctcctcaatgcacaatggcctactgagaatcagcattgccagcaacctgaggccctccacgtgctgcattttgtcatccttactccccaagccagaagcccaagtgtttatttctatgatgtctgcagcaaagtgtgtgtgtgtgtgtgcatgtgagtgtgtgtgtatgtgtaggtgtcagggagcaaagtgaggcacgcaagtctgacctggaatgaagaaatacataaagctcaggagagcagtgaggagatgaagatgtttattgagcaaagggcttggtaaataggactaaaagtttaaacaacaatgtttagaaacaagcaacctgtctctaaagacatcacaatgaccagacctaaaccagccaagaagaagctttctgcagcagctctccccttcctttccccactttcccttttctaatttaatgactttgctttttccatcagtgtttgcatttttctgtttccttcttatttccccacttttatgccccctctttgtctttgttgtttcttaaataaatattttttttaaagaggggggtggtgcaggcatggtggctcacacactttgggaggccgaggtgggtggatcacttgaggttggaagttcgagacgagcctggccaacataatgaaaccccatctctactaaaaatacaaaaattagccaggcgtggtggcacacatctgtaatcccagctactcaggaggctgaggcaggcgaattgcttgaactcaggaggcaggggttgcagtgagccgaaatcatgccactgcactcccctacccacccccaccaaaaaaggataaaagtatgtggggggtctagagagataccagggaccatgctcaaatcagtgctcctgatccccaaacaaaaatcacagtgccaatgagatacagagaaatgcacttcaactgatcaaaaagagcatgagattaaggtaaaggaaaagcttaaaatatttttaataaggtttctttttatctttttaaactttagtggtatcataccctgcatatttttagcaacttgttaaatgtactcaataatatatcttggagatggttccataccagaacaaaaaattaatgagataaatctctaactattttattgcaacctattaaatgaaaatatccgattttttcagtcgttgtctattgatggacgcaaagaaaaaatatacataaatggggaagaaaaaactggagatacacattaaaaattcataattgtagtcacttttggtagagtttgggggttgtgggtaatagtcaaagggatccttatctttatcagtaatttaagaacttttataaggaagatgtatatatgcgattgtctaataattaatacagctgtactattaataaaaagaaaatattctccatctggaaaataaaatctaagtgggtagtaaatgtgagcaaatcacaaagggagagaaaaaaggatgagtgacatttctgtagggaggagacctgggattttctcaaatcttgaatacttataagtcagacaccatcttagtgagagggccaggaaggtgaaagcctagaagagttgtggtcagagaagcagtgctaaggacttcctggaggggtgtgcttgtgttgatgttaaaatcagtgtgagaggaaggaggctggagatcctgcgtggggccagaggggccacagtgacagaagacagggagaagagagaacctctccacttctcctctctttatccatttctgttaaggacaaagaacttcagactagagggtagaacaaatataagtttaaaggaattgctcagcgcagtggctcacacctgtaatcccagtattttgggaggctgagatgggaggatcgcttgactccaggagtttgagaccagcctgggcaacaaagccagaccccatctctattaaaaatttttaaaaaggccaggcacagtggctcacgtctgtaatcccagggtctcactatactgccccggctggtcttgaactcctggactcaagcaatctgtccactttggcctcccaaagttctgagatgacaggcgtgagccgctgtggccagccagggattgttttaaaaggcaaggttagtggactaggtatttgaactacagactcactatggatgatcagaaaggttgggtaaatattaaaagtaataagagaccaagcaaagaaataaaagaatcatgaggccaaaaactgagagaagatggaaattcagagaagaaagtccagagtttggcccactcttcccctggggaaaactgtcattgtcttggctgggcatggtggctcatgcctgtaatcctagcactttgggagttcaaggtaggtggatcactttaggtcaggagtttgagaccagcctggccaacatggtgaaacctcatctcactaaaaatacaaaaattatcctggcgtggtggcacatacctgcaatcccagctactcaagaggctgaggcaggagaatcacttgaacccaggaggcagaggccgcagtgagccaagattgcaccactgcactccagtctgggtgacagagagagagagactgtctcaaaaagaaaaaaaaaaaaaaggaattgaaaatttaaaccaggccgggcgtggtggctcatgcctgtaatcccagcactttgggaggccgaggcaggtggatcacgaggtcagaagatcgagaccatctggctaacacgatgaaaccccgtctctactaaaaatacaaaaaaaatatatatatatagctgggtgtggtggcgagcgccgtaatcccagcactttgggaggccgagtcgggcagatcacgaggtcaggagatcaagataatcctggctaatgtggtgaaaccccgtctctactaaaaaacacaaaaaattagctggatgtggtggtgggcacctgtagtcccagctacttgggaggctgaggcaggacaatggcgtcaacccggaggcagagcttgcaatgagctgagatcacgccattgagctccagcctgggcgacagagtgagactctgtctcaaaaaaaaaaaaaaaaagaaaatttaaacctgagcattttgctgctggagataacctgaccccatggaaatgatattctataagagaattccagaacagctatctccacatgttttgtttgaacacatcaagcaagggggggaaattaggcacccccaatacatgatggtttattagatataagttgtggaaatgcagtacagtacttacatactaactttagaaaatatacacaaaatagaaactaaaatcggagcaaagaataatcagaaagtatcttcttcccacacctcagtgaatcaccaattacccccctagggtgtgggtgcaggtaagtcaccatggagactgttgctctaaactgaggattcctgggatatccttaatatttaacaccaggcatggcagatggttgattctgaattaattttttaatgaataaataaataaatttttgaatatgtttactgagtaactacaaatgctaggtgtagttctagacattaggggtttaaaattgaataaaaaagaaaaatccctgtaccttgtgaagcttacaattcaatatggaacacagagaaattaaaaataaacatgtcaggtgatgctcataacatttcttgaaagctgtgtgaggaaaaatatataaaatacaaggcatttagctccatcagaaaaaaaaacccattgttccccggtgtcaatcaatggctggtttccatctattaagtgtgagattgatgtcatatagggccacaaggctgtgctcttgttggtgtcctgctcatcaattgtcaacaacttgggtgaaaatacatgttgtgtgcctagaaaattcatacatgacacaaattcaggaaaaataatgaaaagataagagaaagacagtgttatctctgaaagcaatttacttgcctaagggcatagagctaataaaagatacaatcagactggaacctaggcattctaatttctctagggctctatacaccacctgtaaaaaagagtagagataatagtaccgaataatacgattgttgtgaaaggtaaaagacgaaatacgtgtagctactactactgtcaagagtatgaatcaaggaatcctttagggacagaaagtctgttagagattaactagttcaaatacctcctgttacaattaagaaagcccaggcttccagagagcaaataccatgtccaaagtcataccactcagagtgtatcaaggttggaattactaacccaggtccttaactcatgtcaataattcttttcatagaaaaaaaaattaccccttagtgtctgaggcaagacagtgttaactaggaagataatgtgtgtcttacacactaaaaagataaggagaagccagacgtgatgactcacacctgtaattctagcagtttgagaggctaaggcaggtggattgtttgaagccaggaggtgaagaccagcctagccaacatggtgaaaccccgtttctactaaaaatacaaaaattagctggcgtggtggcatgcacctgtaatcccagctacctgggagggtgaggcaggagaatcacctgaacccaggaagcagagtttgcagtgagccaagattgcgtcactgcaatccggcctgggtgacagagtgagactctttgtctcaaaaaataataataattatatatagagagagagagagtgagagagagagagaatggaaaatcctgacatttcaacatcctgcaagcgttaagtgtattggcatacatgagcctagacatatatgaggggtcccatgtcccagagattggaaacagactagatattaatttcttcagcttagaccttaaatagcagggtttctaagtttgaaggtggcttttttgcagtcacttgcaaaatgactaatacattctctcccttctcagaaaacacagtgtcagtttttacacggacagctcagtgcctggcctgtaggtaaggctggtttagctatccttgtagtcgcttttccatacttcgtcagattattatgacacaaagtcttctcttgctttatggttgggtattggtacttctgcaaaaatacactaagaggctattgccctcaaatacttcaactgagaaggaaaagagatccagtcagtaaagcttggaagggagtaagaatagaattgggttagatataggaggaaattagattgatcttcattggagaggcaattcctggggtgcgaaatggcaactgctctccttagcagaggttgagtatcccttatctgaagtacttgggaccagaaggtttcagattttggattttatttttcagattttagaatgtctacatatacatactgagatatcttagggatggaacgcaagtctaaacacaaaatccatttatgttttataacaccttgtacatatagccagaagataattttacacaattttttttttgagatggagtctagctctgttgcccaggctggagtacagtggcacaatctcagctcactgcagcctctgtcttctgggttcaagtgattctcatgcctcagcctcccaagtggctgggactataggcgcatgccaccacacccggctaatttttgtatttttagtggaaatgaggtttcactatgttggccaggttggtctcaaactcttgacctcaagtgatccacctgcctcggcctcccaaagtgctgggattacaggtgtgagtcaccacgcctggccaatttcatacaatacgtttattagttctgtgcataaaaccaagttgtgactgcatttcgaccagaacccatggcacgaagtatggtatgaaatttcccacttgtgacatcatgttgtcactcaaaaagtttcagattttggagcatttatggttggggattttcaaattagggctgtactacctgtactttgtttgttgatgaaaaatttctggagttctgagtataaggtgtgaagggatttgaaactgggcaaagacagggaagctattttgtgaaaataatttaaaggctgtgccagtttgcttttgaactcatgtaaactccttggccaaggaaactagtgtgatgacaaaaaaagaaaaacacacctcttaatttatctcattttggggtctgtttttaaatcagtagtccactatggatgtgaattcctaaagttggttttgaaaatatctcaatgtgacaaagaaaagagagaagtggaggagggaaagggaaagagagggagtaaaagagaacatgggaaagagaggataggagaatgagaagggcaaatgaaggcattggagacagaatgaggatagaaagggaggaaagagaagccagagagaggagactttcttcgctatgactattccacaggggtcaccatgccctcctgctgcctggctgccaccagtcccaccacaccaccatccatctggaaatatgtttgactgctttattattatcattatttgtatattttattttattgagaaggagtctcattctgccacccaggctggagtgcagagcaatggtgcgatctcagctcactgcaacctccgcctcccaggttcaagtgattctcctgcctcagcctcctgagtagctggaactacaggtgcataccaccgtgcctggctaatttttgtatgtttagtggagacggggtttcaccatgttggtcaggctggtctctaactcctgacctcaagtgatccacccaccttggcctcctaaagtgctgggattataggtgtgagccaccgcacccggcctgtataatttatttaaatagcatgctttaaaaataacaccgctgtgaaaaatctgactgcaaaaggagtatgtattcattgaaaatataatactaagtatacagaagtaaaaaaaaggaaactaaaacattcttacaatccctccatctagaattaaccacctttaatattttgctgttaatccttcagtactttttcagtgttcgtgtaggcactcctttttctttttaagacttttgcatcatatcacgaacacagcgtaacacacgatgtaatattagaacacactgttttgccagccgtacaatattctatagttgacttaactagttttctgatcacagagtattggtaatatctatcgttttacttttatttatttatttatttatttacttgacatagagtctcgctctgtcacccaggctggagtgcagtggcgcgatctcagctcactgcaagctccacctcctgggttcacgccattctcctgcctcagtctcccaagtagctgggactacaggcgcccgccaccaggcccagctaatttttttgtagttttagtagagacggggtttcaccgtgttagccaggatggtctcaatctcctgacctcgtgatccgcccacctcggcctctcaaagtcctggtatttcaggcttgagccaccgtgcccggccatcatgttacttttagacatgatgctgcactgatgatctttgtaggtaaatatctgtatgtgtctctaatctctctagtttttcaataggaacaactgttataagaggagatattgtagtcttcccttacccacaaagtttaagtccataaggtataagagtgcttacaatgtttagaatatttaccttatgactataccatatttttcatgtattttttaattggtgaatttagaaccttcattctttgttttgggaattaaaatgacttaaacacagaggttagtagcctgcttacaggtctgttttgtttttgggagcagccaggcttgcttttttccttggttaagacagaggagagacaggaaaaggtaaaacagagtgtgagtgtgagtgtgtgcatgtgtgtgtatgtgtataacatcttccttttggaaaagatgtgtgagttgcccaactgaacaaagaggaaagctcagaactactgggtgagaaccccacctccatggtcaaccaagaaaatcagtcacagagaaagtgcatttgcttctgacgtctccattccaggtcagactctaaaatgctccttaaaaaaagaccaacaaaaagtttattagccaaaaagtcttgcccttaattagtaggtcaacagggatcctcttgacaatagctcagagccagggcagagggacacctaaagtgagaaagagatattagtaaagaaacaataagggccaggtgcggtggttcacacctgtaatcccagcactttgggaggccgggcagaccaagaggtcaggagatcaagaccatcctggctaacatggtgaaaccccatctctactaaaaatacaaaaattagctgggcatggtggcaggtgcctgtagtcccagctactcgggaggctgaggcaggagaatgggtgaacctgggaggtggagcttgcaataagcggagattgtgccaccacactccagcctgggcgacagagtgagacaacgtctaaaaaaaaaaaaagaaaagaaaaagaaaaagaaaaaaagaaacaacaaaacacaatctagaattgagcttattcaccttcattagcacactacagtaataattgctgtaggcaagattggctatgaatactatagtaggcaaaacgcatgttctcaacgtatctctccaaaatcttgatcaattttctggttatattaacatatgttcacacactttttgatacttatcctgccaggagttagagcttaattctccttcctttgagtgtgggctgaacttagttacttgcttccaacaaacagagtatgggacaagaaaaagagtaacttttcaatggagaaatctgggagcttccaacaaatagagtacgggacaagaaaaaaagtaactttgcaatggagaaacctgggagacgcccccttcaccaagtgatcaaagttaacatcatcagtaataagacatattgatatcttgtactccttgatatgaggtgatgagaagggtacatcatttctttgatattcttcccaacaatctataaccctgtaatcatgagaaaatatcagactaactaacccaatttgaggggcactctacaaaatacctgactagtactcttcaaaactgtccaggtcatcagagacaaggaaagacggaggaactcctatggatttgaagagactaaaaagacatgaaaaataaatgcaatttgggattctggattgtaccctgggtcaggaaaaaaaaaagcgggggatattagtagaaaatctggagaaaaccagacagtctctattttagttcactgttttttaccaatgttaattttttattggtaaacattgcaccatggtaatgtaagatgttaacattaggtaaagctgggtgaataggatatgggaactctctgtattatctttgtaattgttctgcaattctaaaattatttttaaataaaagaggaaaaaaatcctatgcccaaatcttattaaggacatgaattagagcaaagccacaatttcctacaaagaggaaagtaatctattcagtaagtcagcctcatcacatggaatggactggttatactgtcattaaagaaggtaaacaactgtatcacttcagctgtcttatatttatgattcaggcatttcgacaatcacaaaataattaagctacttcatttttcaaaaaagtgttaaggttgttttagtggctcttatttctgggatgtttttatttttgatttattcataagtagaaaacaatgctgacagccagcgttcttatttattcttgggcttccctggttaccacagacagaacctgatagcagatgacaacataaagatgttgggtccaggagctgctgaaatgtgaggtcaaatgtgaggcttgtgcctgatgtggttgtctgctatgtctcttttggattcctctctcttaggcatctcgctttccttgactactcaattactcaggaaggccaactgatcatagaaggcaatggaagagctggtttgttccctgggatggtgaagcagaagctatcccaagtgcataaatattctaacaggtttcatcctgtcacaatagagtcataaaattgctctgttcagcacatgataatggctttgtaattcaattattggtagtatttgtcttctgggatttagctgccttaaacttcagcactcatgtaaaaccctttaccataaatctcataaacgcaggttctgtccctcaccccagggcacatcttgccatgcctgtgaaaaccttgacagctttctctaaattatagaattgtcctgtttagaggtgttgatgttttaagtgccagagtcaacaataaaaaatagtgggacagctccatttcctctagttattctctttagaggaagacagatcctgacagacagaccaagttccattcccaaaccaaaatgatgtttccatccatttctctagcattttttagaagagattcctgcaagtcatagggggtcagatgagatgtcttctaagttatctttgatcctgagattccgatgcataaatacatcagggctcatcacctacatagattcactagtcttacagttggttttagaattttcctctatctactctgcctttcttttgtgctcagtcaaataagtcaaccttcagtttttgggtcttctctactcttctgtcttgaatttagcattctgcatctcggtagttatctactatgacaaccctatttaaccttcaatttgaaaatgtacttaaagatacaacatgacagatagataggaagcataagtgctcgtgttctatagcacaacagggtgactacagttaacaataatctattatatattttccaatagcaagaggagaggatatagaatgatcccagcccaaagaaataaatgtttgagaagatggatatgctaattactctgatccgataactatatatatatgtatcccataaatatgtactattacgtgtcaattgaaatattaaaataaataaaatgaataaataatgccacctcattcccatcatctgtcctacatttttcactcactcagaaaatatttattgagcacctcttccatccattccaaaatgcaaattttttctcattttaacatcttgtacatcagtaggtatcttatgattgttcaaatgttatacaggcatactttgattgcacttctttttattgctcttcatagatactgagtttttttgttttgttttgtttgttttttacaaatagaaggtttgtggcagcccttcatgcagcaattctatcagtgccatttttccaaaagcacgtgctcacttcatgtctccgtgccacattttgctaatttttgcaatatttcaaactttttcatgattataacatctgttacggcgatgtgtggtcagtgatctttgatgtgactattgtgattgtttttgagtgccacaaacaacaaccatataagactgcaaacttaattgatgcaaacttaattgcaaacttaatggcatgtgtgttctgatggctccacagaccagcgattcccccatctctctccctctcctcaggcctccctattccccgagatgcaagaatattgcaacattcacttattcgtgctagtctggaacgaaacccacaatatatcttagatatacctgtagtttaattggcagcatttttttttgctgatacataaaataataatgcacctccatttgatgaaaatttagactttatgataacattacatgccaccaactgttctaggcactttgctgtctctgctctgtggtcaatttcttcttacacctgtgtgtgagtgtgtgtaacaatcctttccttttgtcttcttctcccacatttacctatgttttctgcagaaaatatgtcaatattgattatattgactaatcctacatctcagcattttgctttcaggatatagaaaggggaagcatgactcaaccagaggaggaatattacctaaatatacataatgtggcatacacaaatgatttcattttggggaaagttatttatcacatttaagttatggaggaacagaaatgccatcatgctaggtagaagcataattttgcttttgcttttatttgggagttatacatggtttcaaaatacctgcacaggtgacaagttttcaaaggatagactgtgatttacttctgcctgaactatatttctcagagtctctgtaaggtttcatattacaattcaccaataggaaatatgagatttggaaggcaggaaaggggcgcagtcaattccttccaagactcattttagttagaggtagtgagaggcagatgcagatgtcccgacaggttctagtttgtccttgttcttctcttcccaattccatgcccagttttacttgagactgcccgccttgtgacctcaggccccaaacctgcttggctgcaaactcactgagcagtagctatgcagggaaaatatccttccatatgcttccttaggcattctctttgcagtcctacctaagcagctgcaagcccctttatggaaggaactgtgtttcctacatctttgtggccagaatttggcctgtaaaatcactccattgaaactaattaaatgagttgaataatataaaattgagaagctacaaataaaaccttcagctgattttctatccactgttcctgattctggacaacaaagaagtaaaatacatgcacacattaaaaattcccattgaaaatataaattattcaatcgaatcaaaatgagattgccacatttcagaaacacattaatatccaactcttccctattcctccttttagcagcagttaacatttactcatcacatatgtaaccaacctgaatgatctcattttaatccttacaatgagtatacgaggaagatactcttatgaggaccattttactgatgaatactgtaaggcttaaagaagttaattaaagagctcaatgtcacaccccttgaaaacaggattctggcaaaggtattctgactccagaactccaatttttacacattaaacaccatctcctattgactaaaggcaacattcaaaatcgatgattgaatgaacaaggataagcatacaaagacgtgaagcaaacttagaggcccttaatttgaaagctaagtgaggtgtgatcactagggccaagtaaactcctcctaataaaattataaattaagaagacacaattatgaggattttttttccctcttaccctcactcatggtaatcacttgcattctgccatcataggaattcttagtgaagtctcgagaagtgactgaatattgttcaaagatagagaagctgcagcctatggggacaggcatcatcaagataaggatcacaggaatcagtgatggccattagtgaatgaaggtcgcatgaaaagtgatgggctcacactgcagaaggggaaatttaacttaatttgaaggtaaaacttgctaatcacaggaaaagattaagaagtggaggaggggccgggcgcagtggttcaggcctgcaataccagcactttgggaggccgaggcgggcggattacgagataggagatcgagacgatcctggctaacacggtgaaaccccgtctctattaaaaatacaaaaaattagccaggcttggtggcggatgcctgtagtcccagctactcgggaggctgaggcaggagaatggcgtgaacctgggagacggaacttgcagtgagccgagatcgcaccactgcactccagactgggcgacagggtgagactccctctcaaaaaaaaaaaaaaaaaaaaaaaaaaaaaaaaagaaaagaaaaagaaaaggccgggcgctgtggctcatgcctgtaatcccagcactttgggaggccgaggcgggcggatcacgaggtcaagagatggagaccatcctggctaacacggtgaaaccccctctctactaaaaatataaaaaaatcagctgggcgtggtggcgggcgccgtagtcccagctactagggaggctgaggcgggagaatggcgtgaaactgtgaggcagaggttgcagtgagccgagatagtgccactgcactccagcctgggcgacagggtgagactccgtctcaaaaaaaaaaaaaaaaaaaaaaaaaaaaaaaaaaaatgcggaggaggtgcaaaagcgttagcaagcagcattcatgtggagatcattaacaataaaaaaagaagaagaaataccacgcctctcaaggtaataaaaattttcttatctagcactcctagtgcaggcactagaaacgcctcagtagaccttgggaagggatctctgggaagattctctgccacttctccctgctccttatccaaaccatacaggattctactcagagggcaggggctcagaattagaagagactgcctcagagaattagggaaagtgtaaaagaagagcgaacaaagtccattctcaaagaaaagggctttctgagttcttctcctgaactccatattctgaaatgtatcaagacctgtcaaaatcagcagtaaaggacaggctcgcactgtgagagcagtctaggatgagtctttctgtttttgcttgaatttctctggttacagggatctcattactccttaggacagcctaaggagttaataaatagcctagtgcatggaaaagtgtgcctttcatggatctaaaattttcattccttcaatatatatactccagtgatttagaattctggcattttcatgctagagggaaatacagaggttacctactatagctctctaatttaactaatgaggtctactcaagatatttcagtctctgcgttgatggatttacatgtgtacatgtacaagcatgtgtaaatctgatgaattttagtaccctgtgtgtgtgtatgcacaagtttctgctgctctatttactgtagtacacaagatagaaatatgttaaaggcagagccttgaaccttaaaaaacttatcttctagaaggaaatgaaaagaagacaataaagaaatatatatggagaacatactaagtgctaagttacttaatggtaataatgataatatgtcatttttaatgctaaaaataagactttgtagcaggaaattgaagcttgggcaggtgaaattgtttcttggaatcacctagttagttaatagtaaagctagaaatttacacctgaatatgttcatcctaaatccatgcttttcctaccaatcacatatatagagctgcaatctggtacatggtatgatatattacattttatctgtgacatcatcacatttaaattcagagaagaaagagatttcttttgtccccaaaagcaggaagaactaaagaaggctccatggcacaggtgggctttcgtatacggccagaaagatccactgtgatcctaataaatgacaaaaatcctcacacagcatctttgtattcaaagactaaaactgtcctggctcataataggtgctaaaaattaatcattgctaaaataaataaggacagatataagaagtattgacagatccatagacttactagtgcttactattacttacctggactcctggaatttagcatacagaattagagtgggtagtaggtcagaaaaagtacattcaaccccacaatggcaagaacctagttagattcttcctcttcaatttatgttgcaaacaatgaggaatgagacaaatatttgattggggagacacaagagtccttgggcagtgatataggaagatgaatggagaggctttttcattatttctcattggggtgttggtggtggagctaaaccagggtaatgctaaggagaatgggggaggaagtgggcagggataatactatgagggaagaactgacacaacttggaaatccacatatttaagaagaggtaagacagcagagataaatatgacccaagagtattcacactgggatatgaggaatcaggaaatatggaagcctatttttaaaaagctgattctaaatggtaagatattccactgccaccgcaacataaattgaaagtgagtgatggtattcattttgaagttttttgcagacagtgacctgcttcatagctttgagtaagagatgaggcagagtatcttggaaaaaaaaaaagccatacccccttcctaatatattatcggtatatctggtcatttttatctaatagagttttatgctctttctctcctttttttgtaacctttttagacttcatcctatttccagtttgcagaacctggagaaggaaaaatgcagaggctcagtctcttgttactgaatccactaaattcaccagggggcaggaagaggaaagagttacagccatctcgcgccacattctctaagtctctttggtgtgggtggcttagagaagtcttaggggtactgtgctgaatagctggtatatctgaaggaggaagaggaatggccatggtgacctcgtgtgtatataacaaactatcaaacaataataagagggataaaaacctgaagttggctcggcagcaatattcaacaaggccttgagaatgaatggtaatgatacgagtcagaatcagagagagagagaggctattttatattctggagtgttttctgatcatggacaggtatgttagcaaaagtttatgaagctgcctctttcgtgtcagccttgatactcaaggttagaggagaaaatttggggcagcgataataggccaggtatattaaaaaaaaaaaaaagtcacttcaaggactagcggtgaggcccagtggatatggataaagtatctgccagtgtaggagttttacgtaagaagagaactcaagctcaaaagccagactttattggtccatagcacagtgggcgccatgaagatacactggaggtagattatagcatagtgtgcagataacacaggctctctagccagacatacctgggtttaaatttcattactattgtctactagtgggaaacattaggcaaaattatataagattgtgtttatttatttaccttatttatttctcctctgaaaaagaggactgaaacatctctggataatgggtacctcttgttgatgccttcgcattatcttccccacgtcttttggtaaaagcaccttagtctctcctggggcatcatattccttactttctgtccatgtggtttagtaaagttgattctagcccgaggtctatctatgggcattttacctaatcagagcccataagatttaatgctaggagtttttctggaacaagcaagaagtccttttctttaacattggagtgaattgggaagatagaagcttctagaggccactgcaaagagatattttgcccaagtgaagctaaaacagaggaaaggagagtggaatgatggggagagatcaagctcttatgcctttaagaagcctatggatacagtggagtctaataaagttccttctgactttccagacccataagccaatatctctttaaaatttttttcttcttaaaacaggatgcatttttctatcacatatcttgaaagagtcttgatcaataaactatttcacatcaattatttgaggattgatttaaacgatatatgcaaaatacttagcacaaggcttggcacacagtaaatgctcaacaaatgggacttgttgaaaaagatggggaatgggaagtcattcacattgactggcattgaactgtggggaagaatgagaatgtgtatacatgctgaaatgcactgagtatagcataaggataaacatttatccttctgctatataatacagatgtcatataactcccggagggacatccttgaaacatagctggcattccaaaataacaaaggttcattgctgagtcagctcttgattttccatgtgtgaattagtcacagaaaatatgtatcaccattcagctgtccctatttcaagccagctgtctgtatgtcagagcaacataatcaataaggtaaggctgaacctatttttaattaagtgaaacagccccaagattgcattgtcttttgcataattaataggttgctgaagagtttctaatgagaaatgccttccattgctttatactaaacttgactcagatcctaacaaaccacactcaccatcctccagtagagaatttggcttttggcaggaggtttccttatttaaggcatttggataccactgatcgtccaccaccatgttctttgttcagtgtcaaatgcggcaccttagcttttacctactgaagtgctaaactaaaatacaatttcaaaatttaaagttttttctcctgtcttttattggaggatgagaagggagtaagtcttgaatttgaactgatctttcaaaacctggctgttacaaattatgtgttatgttggataaacaacatcacttcacttttctgtttcatcagaatggggataataaccgctaccatataatcttgttaagaggatcaaatagcatgattatcatgtggctagctagaccaatgtagttactcaacaaatataaatcccctgatggaattatatccttatgacactcagttctcccatctctatattttttccctaagaagaaaacccatcttcccttacagtaacataatctttgtgtgtgtgtgtgtgtgtgtgtctttttttccctttttaggaattacatttcctccaaccttgaaccatgcagtttgattaggtctcaaccccagactgtatttcaattcttggggtagatatgtgtctgacctacatgagtaatgaattatcttgtatgtccttgatccaagccaggcctctcagattcaatccctggaaatagagaaaaagagacagactggcttgatggggcttctaagctgttaaaatgtaagcctaggctgggcatggcggcccacacctgtaatcctagcactttgggaggctgaggcaggcggattgcctgagctcaggagttcaagaccagcctggccaacacggtgaaattccgtctctactaaaatacaaaaaattagccaggcatggtggcctgtgcctgtagtctcaactactcaggaggctgaggcaggagaatctcttgaacccgggaggcagaggtggcaatgagctgagattgcaccactgcactccagcctgggtgacagagcaagacaatgtctcaaaaaaaaaaataaataaaataagtaagcctaaagctgctagtgtccactgctgtcacaaaatggggaaagcaaacctgatcataagacaacacaaagaaaaacaaaactaatagagatagaaatagatatgaataatattaacactggtagccagtgggcattcaatatggttcttaggcacaaggcatgtaaccaactcacaagaagcatctcatttgatgaagtaggtattaattattttacaggggaaaaaactgagtcacacagaagttatgtaacttccccatgatttttttacttagtaaatggcaatgctagaaagtaaacctcagtgtccttgaaccccttgacctgcaagttgtactgcctcccaatataattgatttccagcacaggaaagaacaagaccactgttgctgtcagttaaattaaaaggacacctattctattaatggtaatattatgctgtctcttacatgatgtcctatatatgtaagtcagttttagaaacaatctgaactccttggaggaaagttcttatttatggttgctatggtagtattaataaaaccagctcaatactcccatacactgttcttttagataaacatagaaattgacccttctgctgttaaagcttgaaacttgtatttgttttatctgagttccttcctcaggaaaggatcttcaagcctctcaaaaaaaaagtattaaagaactgaaactcaccagatcatgaaccagatgcctccttgcccctccctagttcctgttttacaccctgttacattgatttcctgctatataaacccatacttttagccagggagatggatttgagactgagcccccgtctccttggctgcagcacctgattaaagccttcttctttggcaatacttgctgtctcagtgactggctttgtgtgcagtagggtcttgaccaaacctccagtgctttggtaacattatcagaaaccactgtgataacgtaagaataagctgttgcatgccataattatttcacaattgctatttattacttccaggggtggcatgaccattgctaccagaaataaaaataattatcaatatgttaggtgatgaggaaaaaatatgaatttgccttcatttcttctctagggaaattctatgttattacccatggtaacttaacaatttgatttaacactagagaaatctccctcagtcccatacacacccccaatagccaggttccaagcagaaatgattaaaggaggtttcttttaactacgcttgctgaattatcctagatagccccatagttcctacataatttgaagtaactggtttccagaagtgagtctaataaatattgctttgattgacaacttttctgtcagcttaaggtagttgctcagagttagaaaatacagaccatgtgggcagagaccgagattttcatcaacagtcatggtactatgcaatttacgagttcccatgccttctctagaaaaatcatccaagcttaaggaacccttgtgagccatttgacaagcacagttggcactgtggtcaaaagaactttgggctctcaccactgatatgcctgagtgggctagatttccagggctcacagtcccagccaagaacgtaaggctaagaggcagagacaagagcatttgttgatttagtagagcacagactgtggtgacagacagccttcattcaaattctggctctggcactttccagctgggtaactttagccaaattacttaccttctctatgccataggttccctatctgttaatgatgataatgagaagcttacttcagaaggttgttatgaggattaaatagcttaagtttaagtagtgcttgttgcactactaagacgtgaatgggcaagatatgtctgtattcaaaaacaaaagaaggaggttttatttattttacttaacacatcaatcagaattcacatacaataatgtgtaatggcttttataaaaataattttatggcttttgattagaagagctttgctgatcaagctttcacatagaagattccttcttcaaggaataggaaagaaaatattgcaattagcactggcggaagcagtggtgaggtctgttcaggttataataatgcataaataagacctctggtgacatagaaaacactgtatatatgtaccatttacatgggaagtgttctcatctcagttcctttctcttgcccatcctttcaatatttttcattgtttctattggtaggaaccaacttctgccaagccctacttcctaccctctagttctgggcaccatgtacagatatttgcagtcatttgaaagtaggacttgagaaaagatttgtccctcatgctttttcattagcaaagcagcaactccatttccaggataaactagggggacaacattcatttatttcagtccttcatttgcttactttctgaggcctttctatgcacatataacacccccaaaaagggagagaatgaaagaaaaagacatgaaccctctcttccataaactaactttatactttacatgtaaaacacacagagatgaaggtttctcatgaatacgatacaaaattagtaagagagggagaaaaaaacgctgaccagagaaggaagattcagtaagagacagagttgagatcctggagaaagaagatgtcaatttggactttagaagcaaggctcacagcatcctgaacaagagcaccagagggagagaggtaaataagcttctgtgcaacaaaaacctcctttagttacaaatgtctcattatgataggggaaaaagtggtatcttaccatatagaagtccctgtgttatctctgagccagtttgtttgcaaatagcttgtctaactttttcaggcagttttgctagctttttaagagatttctctaatgtagttctctggctttcaactcccacaggggttttagggcagtgtttgaaaatgagaaagataaaaatgcattcctcttagaagttcatataaaagcgaaagaattggagtggaggtgggaagctattatgtacttcggtgatctattctgcctgtaactctaaaggctgatgagaggcagtgtgatttcaggaggaatcaagaggagatactttcactgccctcattacagggagatcattggctcctaaaaggtcactgtcacagtgattctaaatgacatgaataaaggatatttaaactcttgtctgagccaattccttgtaacacggtttatagtagtaaaaatcttgaaacaacctaaatgtcttttccacaggcagattagagaaattagggtaaggtagaatcacgtcttttggcaggaggtaggatgtacattcaaaggtattgataaatattaatatcaaaatcacactagaatgttctgtgatttgttcttactttgccagaatctaagatcttggaaacttaaaagccacagttaacttctgatatttttcttgttttcaattttacccacccattcccatggacacagccacctctagtttaattagggggatgaactgaggcagttaaagaaaggaatgctatttcctttgtccctttctttctcttgctgcccccttctctctctcttcacgtatttctcttttcccatacacagattcccgctaacatatatagtttatgttttgcattaattaggcataagatttacctccaatctatatttttagagcaaaatgatatgtagttaactaaaaataatgatatatgcataataaactgcatccctcaaaaaaaaacaaggcatagaacagtgtgcacagctaccatttatgtaaatgcaagtatctctatctatatatgttagggactgaatatttttgtctcctcaaaattcatatgttgaaaccataacccactatgatgtgatggtatttgcaaatagggcctttaagaagtgattaggtttagcttagatcatgaggatagggtccttatgatgggattaatgccctgataagaggaggaagaggccgggcgtgatggctcacgcctgtaatcccagcactttgggaggccgaggtggggggatcttgaggtcattagatcgagaccatcctggctaacacggtgaaactccgtctctactaaaaatacaaaaacttagccaggcgtgatggtgggcgcctgtagtcccagctacttgggtggctgaggcaggagaatggcgtgaacctgggaggcagagcttgcagtgagctgagatcagaccactgcactccagcctggtgacagagtgagactccgtctcaaaaaaaaaaaaaaaaaaaaaaagaggaagagagatcagagctctctctttctaccatgtatggacacagacagaaggcagccatctgcaagccagaaagggagtcgttagcaggaaccaaatctgccggcacattgatctcgaactccccagcctccagaacaacgaagaataaatatccgttgtttaagccacccagtctatggtattctgttacggcaacccaagcaaagtaagactacatacacacaaacacacacacacactaacacacacacacacacacacacacacgcacatttggcaattcacagaacatttctagaaagataattgagaaactagcaatagcaactgtgtcccacatgacaaggggaaggccggccaggcatgctggctcacacctgtaatcccagcactttgggaagctgaggtgggtggaccacttgaggtcaggagttcaagaccagcctggccaacatggtgaaaccccatctctactaaaaatccaaaaagtagccaggcatggtggcgtgcacctataatccaagctactgggaaggatgaggaaggggaatcatttgaacaaagcaaacagaagttgcagggagctcagaccgcaccactgcactgcagcctgggtgacagagtgagactgtctaaaataaataaataaataaataacaaggagaaggcctacaagatctaaaatcaggaatgagaggaagatctacttttagactaaataaaacctacttatttagactgaaaatcttcatctgaatatgcgatatatgtgtatataatgcttttaataataaaaagtcactattagatttttttaaatgtctgtctcaaaggttccaccaaaatataacaaagcaattctcataaagcccctgcagttcactaacctccataatccatttgaggtttttcaagaagactgtgacacattttttaacattctcttaaagtgtttcttactctaatgtcacatcctgccctgaggggatgtgggcatgtcccaataagaacagaccttatgtgagagcactggtgagaacaagattccaatgggcatttactaggtcatatctgactaggtcatatcttaatgtgctacaagataaagtgagacttaccagtagaacctgtttggtacaaccccttcttggataagctgccatcttctcccaaattcagcagagctgtataactgtaaagaacagaaattactcagcactatggttctatagtacatcaaatacacaaacatcagttcattggatcaatagtaataataataatacccaacatttactgaacacctgccatatacaaggtgagtgctccatgtgtaccatctctattccttatacaaattctgcaagtcagactaatatcatcattttacagttgaggaaactgaagcttagaaggattaaccgacttgtgagaaattacatgtcaaagaagtggttgaatgaactggaatgcacaccctgttctgcctggcgataaagtcagctgtgccacttgacctagcatgtgctgagcattgtgggtgatgcaaagaagtgcaaaatctagacctggttctggaagagtacgcaatgtaacctgaacctggctcacataatgagaaatgcacgaggcagccagtgagaaaataatgcagaagacaggagccaatttagggatgctttccagatgctgtggtgaaacagctgggacctgaacgaatgacagcattcaaatggacaaaaatagcattattcacaaaaggaacaacatgagttaaagtggtaagatagacagggacaagatataaataagcctagcttatctatgtaagcttatctaagtaataattacacattattcaggcatctagccaaggagaatctgtaactttttctttctaagtcttttttattattcttttttttttttttttttttttttgagacagagtcttgctctgtcgcccaggctggagtgcagtggtgtgacctcggctcactgcaagctctgcctcccgggttcacgccattctactgcctcagcctcccaagtagctgggactacaggtgcctgccaccaagcccggctaatttttttttttgtatttttagtagagatggggtttcaccatgttagtcaggatggtctcgatctcctgacctcatgatccgcccacctcggcctcccaaagcgctgggattacaggcgtgagccaccgtgcccagcctattattcattctttggccatcatgcctgggggagactggtttcctgggtacatttcatgtttgatatattttatgagtgccaaggagagatgggtgacaactcccctcatagagataacagaagatgggacaggtcacactgtcttaactgagaactcaaacagccagtgtatacatggcctgcttcttgctctcagcatgtcctgaacacctggtatttcaacacagaggactgtacaacaacagcaggcacccaacccgagagtatccgcttctctctctctcccctttgtcttcttttttttaagcccggagctctacttctttctataagtttaaagggaacagagttcataccattgtggtgtgcctatgtcatatagatatatcgatatttagtaacatacaaaaattaatgcaaatgtaaaagtatcaggacagttcaaaataataatatgtctgggtaacaggctgaactcatatacatgctgcaagaataatatataaactctgtgtgctcctatggctataccaaaggattgctattcctgctcccacagagaattcatctctgtgaggaattgttgggcgccagcgtttgtggttctttttttctcttgttaaatgtatcccctaagcttgaatctggagcctgtggaccactcaggtatgtcccatgacatttgtttatatcttcaaagagcaactttgttatttgtgagcatatagaggcccctcaagtggtgggtatacaaaacaatccactaaaccaagcctctcttattcagcttactgagattctttcaatttactctctccaaaggtaactttcggtcctggtgggctggccctgtcaccttctcacacatgccctgctacgccttcactgaggctgcccactctggcagaagtggcttcaagactttccttcttcaacaccagtcttgttttcagagccagatgaaaggccacctcttctatgaaccctcctctacctactaagattcctaccggtctcatctccaaagaactgtggaacaagagcagatgctatcaaactaccagccacgtatttatatttaattctcttaatagcctttcaagagaacctttcacaaatgcaaggcagaaattcctttctatctaaaattactctaaaatatctaagaccacttcctgcctctttaatgagattgcaaagcttttagatgttggaaatcctatccttctacgtgtacgggtgcctcaaacacagtagatgataaaggaaaaagataatgattttgtaccacgtgaatttcctagtcacgtttctacctaatagagaacacaggtttcacaattggtgtacaaagaaaatttatcagaggaatatgttttgcttccatggatttataactagaggcgtatacctaaaaaacaaataaaacacacatccacaaaaccctataaatatcagtatatttgaaactcccaaggatttgaaagcagagtcttgaatattcacttttagacaaaattgctctatattctccacctactacttcagacattttctccctaaaaaattaattgtccagcctggtgttataccgaccaaaaagaaaacaacaactctgccattcaagttaacgtgttaattaaacctacagagtctggaagcaaagtgctcctccacaaagaagggaatggtatcaaagcattttacccaatgactgtctcagccaccagcggaaggctttccctgtagaatgagtcaatgtcctttaataaaattcatagtgttggcagcacctaagtaagatttatttccctccctgtctgtctctgactccaaggtttcttttgactgtcagaacacggaactgagaactatcattactatctgtcacatcagagaaagcagcagcagctttctctagctatgccaagcttagagaaagatagaaagattaggaagagaatgaaagagtacttaaactagttttaggagggcactattcctctactagtgccgtgtcatgaacttaaaaatgccattcttggccgggcgcggtggctcacgcctgtaatcccagcactttgggagggcgaggcgggcggatcacgaggtcaggagattgagaccatcctggctaacacggtgaaactccgtctctactaaaaatacaaaaaattagctgggcgtggtggccggtgcctgtagtcccagctactcgggagactgaggcaggaggatggtgtgaacctgggatgtggagcttgcagtgagccgagatcgcgccactgcactccagcctgggcaacagagcaagacactgtctcaaaaaaaaaaaaaaaaaaaaaagccattcttgggtttgattttgtttagctaacattagtataaatgttgaaaaagaactgaaggagcagaaatgttagagaacagggaaagattctggttatatctgcaataagaatgcaacacagaaaatcctttctgtgtaaaatcattctaaagtatctgtgactacattgcattagtaaatacaacttaatgagcacaaacccaacactcacctgtgctcaagatctattagcagccttagggcctaaccctccacactgtcattatgctactctggggctattagcacttctctctctatcctgacatgttcctctcctgaagggtttttttttttaagacatctttcacattggcttgtttccttgccatctgtctttgtttgctttaagaagaatgcagataaaaatacacttaattccaaaggatgaaattgccagggttagtttcattgagagctttgagccaactgttaggcatctctggcgccatcctctgaatgtctttggagctgccagttgggtggtaggcactgacaaagagggatgccacagcagggcaaaatagcctgggggagggaaagaatgggatgcactggttttgctcaattcctagtctacagcagatgaagatgggatgagagaagggtagcagccatttccaactttcatttccaccttaacattcacattttggttaaatccctagaagagtgacaacttgctactagataagaaattcaactccttgtggtgatccacaagcttgcaattgtcagtgtccctagaaagtcttttcaatattcctaaatcggatcaacgtatcctctcttttcagattgttagacaggtgcacgtgatagaattctcttttgcagctgggaaatgagtgaaagagcatccatttcaaagaaatttgtgctacgagaattccatagaagctaagagttgtgataacgttttaagtctttggttcatgggaccagatgttgttcaccacaaagcttcccacggtggcttccccggtcaaggggtagtttcctggggatcctccacacaggctccttaggaggcgcctgtgttggcggaaaacatcctgctgtcggctcttttcaaggttgcctgcccactcctctttccttctctcctcttaacattttggaagcagggggcctgcaaattgtacttcttgaaaaggctgacagaaaatcctgccagttctattttatttgcctcatcctaatactgccctggggatggcctgggtacaaagcactcatccaccttatgactctctgcttctcactgctgttcctccatccttttttagcaagaaagagatggtaccttaaggacttcatataaattcctaatgccaggcctgaggcatcacaaatatcaagttcttttttccatcaccctcaataggaagaaagagaatcagtccagagaaaaatgcggtcctcagaagtatgttctgatgctctggttccacagcataggagggggccacgacccatgcaaaggggaaccaaaatctacaacacttaaaaggattccataaacttcactaagagctgacacaagtctttaacttggctgttccgtacagagagcagatagtgaaagagccatgatgcccaatccagacccccacacccaaccctgccccaatagatttaagtttctcaaagaaaatgttgtgtattagtgatatcacagacaacctacagtaatgtgtaatattttgtgcacagtgttgtagtggcctatgttgtagagaaaaagtttggaatttgcaaaagaattcacagcgggctttgtaatacaattaatatgtcttagaatgaagacatgcagaaaaagtgttctaggggaatgggtcagtctgtgcaaataaacagagcagcaaaactcagggtgatgttctcacatttctttggtcaatagcaagagacccagtttggctgggatacataatagagtgaagtggaagctggggctacaaagagagcctggaaccaggctgggtaggtgcaatcttaccaatacttgtggggagctgatgtagactggatccaaatgtcattaaggtcaaaagataagagtatcaaagctgaacagtcaggctttgctgatgaaggctgggcaggaatgatggcctattgctggttccaccaatctctcctacagctggatttatcaaatttgtcactgcccattccccagctgtcactgaagtctgtcaaatgccctacagttgagggtggtactctgaagcttggaagattagacttacggaactagagccggttgggaagggagggccaatatatgactgtgggcgagtttgatttgtgaacacctcctgtgcattcaggtctggaggtatataggaaaatgataagataaaatcttggccttaaagattcttatatatttatttatttatttatttttgagacagagtttcgctctgttgttcaggttggagtacagtggcgccatctcggctcactgcaacctctgcctccagggttcaagagattcccctgcctcagcctccccattagctaggatcacaggcatgcaccaccacgcccggctaatttttgtatttttagtagagaggggtggtttcacgatgttgaccaggctggtctcaaactcatgacctcaagagatctgcctgccttggcctcctaaagtgctgagattacaggcatgagccaccacgcccggccccttaaaggttcttaaagacaagcgttggtggcatagaacagatgaagaactagctaaaaatttggacaaacaaatacctctctttcaaagcctacaaaactattaaatagcacaattgtgcctgttcaaatcttaaacccaattgcttgttttaaaatgttcatttctccttattcttgtagctctatttttttttcccgaaatcattagaaacaggcaaatcaaactgttccaggtagcaattgaaaaataatgatacaacctgtttaaacacagtatctaaggtgaacgtagtaggccttccttgtttgcatatgatggcatttcagcttgagaattcgttttataaacaagtgttggggttgacatttagcgagctccctggtttccactctaattgccagttttgtacttggatacttaaattactcacatattcatgaggttagaaatcagatctgacactgggaaatttcaagcacatgaaaatcctgccaaaccagcatggtatataatgctcaacatatttcttataaaaaactgagtgccttttaacttaatgcagtgccttggggaaacatgatggcattaggtagatatcagtttcctaagtgtttgtgcttgtgcagaaatcatttgaatatccccagggggttgaatttcaaggatcaatttgtctttatctcaatcttgcccttttgacattaaggggctgctaggtctattaaaaaacaaatagagttaatgtgaagataaatactttaatatttaatggttttctattgttataatcaataatatttctaagtaccacatatctgtcggtcctgttccattcattctgcttccatgggaccttttagtgattgtctaaaaaggcatttaaattaaattgattaaagtgcctgtagctctgcgtactggaaaggcacagggataagacagcctctgcctaagacatgctttgtctaattccagctgcaccacaccaggggtgctttctttcaggtctttggataatacactggctggcatctatgccatgtttgctatgtgtcaggctctgtgttcatattttgcatgcgttatctcagtatcatcaaatagtcccatgagccaggtactcttattattgttcccactttacagttggagaaactacatttaaacgacctgttgaaggtcacagagcaggggtaggacgtgacagagcagagagctgatcctcttaccagctcactctactgtcggtcagtggtgagaaaccttagtatgactgagattttgaaagcgctggcatctatttctttattaagtagtcaatatttcccagggaatgtctgccattgaaagcagccatgataagtattgcccttctgtgaaggctcactcaggaaaagaaaggaacaattggctgggagcggtggctcacgcttgtaatcccagcactttgggaggctgaggcaggcagatcacaaggtcaggagtttgaggccagcctggccaacacagtgaagccccgtctctactaaaaaatacaaaaattagccgggcgtgggggcgggtgccagtaatcccagctacttgggaggctgaggcaggagaatcgcttgaagccaggaggcggaggttacagtgagctgagatcgcgccattgcactccagcctgggtgacagagctagactccgtctcaaaaaaaaaaaaaaaaagaaagaaagaaaggaacaattaaaaggaataaagagaagattttttgtttatagatatgtttatagatatacatgtagaatagatatgaaactttaaaaacattgcaggactggtagagagagaaagaaggcagagaactaaaattagttcttttttaataaaattcacttttatgcatgttactaaaattctgtcattggctgttcatcacattggcagtccatttttccttttctatcaccatatgattttaactgaaagtcagccttcatttctgaagagaatgccagctgttaatatttagagtttccagccaggcacagggctcacgcctgtaatcccagcactttcagaggccgaggcggatcacttgaggccaggagttcgagaccagcctggccaacatggtcaaacccagtctctactaaaaaaatgcaaaaattagacaggcatggtggcaggtgcctgtaatcccagctatgcgggaagctgaggcaggagaatcgctggaacccaggaagcagaggttgcagtgagccaagatgacatcactgcactccagcctgggcaagacagtaagactgtctcaaaaaaagaagaaaaaattagattttccattatttgtaaacagaacctccctatcaaagcctgttttctgcctttaaaagtatgttttggtatctgacacatatgtaccaaaaaatgttgaagggaaggccaacatacaggccttaggattttctgtttatttcataaactgtgatcctttggaatttaaagaagatcaggaatgaagcaagttttccacatgttcttacttggactcatagagctccaaaataagcgagtcaatataaacttacaaatattctagaactgccacaaaataaagggtggcccaccaaactgtcctaaaagttttattctccctcgacaaaaccgatcatttatttgaatgtacttttttcaaaaaatcgcaaaaaaaaaaaaaaaattaacatcttctcaaataaaatcaaaagagagacccatgaacaaagaaaaacaaagataatgggaaagaagaaaggacaaccacagggcagcagatgaggtttatttgtcctatgcagtgcttctttttaaatttctgaggtcattgttacacacataaaaataagaaaacttcacattgaaaacaaagcagaattacttctctcaaaaaaagaaagaattctgaaggtctggtgacattggacccaccttcctacatggcaagaacagcaggctagagcttgacaatatccctccctccttctaaatgaacacctgctctccaacttcccacagcctggacccagcctgttttgttcagttgtacttcttgcctgtttgtataggaactgcgttcatgctctacgtggtcttgaacgtccacaagggtgggaattgcacaggacaggagaagagcagcccttcctgctcctggtaaggggcagcaggcccttctctggagctacctgaagaagaggtctggataaggacagcaaggggcctctgctctccagccactcagcagcaagagtcctgacagcgttcatgttggtttcacaacatggcactctcccctttacaaatcacgtctccgttgcaaatcctaacagaggctccaagagcccttaccccggcatagacagcaaagctgaggtatacacagattcttatacttctctcctgttttttttttttaaatttccttacagtcacatctgctctttgttttctctcatttcaaatgtttcccaacacatcatgtttagtgaggtgtttaagacagactgagagatgccgttggaggcaatgttttatagcacagtttgtacactagtttattgccaaattgaaataaagatgtaatctggcaggctcagccttctgctaagccttccttgggtggtttcctgtattgaggcaagaaagtcagctagcaatgaagtaaaggactatatctcctttctcttatctgctcagtttccaaatgcaaagaatttttttaaatgggtagaatgcttggtttgcctactgtttaaattatagaaataaaaaaagtaaattaataaaagaaagcaacattttggtgctcctataataaatgccatggaattcttcatactttccacaaggattcattgttttaaaaatgtgaggggtgggattgtagacaccaagtagccccctgtccatttgaaacagaatctctataattgtatctataatgttcctttttctgaagatttcagggctttccaaaggcacatcctcacataggcccttcagaggccaagtccagctcctatgtctttactcgataagtctcagggcagggtttcctatgaacgcaggctacttatttaagaatttcaatgggtaaaaggctccacacattttcctttcagtcattctagtggtgcctggatagccacatccccagacaagatagcatttacctcttggcaactatgatggtggtcaattttatgtgtcgacttggctaagagatgcccaaagagctgataaaacttatctgggtatatctgtaagggtttttttagaagacattagtgcctaaatcagtaggctgagaaaatccaccctctccagtgtgggcaagcatcatccaatccttggaggtgttgaatagaaaaggcagagggagggtgaattccctctttctttttgagctgggatatccatctgtctcccctggccctcagacatcagagttcctggttctcaggactttggacttggaccaggacttacaccattggttccacccccaaccaattctcaggccttcaaacttggactgaattataccactggcattcttggttgtccagcttgcagatggcagatcttgggacttataagcctccacaattacatgagtaaattcccataatcaatcaatcaatcaatcaatcaatctctctctctctctctctcccctcctctctctctctcctccccttattggttctgtttctttggagaatccttaataatacaaccacctagatgttgaatatcacaaatagatttctccttctaagtaaaaacaaaaaatatcaaaaaccttggtttgtgaattctgaggacatttggccatacacattcttccctgattaaaaccaccttttaaaatcttaatatgacctcccataggactgatatccagtaaaattctatcttggaccagaaaggaacacctgttcaacaaaactctttgagtcccttataatgcccacatcaaaaagcctccactgggatttaggcacccaaaatgaaacacaattagagcagggtaccgcagctcatatacggtctatcctgcaggccggagctccaaactctgtccttaggagcttaaaagtcacatgcactgaaggagagaaaaagcaatgtcagggagataaggggaaaataaatgtggctatgtgttcaaaagacggagagtatgccttaaaaaaacaaggaagccagcaaataaagaaaaagagaaaagaggaggaccctgttcataggaattgccacctcaataatgcattttctaagggattgttcaccacaatttgatgtaaaacagcatccagcagagataatactaagtaagatcctagctgggagatctgcagcagtgacattagcagctgtcacagaaaaactgatgagcaatacttacatgaaagaataaatgttcctgtttcctaggcaagggcagtcactggccagccaacaccagcacatggtcctccttgttgccacacatctcatcagtgctaaaagttccacgacccatgggggactgtcagcttttatttccgtatcactgacccacctgagtggccacagaccctctcaacttgacttccagccaatgccatcagctaacggctgcggctcactcccttccagcgaatgccccactccctattctgtgattcaagccttgagatacggaggtcttctctgattcctacttgtagagctggctatccatgatgtgttttttccagtatgatttatccttcatcctctcttaaagaaacagagaggtcagtagaaagcctggctctttcccatctgttcatctcaaaatatcaccttcaaaaacgagaaccctggctgggcgtggtggctcatgtccgtaatcccagcactttgggaggccaaggtgggtggatcacaaggtcaggagtttgagaccagcctggccaacaaggcgaaaccccgtctctactaaagatacaaaaaattagccaggcgtggtggcacacacctgtaatcccagctacttgggaggctgaggcaggagaatcgcctgaaccctggaggcagagattgcagtgagcccagattgcgccattgcactccagcctgggtgacagggcaagactccatctcaaaaaaaaaaagaatgagaacactatcaaacgtcaggtagccccttaccccatttgtagaatatccacatgtgataccaattagtgatttttccctttgagaaaatgtgttaacctcttagatatttagatccttggcctcatacagaaaaacaacaacaaataaatgaagactgcttccaactttaaaatgacaggattcattgggtctgtggtcacaaagggtaccttttggttcttacccttagcatctgatgccaggactgctgtaatatcatcccaactggtcttgtttttgacctcatattaccacagtttatactgatattactactgattaacgcttgaaatctatagccctaaacatatcattctctggatgcaaatttctgaaggctcctaattaaggaaacaaaaattagttttcctaaaaatcaaacagccaaaacagtgaaaaataataaggattaggttccaaagtgtgtgtgtgtgtgtgtgtgtgtgtgtgtgtaaattataactagctataacaaattttagtttcagccaaatagaaaaatttgcaattttgtaaatgtgatttttacaatttcatgtatatgacattcctgttgtaaaaaattggcctcccctactgttacaatagaaatccgacatatccattaaagtccagctgaagtcattttgtaagacttctagagtagacagatcactagatctctatctcctgaactttgagctaccaatttaatgtaattcatccagtcccttgtatataatattcagtgacagcactgcctttgtggcctctcttaaactattggtcaactcatatgtgttaatcatctatctccagatggatagaatattgttattttatatcaacactgtatcatgcatggcacttaaaagagatgtggcatctaacatttgtttctttttaaatcactttggaagggtacctacaattataattatccatacaaacacattttaacgcaaaggaaaccaacgctaaatactattcaccataagtagctgggatgaagtcacagcccaggcatcctaactggtcttgtatcatccactctgccacagtgaccatgggaggcactctttgaagtgctgggaacgaaagggttacatatttgggcatctcctccagcataactgcaaagatgcaaagcttttacttaggcaggtaaatctggtcctcgctgtgcctctggcatcggtgggggggaattaaccaactgtcgaataaaatgtaacaaccctgtggattaaatgactaatactctgtctgagctggtcaggcttcgcctctgttaattgcaccatcctggaccagatgcactgtggcttgactccagaaacaaaattgtacattctgctgaaagggtagccaggctgctcaacaggaaaaaaaaatgaattgtaaattctttctatttttaggattaatgtgcattttatttggcagtaggggcagcatgaataaaactccaatcttaagaattttaatttgcttcctttaaaatgctcctgtcagtagagaccttgggaagttgctcataccattctcctaccttcaaaaatgccacatatctatgcaaacccagacaaatgaaaccccagaatattcacctcacttagttaagtccagtatttctttaaatttatataatttctaattcatgatccctctaaggagaattctcagaatgacttcactgcataatgcatttcacaaggagtattctagtatttcaccaattatccctctggtttttatggccagagtctctctcacatttgcctgtgtaaatgctgtttcttttcattttaatttaattttattagctattgctagccttttattctacctgagaaagcaagttccttaaaggcagggaccatatgtatgttatagtatatatgtcgtatagagtacataatatatattataggatgacattttatgggtcatatgcacatatacacacacacagctaataccatgagctcatttaatcctttcttacgaagtggacttcttcaactttaccaccaagtgaagaaaagttctgagatgactaggttctgcataaggttacctatatacatcattattgttcctctggccatttctctcagtgttttagaacaaccctgcttcgtgttcttaaacttttcagggttatgcttccctttaagagtttgagaaaagccatgggtctttcaccaagagaaatgatcaccaatccacaaacataagacactgtctccaattcagtgggggtcagaggctcctgactgccttaagcatctatgctgagaactgcttctccaccatgtcttacttagtacacctaatctttatttggtaagtggtttcagatatttacatgatttaaacaagcaacctgagactctccttgctttcccttgtcccattagcacagaggtcaggctactgctcagaacaaaaatgatcactgaggtgaaatggagagatgattaaattagcactattttccccggagaaccatgcttcattgtctcaaacaaggtaagtatgctcaccttttggtcttgactgtatgccagaatccagtcttcttgtttggggtgaaaaagcaagctttgaatgtagaagttcagccggtacttttgataagttgccccttcatctgagctgatcaataaactgctctcaatctccgggtctgtgagtaacattatctgcagcaaagaattgttggagaaagaaacaacagaaaattaagtttacaaatttgcaaaacttgaaaattagctaatttttgacaagggaaggacaggggcaggcaaagaatgcttggccaaacagggaccttgactctgtcaggattatttttccatcttggatcaatgctacagaaatatttctacaaagaaatgaagggagtaggagaagctggaagaacgagggatgaaatagataactgtattctcttctcttttaggggactctttgttttatttccaaggttatttcctgaacctggaacacttacccttcttcccttcttcctactgtgccttatgcactttccattttgggggattaacagactggttatagtctgctgtgggaaaagtggaagagaaagaggatggagtccattgtttttcttccctacctcgaatcttttcattccacttcaatgatttcctacgccatccaaacttagcctgattttctgagtcttaagtcagtctaggctctaaagctttctctaggaatttcacaaaggctattttaccccaccaccctcatcaccttctagcctactatataatttacttatttattttgtttcttgtctatataacctctactaaaaaataaaccctgtgcgaacagagatagctgtctgtatagttcacagatgaattcccagcagctagactaaggtccagtatgcatggtacactgataaatatttgtcgaatgaatgaataaatgaatgcatagaaagatgcccagaacactctgagatatggatggaagcttcacaacttctaagtctacatgactctctaaaactctctgaaagaaaagttggttgctctgcacagtctgcaccacagaagaagctataaatacgtaaaaattcacagcttcagacgttttacactgtctcattgggatgcccaattttgtccagagcaatgggatcaatcacaatagcagcaagatggaggagctgccttcgaaactgccttaaatcctcattttatgccttcacgaatgtgtgataaattacttcattcccaactctctgtgggtctttcattcaaagtgtgcacctaatgtctccagacaggtggccttaatgctacccgttgacctcttccccatcaacttattaattggtactttctgaatttggttcagggaagcatgaaatatgtgtttaatgtgttgctgtatgaaaagaaatcactgcagcccaaggattaaagattaccagctgaggatgctgcacttccaagaaagagagagagaggggaatagaatcatatcttaaaagagcagagtgccaggcaaacacatggagctttctcaagcatttggaggcaatcatattaaagcctctgaacagttagtgtcatctttgaaagtggtgtcctgtcactgtaaatggcacaaaaggattgcatgccagacactctgcccaaactctgtttatgctatccaggacgaatttaaggttccttgctgttctttcaacctccccttcttgaagaggagaaaagggatgtaatggggtgaaggcaatgctgttgctatcagctacactcccgacaagatgaaaagcgcacacaaaactgaagactaattgcctcttgtaccatgttccaggaaagccactgcccaccaaccataaattctgacaaagttatggatttctctgtctcacattcaccaagcagacggcgttccctcatcagatggccgacaaggagccatcaggtaatctacgaagtataaactcatatggcttcattaaaatctagtgtatgcattaagcaagtacatttagatggctcctaaattcacaggaatatttccaagtgagttcatatttatgaatacataaaacctgtcattttttgaataacaaataagccatcaaatgatcatattgttttgtgtctccaatcacaattaacaataatgtaaaacaacctttttgcactactgccgaaaagtcatttccatgataatatgaagaagctcaattttatagaacatctattgtctcaggcaaggtgattcccttccccactctgattttctagttccctgttagccagaatatgctttcctcttttcccatgagtatagatctccccacctgcttctcctggcagaatacttaatcaaaataaaattaaacacaattacaaactaggcctacagaatattcccaaagcaagctgatttttatcaatcactttaaagtatttttgatacccatttatgctccacgtgatcagactgcataagacatcctgtatcaggtaatattgggtgcgagtggcagagtaacgcacatatttcccaacagatggaaacttaatattataaaaataaagcgactcgtatctttggctttttttctggatgttgaaaataggcagaccaaaatcccaccttctctatgcagccctcacctaaaactctccatctgagaatttgacattttggaaataatgggaaatagaaatttcccggtgagctttataggtatgtctgtactacagaaacattccagtggctgctctcttaaatttctgttcaattctactcagaacaaacaggtcaatctggatccatttttcattagttatttttcttattgcagaaacaactccataagacctctggtagaattcaaaagaaaaagaaaacaaactcatgaccctatcattgcaagttaaaccatgtttgtgtttctttctacttctttatccacatctctatatcctattgtggattgaggattttattctggttttttcttttaagtttgacattatggcccatattttttttttttttttttttgagacaagagtatcgctctgttgcccaggctgtaatgcagtgacacaatctcagctcactgcaacctctgccctctgcctcctggctaatttttgtattttagtagagatggggttcgccatgttggctaggctggtctcgaacccctgacctcaggtgatctgcctgcctcagcctcccaaagtgctgggattacaggcatgaaccactgtgcccagccccccaaatattcatttttaactgagccatagacacacaaatgcacacacgttaacacacatgactgtataatgtactccaattaatcacaaccttcaaattaattaaattatgattgttgtaatgactgaaacatagtatgtacctaattgttaattgaataagtaaaatcttattattttagtcttaaattcaaattctttaataattttgcttcaaatgaattgatgtttgtcctaccattttatcagtaataaaatataaataagctaataagtaaaaaatttaatgcgatctaaataaaaaagccttaacatacttgagaaacaaacactgaaaataataaatatgatccagtctttagacatagatgatattgttcataaatgaataagtcatatcttctcacaagattttctgctcagaaatattttcaaaatagtaagttcaaattagcaaatattcttcaaaaacaatagattacatttcttaaagatgcctaacaatccctatttttgctagtttagaatgactctttatccccttctgactcttcatgtaactttgaacaaataatgttttgttgtgtttacttctctgtattctggagcatgttctggacaacagaattttagcatgcctttgtaaaaggcatgaatccaagctttgcagattcctaaagtaagctctccaaaaagagaggtcattgtctgccaggatcaaagcttgttccatagtaggtccacatactgttgtaaatgaataaaggaatgaataaatgaatgagtccttttcattcctgccttctgctgcctgcaggccaggggcccctgcaacactgggatttccagtccccttgagcaaatcctcgctgttctacttgaggcaaggaaggtgaagataagagaaagacactgcctttatcaggaaagtaattattccctgttcagttccacccatgagtgattagaaccagtttacttatgccttgcagggtgtgccgactgactgcacctgcagatgaattgtttccatagaaagtcaataatggcaacacaggatcctaccacccaactccaagcaatcattcatcacccacttcagaaggaagaagaaactttatttgcttttcctagagtagacaaatgaacatgaaatgcaatttatagatttcaaatacgtcacttctccttttttttttttttggtattagtccttctgacagctcagtgtcatcaaaaattaaatgcactttcactgtctttagtttgctccagattcaacatatggctacaggaagtaattctacaaaaggttggcaggcagctttctgatccttccagttgtcgtctcctgcgggccttcttcccagaggaatgctgctactatttagttttccaaattcttttcctagatatgctgttcttggaattccaccatttattggtttatgtggcgtggagttaataaaaagttcttcaccacctccgggcatatactttttcgtaccatttctttggtcctaatggaaaaagtatttattttatatgttgttcattatttgttggctcatttgtctattctttgtcataaatgggctggaatcaagcagaggtaatgggctgctgtgtggatatctcttttgctttactcagagcttaattcagctccagatgcccatatcacaggtgcataataaatgcttttcataatgataatgacaacagcaaagaaaaacagcaacagcagcaattaggcactccagttatctactgctacccactttattcaaacagaaatatttctctctataaacagaataaaagtctatttgcaaacctctgatctcaaaattaaaatcaaattaagcaaaatgtaatcagagaaagtaagtcatctgctgaccaatgagggtggaaaagctacctattctcaatgagggctgagtacttatccttcccagatgagctgagggaaagagcaattaagtgcttatcaattggcaactatttggaggacagtgttagggaaagttgaacaggatcccagaatgaaccatggaaagaaaatcacagaaatacaaacagtgaaggaaggggaggaaggggattaaaaagaaaaaagctcaaatcaagcacacactgatagaaatgagtcaaatcaagcacacactgatagaaatgagtctgtaagaagatggaaatgacacaaccaattttcctaaatcccatccttccaaactcagcgaagcttacctatgtgccatctttgtttattagcacaaaatcgcgtcattcaatactgagatgaacagaacatttaggcaacagactgtctgcttgtgacctggaaagtgattcagtgaaatgactgggaaactatggcattgtattttaaagagtttattctgtccttttgatttcaaactggttttctaatgaggatccacagactcagattttttaacggaaaaaaacaagcataaaaaacattttttaagacaagatcttgctctgtcgccccggctggagtgcagttgaatgatcacagcctcaaactcctgggctcaagggatcctcccatctcggcctcccaaaacactcagattataggcatgagccaccatgtaaggctgggaagaaacatttttttaaggagcatgtaatttcagtccttcatatgtgtgttaattgccttgtcaggagacccaacccattaattattatttgtaacaataatgaggagtcattcagtacctcttggccaattccacagagtacatagaagatgagtaaggtttatcaggaatgacaacatatgagttacagtccttggaagatgattcaaaaaagaaaacgtataggacatctcttcttatttcacttgggactactgaacatagtcttctcctttgagacaatttagagaaacccaaacgtacaaacactattttactgtaagaatctgcttccaccattgtgaatggcactgaacttctataaaggaaatatatgtccacgtatatatttccatggcgggttgatccacagggctgagcatggggctggtgcaccacagacttctgttccacaggaagagccataacctaatcctaaacctggctctagtcaatgtcttcatgaatgtgtacttttcctcacaaaatagaaaagaagggagtgtgcttagtgaaggtcattcacaccatgagaagaaaggtaagctacaatcacaagaaatagtaaggggcctgggtttaaaaactcggatttgaatttcttctctgctattatcagttgtgccactttgaataccttatagctcattaaatcctttttttgagtctcagtttcctcattgaagacagtagtgataccacaaacaagttgccatttattgagctgttgtgtatcaggctccctgctaaagctttaaactaaattattccatcagattgtttatgaaaactacttcaggtagatatcattatgtccatttgatatcgggcttagagagatgaggcaatttgctcaaggttgcacagctagtcagtggtaaggttatctatgtcatgccctgcagagattcgtgtgaagatcagataagattatctgtgcaaaagcactgttaagttttgtgcaaatattgcgtttacctcacaaaggatgacatatatagtactttatgttctgctaaaatatgatagttgaattccaaaaaagagagggaaagagatttaaatctggcattacaaatatctcataaaaatattgcctagatgaaaaaaaagagacagcaagaagaaatggggtgtaagataatggagaattccagtaacaagtgtaagacgacactatattcttgaacaaataaagataatttcttggttttaaatatacagtcagaagatcaaaacagccagttatggttcataccccagatttttcacaatggctctggcttcctttaccttgtccttccagcatgattcttccgtagattggattttatgctttatcataaaaatggatgggaaaaggataataggaatgggcaaaaatctctgatgtaatgttcttattggtggagaaacattttcccacatgctagttcgcaaagaagtttatgctaaagcaaataagaactattacagtgtaactattttcctaataagtgcatcccatgcttaactgtcatttaaaaaaaaaacagactcattttactggagaaattgctattattaatatcatatgaggtgacagtgcagaatatggaatattcactaatgcttagcattgggtcatctggtttaaaaaactaaacctggggccgggtgcagtggctcacgcctgtaatcccagcactttgggaggccgaggcaggcggatcatgaggtcaggaaatcgagaccatcctggctaacacagtgaaaccccatctctactaaaaatacaaaaagttagctgggcgtggtggtgggtgcctgtagtctcagctactcaggaggctgaggcaggagaatggcatgaacccaggaggcggagcttgcagtgagccaagatcgcgccactgctctccagcctgggcgacagagggagactccgtcaaaaaaaaaaaaaaaaacctaaacatggtatttcagagggaaataatgatgtacacattcaaagaatgtttttattattgcagtcactatgagaactaattaaataccttgagaatatttgagccaccttaaaaatctcattatcctatagcctccgttccaacccaatcagaacacacttccatcaacattacaagtcccaaagtaacttctctcttaaatccccaaaggtctataaatgccaaaaggttacatcattttaaaatgttagctgctatcagaaggagccatgatgctaagagaaacagacattcatcttctttgctcatgggaaactttacaagaaatgatgttcatttaatgataagaaatctctttattccacaagaaatgataaagaaacacaggtgagaaggaagagagagcaggaaagagaagctatcagtctatcttaacattgatttaagtgagggaaatccatttttggtaaaatctgtaagttgtgtacttgactttagagtttgaataagtgtcaagttgaaagtcaggaaagtaaaatgaaaagtccatagacattaatccactctaaaaatcagtgaacagaatccatccacattcttcatcccttgctgtatttgtatcatcatcctaatgaaggagttcaggaaatgccaccccaaaataccctgctttggtacactgattacctcaaactgagggctcttggggaacagccaatgctggcaggagctctctctgagctctccttatctgtctgaagactgatctaaaataactcaattgtcataatttccttccccaggaatctcatcaaccaaagatgaactcagattacagaagagactagaagttgacattacaaccagactcgctatcacctgttcttctgagggcccatttgtctttcccaaaattcatttacttttccctaaattgcctacatccctcctctcctccttcctatgaagtgggcatataagcttttagatctcactgggtttttggtattcacttttctttcatgtgatgcccctgtacatgtaatacatttgtttacctgttctcttattaatctgtccagtgatggtttatttcatggactcaattataaagcactcagagggtagagggaattttttccctttcctacactaacaagtacgttttaattttacttatattaatgcttcatgataaactggcaaatatactagggtgtactggggaagattaatgaagtctcagccacgtgagaccttgctaatgtatttgactattaaagctttcctgaaaagactacggagaccaccagggatttctcttatacaggatttgcagattagtgaagtgagaatagcctggtgcagctctactgcagagctctttggaagatgggcctagagggggtcatccaggaggaagcctctcatattaacaatgaggtccatttcatgtaaaattttccttccttcttcagttatttaatgacaaacattgatcatctcaagttgttgatgagaggtggaaaagggtcaatgtgcttaattgacatgtcagagcataattacatcatctgctgctttcctctctctttttggatttcagtcacagcaggaaagacagcagtgcggtgttttatgaagatgatttttttcatgactgcatattctaggtttaattctatctcaatatacatacctcagaagcattagaactgacatagtatactaaagagaaaaggagttctattctacttatgtattgtataacaatctatctcagaacagtggcttcaaacaagcattttgttttgtttaagattttgtgggtcaggaatttgggaaaagctgagctgagtaggtagtctcaaatccacatgatgtcaactgtggtggccagagttggatatttcacttccaagatggctccttcattcctgtatctggttggacctctccctttctctctgcatgacatcacatcctccaggaccccccatgtggctgaacatcacataacatggcagtttcataatagttgaatttcttatatagcagtggtttccttcagtgtgaatgtcccaagatcaagtattccaaagggctaaagtggaaggtgcaaagctttgcatgacccatccttggaagacccaggacatcaattttgccacatgctattggtcaaagaattctgggccagacttaatgggaggaaaaaaatagacttcacctctcaagggaagaaaagcatgcacacgcacacacacacaaacacacacacacagaagcaagccatattgaagataagtaaccacaactatcttctgtaaaacttgtcacataatttttaaaaatagatatgataaaaagttgtaattattatattcaatatgaattaaaatgtcctcataatcatagaattcctgggatatagatatcttgaagttgccagaattttcattgggtcttaccttaaacttttgaaggctgaaaaattctaatctgttatcagattaaggtaagtgtatttattgaagaccaagtgaattgcattgtttagtccctctcagggacattaagggagccaaggttgagtaatttcagtgtgtgaattttcagggtacataaattacccagattaaattatagaagaatagaccagttcaatgtccattaaagtgtgcctaagcaactctctaataaaagaacctatatctaggcattataatcccctcatttaattaaggatctgatatcatgaaatatgggtttcttaagagcaaagtagtccttgctcttctatgctcacagagaaagcactgatatcatttacaacataaaccagaaattgaaaataggatacttagtgttcccttcagtttggaaaatggatcttaaaataaacctaatgattttcaggtatccttgggctaacaacaacaaaaggccatttaggtctgaaagtgaatggtaaatgtattctagaaacataaagaaagttcaatttttatcatgcccaggcccacataaaaccatctaaaatttttattttattattttttaaaattgtatttgcatctggctgcatagctcaattcctgctgctgctatgccaaccctataaaacactcatctgctccaagttattaccaacagggaatccacacttcaagaaaataaccacaaaatcagctctcttgacatcagtggtatttctcaacaccccaaaagtattttgtatgcaaagggaacaaaaatgttgccttctttaaaccgtttcaaacaacacgatcttttatggatctggcctagtatcttttatacagctagtcaccacaattgcttataggcaaggatcctcatcaatcagaataattcctaatcaaggggctaccatgaagtccaattataaaagctccaattctgttttgtgactatacaaaagccattttcagacccaggttcatattcatgataagttgaataagttcatgaagatactgtcattttaaaagttgtctgatcttgattcaagagctgccttgatcatatgaaagacagttcatagatggtttggctttctttgaatgtgtcatgaatagggtgaacatacattacatgttgcctttgaaagtcttggcttattcctatagcaccatcataaatattattactgacatgcagatatgacttggatgataaattaatcaaacagttataaaaccaacagagctcatgagaactcactcactatcatgagaacagcatgaggggaaccaccctcatgatcaaggtctctccttcaacacccaggaattacaattcaagatgagatttgggtagggacataaagcctaaccatatcattctgccctgggcccctcccaaatctcatgtcttttcatatttaataaccaattatgccttcccaacagtcctccaaagtctcaactcatttcagcattgactcgaaaatctacagtccaaagtctcatctgagacaaatcaagtcccttctgcctctgagcttgtaaaatcaaaagcaagttagttacttccaaaatacaatggaggtacaggtattgggtaaatgctcacaccaaatgggagaaattggccaaaacaaaggggctacaggtcccacacaagtctgaaatccagcggggcaatcattaaactttaaagctccaaaatgatctcctttgactctatgtctcacattgaggtcatgctgatgcaggaggtgggctcccattgtcttgggcagctctccccctgtggctttgcagggtacggcacccctcccacaccagctgctttcatgggctggtgttgagtgtctgtggcttttccaggggcacagtgcaagctatcagtggatctaccactttggggtctggaggacggtggccctcttcttacagcaccaataggcagtgccccagtgggcactctgtgtgggggcactgacccatttcccttctgcactgccctagcagaggttctccatgaggcctctgcccctgcctcaaacttctgtcaagacatccaggcatttccatacatcctctaaaatctaggtagaggttcccaaatctcaattcttgactttgtgcacatgcaggcccaataccatgtggaagtcaccaaggcttaggacttgcaccctccacagcaatggcctgagctgtgtggtggtccctttcagccacgcctgcgacagagggcaccaagtccctaggctgcacagagcagcagcagtgccctgggcccggcccacaaaaccatttttccctcctatgcctccaagtctctgataggagggacagccatgaagttctctgacatgccctggagacattttcccccttgtcttggcaattaacatttggctgcctgctaattatgcaaatttctacaggcagcttgaattcctccccagaaaatgggtttttcttttctactgcattgtcagactgcaaatttttcaaattcatgctctgcttcctcctgaatgctttgctgctttgaaatttcttctgccagataccctaaatcatctctctcaagttcaaagttccacagatctctagggcaggggcaaaatgccaccagtctctttgctaaagtatagcaagagtgatctttgctctggttcccaacaaattcctcatctctatctgaaaccacctcagcctggacttcactgtttatatcactaatcagcattttggtcaaaaccattcaccaatctctaggaagttccaaactttcccacatcttccagtcttctgatccctccaaactgttctaacctctgcctgttatgcagtttcaatttataccagtactccactctctgcagtaccaattcactgtattagtctgttctcacactgctctaaagaactgcccaagattaggtaatttataaagcaaagaagtgtaattgactcacagttctgcgtggctggggaggccacaggaaactgacaatcatggcagaaggcaactcttcacagggcggcaggagaaagaagaggtgagcaagaggaactaccaaacacaaaaccatcagatctcttgagaactcactcactatcatgagaatagttagggtcgggtggggaccatccccatgatccaggtctctccctcaacacctaaggataacaattcaagattagatttgggtagggacacaaagcctaaccacatcatggtgcttctcaattcataaacaattgatactggacttaattccttcaatttgttactgtaacatcagagatttgttctaggtcctgatgctcaacaattggtactggacttaattccttcaatttgttactgtaacatcagaggtttgttctaggtcctgatgctcaccacacagaaagccaatcactgagacgatgagttattaccaaggaaaaaggctttaatccggtgctgcagccaatgagctgggaactcagtctcaaatccatctccctgactgactgaaactaggggtttatatagcagggaagaaatgtaatcgtgtgtaagaaaacaggaactaaggaagggcaaggaagcaatcaaagtgaaagaggggtccaagcttctcattgtcaggatgtggtaatctggtgagtttcagttatttgatacttttttttgagaggcttgaaggtcctttcctaaggaaggaactcagataaaacaaatgtaagcctcaagcttcaattgaccagaaaggtcaatttctatgtttatccaaaacgacagtctatgggactattgggttggtttcaaattcagaataaaagaatgaagacaaagagtgctcctagtgatggccggacaggtttttaagctacttgtccgatgtctagctcttgctaggtatgaatctttgtgtcaaagatacaataattttgtttcttttcatttagtcatattatttgctttaaagtttaggtattgtgttcacatatgaacaagaaaaaatatgcattaactgcagatatttttgaaaaatgtccccaaaaacgtactcagaataaaagaacaatcacttaagcatcactatgcagagattattgtcactgacactttgatatttgttttcaatctttgttttatgcatatatagatatacacacatatacataaatgtttatgggtgtcagaaagagacacaaagtgggagaaagagaaatttatacagcaagagggtgtcgtgtgacacttcctgctttttaacctgcttttcccactttaaagccgcacttcgaagattttctatggttttcaatattcttctgtgttatcatttttattggtgatatagtattgattgtacaaatatgccactatgtaattaatctcttatttaccaggtttccaattttcactaatattatgattaatgtagattaacatttctgtatgtcaattactatttcctcaagtaatttcctagtagtgaaatttatggataaagaatatgaattttggccaggtacggtggctcacacctgtcatcccaccactttgggaggccgaggcgggcagatggatcatgaggtcaaaagatcgagaccaacctggccaacactgtgaaactctctctctattaaaaatacaaaattagttgggcgtggtggtgcacagctgtagtcctagctactcaggaggctaaggcaggagaatcgcttgaacccaggaggcataggttgcagtgagctgagatcgggccactgcactccagcctggcgacagagcaagacattatttcgacaaaaacaaaaaaagaatatgaattttgcaaccacttttgatacacactaccaagtgtttttcagaagagtatactaatttaactggaagtgcctatcgcaacactaggttttgtctgtctttttatattgttttctaagatgactggagaaaaagatgtattttatgtcaatatataccactttcattcctaatgacagtgaattttttcattcctttttccctcccttttatccttttgtcatttatgtttactcacttgaaatcctcatttgatacacagactggtcatatttttctccatttaaaattctgggtatgtctctttttcttattgatttgtatacattgttattcttacttcatagtctgtttataagtctgcttatgcacactttctatcttcatctacatttctggaaaaagacaacacagtagcattctgcacatattatacacacatagacatgggtgatcccaagtgcgtatttcaagctcgaagacaattaagaaattagaaactctaaactgcatatttcagtaattgcgttcccgaaataaaggagctgtagaaaaacattatttctcctttttgtactatgtcatcaattcccagtcaaacctttctggttatccttttataaattctaagatgttaaaaaatagctcattgcacaaaaaactcaaatttgttaaactgctatttcaaaagattttatactcacatgacgtttttcatttaagcattacacagcgctttacaaatgttaattaggatattccaactggaaattgaaacaaacctcaagagagtgaaattaggcatggagagacataatcattcctccaagattattccagagcatccttggcatttccatggctcacacccaagtacctggtttcccaggactgcatcttaaccattagagcacataataagcaggtcttcgtaagcacgggcttatagagtaactaaccaacattttaaaatttgtctaaaacataagtgaaaatgtgaaataaatagaaattctctctttgacacacgttacactcaattcataagtgatacactaaatggaaccttatgtgccttgtctataaaatattttaatgaatataataaatattcaaaaaaattaaaatttttagaatccttttttaggcctttcaagaacaaatagaaaaacacgacttttggaaaaacatcacttttttgagaggaaaatttcattctttgtgggatgagcagatgttcatcattcaaccattcatttcattttttttaaaatctaatttaagaagtttctgcaaccaagtgacagtccctgtgcttaagacttgggattaaataatgaaaaagacactaaatgccttattacaacagataacaccacaaaaataacagatcaatgaaactaccattgcagagctattgaaatgtacaaaattttactagaacacggaaaagcacttttttttcctattgctggaataagagatgtaaccacagaatacctgacaccaaaattagttctgaaggaagtaaaggtgtttaacagaataagtaggaaagattcgtgacaggggaatcacgtatgcaaaagcagaggaatgcgggcatgcattacatgttttggtaatggcaagttcctcagtttggctaaagttaggcaaagcagtctacagccaagttgaaagagacttacttgccaggtaaagcgattttgactaaagcaacagaacctatttattcaggggcatacatacagaatcaagatttttaagcaggggaagagaaagagtatagctcattcagaatgatcactttggaggtaatacagagattgtgttaaagacaagagaatggggggcaggaagttcaagctaagaggttattacattggttcagctaagaggagtgtttcagaaacacacaataacagcgttaggcaaaagaaaaatactcttaaatccaggcagatgaccagttaagcattacccaaaatatgtccaccaggattccaagcatactttatagctatttccagccaaatgtataagtactggcaattctgaaaatacttttccaaaacacactacttataaagctactgctgagtctgacaatcaatcctctttaaggatctaacaggaagacagaataaacaaaacatatgtctccccaatttaacacttgccaacaatgtaaatgagcacatgtgccttttcaatgttcaacaaattcctgaagccacagaatgtataactgccacaaaggaaaccatcaggctacaaagaatgatttcagtggcagaccttttttctttggcaagtagcatagtgaaatgcaaacattagaaccccatagtccacagactgactctgaccagcacccgagttctatttgatgtagataatattggcccaaagagcactgtttaacagattttccaacaatgtccagatgtcctggacattattcccatatggccatactctacaacaactctagaactgctatcccctatagagaggtcataagctttccaggttaccaccacccacatcatcttttgttatcttgttaaaactaaaagcaggtctctgttggcatttcttattgatgtaaggggaaaaaagcatacattcttagctaaaacaaagtattgcatccttctggctgttcaaacagaacaacaaacagatttagcgggcagagagcacattaaacactggaaatattcctcacttcctacaacgtcctatgctcactagcattgtttccttttctttttctttttttttttttttttttgagacagagtctcgcactgtcgcccaggctggagtgcagtggcacgatctcggctcactgcaagctgtgcctcccgggttcacgccattctcctgcctcagtctcccgagtagctggaactacaggcgcccgccaccacgcccggctaatttttcgtgttttttagtagagacgggttttcaccgtgttagccaggatggtctcgacctcctgacctcatgatccgcccacctcggcctcccaaagtgctgggattacaggcgtgagccaccacaccgggccctcattgtttccttttcttaaaataaagtttctgtattcatagactccctagtcactccattcatctacaattacctgtgtaagtcaataggtatttgagttgagactcctgtaggagctaagatcataaacttaaccaggggtcccccaattctgctcactcacacgaccttaggaaatcacttcttatgtctgatcctttatttctatagctatgaaatgaggctaacaatacacaattcacagagtgggtgttcattatgatttgatggagctaacacaatgaatgtagcattttctaagtgaaattaaaagttctaacaccataagaattcaatagtcatgtaaatttgggggataccagaatgcagaaaataaaacaggttcctttggtttattaaagtctttggaaagtgcatcctacagcaagaagagtcgaagataatttgtcaaatgtattcaaagatataatctagttgtttttttttgtttgttttttgttttttgcccaggaagcttctagagaactaaggttctgagaaacatactttgggatactagtgattggttagtatccctttttggtacatagtagatacttaacagttatcaactcattcttagaactggatctagaatttctgtaaggtttagatcaaattcagctttttcaagtttatctgtgaaaacaagatgcaaaataataacaataggaacactgaggactagaccacgtgatgtggggttgctggctaaaagaggggtaagaagctctggctataatgatcctttctgtttcgggagatgatcaaatccataacattctgagccattgaaataatgggtgttcgtgtgatctttggtatttataggcatcaaggtatttgctacatattctgaagttatccagtataatgaaggaaatttgctacaactctagaattaagaaagagattgaatgggaacattctgtaaaggtgggtcaacctctaagagacagcagggggaggcagtgtgccgtggaatgagatacggggtccatctctgccactgtctagttctaagacgctgggagaaaaccaactaacatctgtgagcccaaatttcatcatggtcaaatgctgagttagaagagaaagtttctagtgatcttccagttcaaacatcatgtggtttttctggggtgagagatgcatgctagtgaggttatgaacaaatcaaattttagtgaatcaaatcttatatacctataaattgatattacattttccaaaaatgccatttctcaccattaattgatcttcctgtggcactggatcttagcattttagtcttaagttttgcccttatttagcaaaacatacaaggactgcctgctattttttaaaatgtctgcactgcttctttgtgtaaagtgaagaatttctacatttacatgttgacagttcagattttctaaaatcaaggtaaacctagggtgccaaggacacagcagacattaagtctgtgctaaatggaagctttaaattatagaaacttcagcatgtttctaaatctaagatcagaaattttcaagaagatgtagatcttcttgacatacaatgtttctcaccagtccctttatcaaatttgtttttttccctgaaggaaaattcttccactgctgcattatactcataagtcccatcccggcaagactcaattgccaatgatacttataagattatatttacttctttgagctaaaatgtaaaggtcattttctgtattaaagctcagcctttaggctaaatatctttcttctcttttcctgggaaagagtgagagagacaaagattgacagggacagggacagttgggggtggggagaaagagagcgagcagagtttgggaactagaaacttttactaatggatctgaaattggttccctggatcctaaccaaatttaatttgtctaatccatagtttaactagagtttccactcaaaccaaaagtaaatcttacctagaaaataatgtacctggccgggcacagtggctcttgcctgtaatcccagcactttgggaggccaaggcggatggattacgaagtcagaagattgagaccatcctgccaacatggtgaaatcccgtctctactaaaaacacaaaagttagccgggcgtggtggcgggtgcctgtagtcctagctactcgggaggctgaggcaggagactcgcttgaacctgggagacggaggttgcagtaagccgggatcacgccactgcactccagcatgggcgacagagcaagactcagtctcaaaaagataataataataaaaataaaagaatgtacctttctcagacaggataacaaccacttttttacttatctttcatctttattctaagagattcagtaagattctttactgggaaaaacactgtcattttgctctggctctttttatctgcatcaaagtgtttcaaaaacctctgagcattttggaattcctagacaatggcatttaactcaaatatacaattttttttttcaaatatatcatttgcctaaatttctctaagactgaaaagtaaactacatgatgttgttaactcttggaaatcctgaccccaacatctatacttaggtgattttcatgaaaaccacacagattttcttctaaactctgaatacaatccttttccaatttagtctcttgctgaggagttgcttttttttttagcagtgccagaatacatgaaaaacagagggtagaaacaaccaaccaggtgcattcatgaatttttaaaccaggtctgctgaaaaacatgcaaaacaaaacctctccaagcacgcttggggtaaaacatcaatctgaatattattcagtatcatctccatgtctataccagccccagcagatggccaatttgcttttaccaccttcagtccatgcagccagatgctcccagatgatggctttttcagactgcatctctgattgtgcagtccaggtacccagggagcagggcaaccccagagtggcacacagatgtaaaaagtaaaaataaccacataatcctctaaaatgtttttaaaactaaccgtaggcagagatgggctaagatataaagcaatctgacacagaaagtttaccggaactttccttgaaatatgaggtaccatttcttatgggtactgatatggtttggctgtgtccccacccaaatctcatcttgaattcccatgtactgtgggaggtacctggtggaaggtaattgaatcctggggggcagatcttctccatgctgttcttgtgatagcgaataagtctcacgagatctgatggctttataaggcagagtttcccttcataagctctgttctcttgtctgcatccatgggagaaatgcctttcaccttctgccatgattgtgagtcctccccagccccgtgcaactttaagtccattaaacctctttcttttgtaaattgcccagtcttgtcttttttttatactttaagttctatggtacatgtgcacaacgtgcaggtttgttacatatgtatacatgtgtcatgttggtgtgctgcacctattaacttgtcatttacattaggtatacctcctaatgctatccttcctccctccccccacccacgacaggccctggtgtgtgatgttccccttcctgtgtccaagtgttctcattgttcaattcccacctatgaatgagaacatgcagtgtttggttttttgtccttgcgatagtttgctgagaatgatggtttccagcttcacccatgtccctacaaaggatgtgatctcactcttttttgtggctgcatagtattccatggtgtatatgtgccacattttcttaatccagtctatcattgttggacatttgggttggttccaagtctttgctattgtgaatagtgccgcaataaacatacgtatgcatgtgtctttacagcagcatgatttataatgctttgggtatatacccagtaatgggatggctgggtcaaatgccatctccatcaagctaccaatgacttttttcactgaattggaaaaaactactttgaagttcatatggaaccataaaagagcccgcattgccaagacaatcctaagccaaaagaacaaagctggaggcatcacactacctgacttcaaactatactacaaagctacagtaaccaaaacagcatggtactggtaccaaaacagagatatagatcaacggaacagaacagagccctcagaaataatgccacacatccacaaccatctgatctttgacaaacctgacaaaaacaagaaatggggaaaggatttcctatttaataaatggtgctgggaaaactggctagccatatgtagaaagctgaaactggatcccttccttacaccttatacaaaaattaattcaagatggattagagacttaaatgtcagacctaaaaccataaaaaccctagaagaaaacctaggcaataccattcaggacctaggcatgggcaagcacttcatgtctaaaacaccaaaagcaatggcaacaaaagccaaaactgacaaatgggatctaattaaactaacgagcttctgcacagccaaagaaactaccatcagagtgaacaggcaacctacagaatggaagaaaatttttgcaatctactcatctgacagagggctaatatccagaatctacaaagaactcaaacaaacttacaagaagaaaacaaacaaccccatcaaaaagtgggcaaaggatatgaacagacaattctcaaaaaaagacatttatgcagccaacagacacatgaaaaaatgctcatcatcactggccatcagagaaacgcagatcaaaaccacaatgagtaaccgtctcacaccagttagaatggtgatcattaaaaagtcaggaaacaacacgtgctggagaggaagtggagaaataggaacacttttccactgttggtgggactgtaaactagttcaaccattgtggaagacagtgtggcgattcctcaaggatctagaactagaaataccatttgagtatgtctttatcagcagcatgaaaatagactaacacaggtcctaaaaggggaattgccttctgtcactttattcttcaagttcctgcaagaagcctaggatgtctagattcagaagtgactgaaagcagaactattatatgcattgccacaaatgtaacatttggttatagagatcaagcaggacctattacagggagtcagaattgtctgcctgccctatttttctacaacttagaccaggctcttgattttgatgcactgctacagctggatatgttgtctcatttgtaattgacctatagagggtgataccttctaacactagctctaacctctcaagcaaaaaataataataatctattaataaataattaaatgtaccagtaggactcacccaccaaggaaagtaattggtcatgtccatgaatcattttgaaaaataaaaaagtatatgctaagtgatacttacataaaacctccatatgactgtaagacttcctaaaggttgatatctctgtttaacagaacatttctaggattgtgtacaataccatacacaagggatttctgtgtctgtgtgttatagttcaccaacataccatcaacagcagagattgaggggccaaaagatacataggttctaggtgaatcttttttttttttttttttttttttttaagatggagtcttgctctgttgcctaggctggagtgtagtggcgcgatctcggctcactgcaagctccacctcccgggttcatgccattcccctacctcagcctccccagcagctgggactacaggcgcacaccgccacacccagctaatttttttgtttgtttgtttgttttgttttgttttagtagagacggggtttcaccgtgttagccaggatggtctcgatctcctgaccttgtgatctgcctgccgcagtctcccaaagtgctgggattacaggcatgagccaccgtacccggccagttccaggtgaatcttaaaaagaaacagagggtctcctaggccttcagtgggctggattaggtgaccttcctcagtccttcaaaagcaccctgggattaatgctatccccagatcaattctactttgtcgttatttccttatttgtgtatctccttttccagactggaatatcaataccacacactggaacctttcatcgtctttagttcactatctctagggcctctacatagtaagttgttaatcaatgtctgatgattgaatggacaaacaaaatattttcttaattttataatatgtatttagaaattagctcattaaatatttatatgaacacctaattttcacatactatcatattaaatatgtgctattcataattttaaggaaagcaggaaggacaagagaataaacagaaagaagaaaataggaaaggaataaaggcaagagaaggaaggataaagtttctaaatagtatggtttggggaattaagaaaaatttctaaatgtgctttatatattaaccataattggtctattttttttactaatttataaaacatcacagtaatagcaaacatttaatagcccttactatgtgttaggctcattttaagggatttgcatatattaactcatgtaaacccacgaatttattgggcaggaactattagtatagccattttttttttttttttttttttgagacggagtctcgctctgtctcccaggctggagtgcagtggtgggatctcggctcactgcaaagctccgcctcccaggttcacgccattctcctgcctcagcctcccgagtagctgggactacaggcgcccgccaccacgcccggctaatttttttgtatttttactagagatgtggtttcactgtgttagccaggacggtctcgatctcctgaccttgtgatctgccctccttggcctcccaaagtgctgggattacaggcgtgagccaccgtgcccagctagtatagacgacagtttacagatgaatatgctgaggcacaaaaaagtttcatgactagtccaagaccacatagatgataagtggccaaaccaggattgaatgtagttagtttagctctagtgtcagcgttttcatccattatgctatgcggctccatctcgaatttgcaagcatttattaagtactttcattctcaaagttcacgccatttggtcaggcacaggagggatatacatgtctaagccactgctttatattatcagttcctttaccaagtacatgtcatatcttctaagacagaaagttgcatatggagagtaaagacagagtcccaaaaagagcatacatactgtaggagtacagaatcagaagaaatgtttaaggatggtgtagtcaaagaaagtattatgagagtgataaggtgagcctggcttcagggaagatttgcatccacaaaaggcagagaaacatatgtacaatggaagggccacttagcaaaatttaactttacactttttttgagacggagtctcactctgtcacccaggctggagtgcagtgacacgatcacagctcactgcaacctctgcctcccgggttcaaacaatccttctgcctcagcctccagagtagccaggattacagacatgagccactaaacccagctaattttttttttttttttcgagatggagtttcactctttttgcccaggctggagtacagtggcatgatattggcacactgcaatctccgcctcccaggttcaagtgattctcctgcctcagcctcccacgtagctgggattacaggcatgccccaccatgcccagctaatttttgtatttttagtagagacggggtttcaccatgttggccaggctggtttcgaactcctgacgtctgctgatttgcccacctcggcctcccaaagtgctggaattacaggcgtgagccaccgtgcccagcctaatttttgtatttttagtagagacagggtttcaccatgttggccaggctggtctcaaactcctgacctcagatgatcctcccgccttggcctcccaaaagggattacaggtgtgagccatcatgcccggcctgactttacagtattttttaaaacttcgttaaaatgctggctcaaggcaaattatgacagaaaggaaagaactatcctttagtcaggaatgatcttctcccttctgattagggagactgggctacttctctttcacttgatcacatgtgatggcctcaatagtctgtaacatatgttgacacgacaccaacctagaacgcagaccttgggcccaaacctctgctcaccaaaccaaaatcagccagcttgcaatatttataagaaacttaaccaatgtaccaataaatgaaaatcgtggttcaagaatgagggtagtattcttgatgaaacagatttatggtaacaaaattattcatttacatatccatatctttccaaagaataatattttgtattacaaaagggacacacacttatatggaaaacataccagggcacttgaccacacttataagagtatttattgtaaaaggctagtttttatcaaatcattcacctacagataaacgcagaaactttgatgtctagcactagttttcattctcacaatactttgtacatttgagtgattagattctgtcctcttgatagcatggctgaagcttgttggtcagattccaatctgttctgggtactggtcatactcagtatcttctctccaacctctatcagctctttaggtcttgttatctcaatgatacattttggtgtctctccagcttatatattgtttattgactgatgtgaataatgtagggagggtagaacattctttgaaggttatgaacaactgataaaagagtttctgaatgtagtgtctgtcagaattgttacagccaagggatgcaatgaaatagattactgtgcatcttctccctggctcccaatctaggtttgcagcagagaatttctgggaaccatttcccattacagttgatttctgcaaggacatttttcatatcagaatctctaaacatctactctacagatgactcatgtgaacaaaagtgacacacgaccatttaacaatcagcctattttacaggttaaattccaggagactatggggccaatttgtggggatagcatctgaaaaagaaaggaatttccaaacctgagtgtttcattagaaagaggaagtcagttgggcaagccacaggtaatctaaacaaattgatgggagagagtgaaaaagtactcataattattgtatcaaagaaaatctcttcattatcaaaaatgaggagagtgtgcttggggacaaatatggctacttgccatatcagctgcagtttggaaacataattaacaactgtgtatggaaataattaatcttgtgctgcagtgatccatgattgcatgactgcactctagactggttacagagtgaaactctgtttccgaagagaaaataaaataaaataaaataaaataaaataaaataaaataaaataaaataaacctaacaaattgaaaatcttaacaatttagttgtaagaataatccttctacgtggtaaacagaaggaagaaacatcgcttaaccacaacaaaaattaaaacaaacacacacaacttaaattcaatcaataaagtaaaaagtttataaatatataccagaaccattacaaagaacaaaaacatatatacaattcataaaataaaagaaatgccaaatgtaagatgcttgaaaaaggaagacgagaatgtaatctaattttgaaatatttttcagtagaagataagcttcagttatctaggaaatccacttaaatagacttttcctagcatggtgcactcacaagtgatagtgaaatatatggacctcttcatgaacatatattacagcaacccctggtacagaagcgtactcagaattaaagcaggtggtcccaaaaagaatatcattgtttctaaagatagataacccattacataggatataagcgcactaagaaaatggtattcatttatatttacttttgcaaactagctcctggttattcagtattttcagaatgaccattcactgatgccctaagattatgtgcaaactataaatatgagaaagtgaatttcaaaaccatttgtatcaacctcagaacccaattgtcataaccttttaagccctcctgagcactacagatttatcactccccaggccttccaaaggacttgaaaaggtattttatctcaatatacagcagttaagttcattcactgtaatcacttgctaatggacatcatagctgcaaattaaactaaaatggtgtttagagataacaaatcaatgggttagattaaaggatattatcaaacaagtagcagagagtctgataaggatcctacgaaactaaccagggagatttgaaaggattaacttactccttgaagaggtacctctgatgttgtgaggcttggaatctattacctttggggtccccatgcagaaagccagcagctgcaaactactacttagttttacaaagtaaaggtcaagtaaagagagcagactgcagtagacatcaaaggaactacaatatgttaagtagaaaggacctcatgacatttataggagatcttaaggttactatccatttaactgatttaaaaaagatcctatgatgctaagtgctttattcccaatgccaggaagatgagacaagttgcccaaggccaccctgcctgttgactcacttgccatctatagcttccaatactagttcatgccatgacagaaatgatttatttgcctatatggtatctggatgtggcatttattaattttttctggatatatacatataaatcataatgatgcaaaggaaatagatttaaaaaaaaatcagccgggcgtggtggctcacgcctgtaatcccagcactctgggaggccgagacaggtggatcacgaggtcaggagatcgagaccatcctggctaatacggtgaaaccccgtctctactaaaaaaatacaaaaaattagccaggcgtggtggcaggtgcctgtagtcccagctactcgggaggctgaggcacgagaatggcgtgaacccgggaggcagagcttgcagtgagccgagatcgcaccactgcactctagcctggacgacagaactagactccgtctcaaaaaaaaaaaaaagaaatcatggagtaggccgggcacggtggctcacacctgtaatcccagcactttgggaggccaaggtgtgtggatcacgaggtcaagagatcgagatcatcctggccaacatggtgaaaccccgtctctactaaaaatgcaaaaattagccagatgtggtggtgtgaacctatagtcccagctactcaggaggctgaggcaggagaatggcttgaacccgggaggcagaggttgcagtgagccgagatcaggccattgtactccagcctgggtgacagagtgagactcctcctcaaaaataaaataaaataaaaataaaataaaataaaataaaataaaataaaataaaataaaataatcatggagtagcgtctacctacccatggatataaatcctgagagactacagcccttctgatgagagaggaagccttttttttttttttttttttttttttttgagatggagtcttgcactgtggcccaggctggagtgcagtggcatgatctccggtcactgcaagctctgcctcccgggttcacgccattctcctgcctcagcctcccgagtagctgggagtacaggtgcccgccacctcgcccagctaatttttcgtatttttagtagagacggggtttcaccatgttagccaggatggtctccacctcctgacctcgtgatcagcccaccctggcctcctggagtgctgggattacaggcgtgagccaccgcacccggaggagaggaagcctttcaaataaagaaaactccaccttccctattattcatgacaaatgcataattgcttggctcttttcaacatcccgccttactcacatactatcatgctataagtggagctaagattgtgtattttaattcccatagtcctgaacacaatatcaataaaggcatggggaaaaaaagcacatatgttcaccatcctacttctcgtcataatttagtataaaattcagggaaacccaattagttttccctttatctttctctttagattacttctctaaatacttagcttgtactgcagtgttggtcaatgacactatcaaaggttttctgctaacataacaatctgctttgaagaaggaaggaaggaaggaggaaggaaggaaggaaggagagagagggaatctcagtcggagagtgcaaggactgcagataaagaactttctcctcctaatgtttgtgtgtagacagagaccacatagcagcactgaatggtaaactgtcttttttgaaacttgaaacttctgtttaaatggcatttaagacatgataaaataaattgtttcattcactaagcactgggactcccaattacatctctcctctaagaaccccaagtccctattgcctgcccctgctttttgagctcagatgtttgtagatccatgcaagaaaagtaatttctcttggttggtgatttctggctgtggttttgcaggtttttcactgagatgtaaaacaaaggccctgactactcagtcatttaaggaagactccctggaaactttctgcaaaaggtagtaatattaacagcaattgccctggccagaatccattgcaagtaattgcattccaccaggtagtttataacaaaagcctcttcccatgcagtcttctgcatctctgccaagaatacagcagcagctaagctccaactatgtttgggtcaaaacagtttctggagtgaagtcatttaaggaatacatacagtgagccccaactgccacagcctcctttgttgtctgcaatgattgctgtattagtttgcaatgtcaatgcattctttacatcttcccatttgccaagattcagctcaaatctcttctcttccaatgagtccttcaaaagcctctcagattgagatcaattgcacccttttccgagtttcttcttctacatggtattagtgactctatttttatttatttttatttttttgatggagtttcgctcttgttgcccaggctggagcgcaatggcgcgaccttggatcaccacaacctctgctcttgggttcaagcaattctcctgcctcggcctcccgagtagctgggattaaggcatgcagcaccacgcccagctaattttgtatttttagtagagacagggtttttccatgttggtcaggagggtcttgaactcccgacctcaggtgatccacctgccttggcctcccaaagtgctggaattacaggcgtaagccaccgcacctggcccggtgctgtttttaaatattaaattcagctcaataaatgcacatccctttgtgtttgtgacctcctggccctcactcccatgcaatgagctaacagaatatgtgttattatcaatatttggagataaagagtggcacccaaaactgtgtggttttgtgtgcacaacagaaaagagtttatttattttatttatttatttatgtgaggcggagtgtcgctctgtcgcccagtctggagtgcagtggcgtgatctcggctcactgcaagctccgcctcccgggttcacaccattctcctgcctcagcctccctagcagctgggactacaggtgcccgccacctcgcctggctaattttttgtatttttagtagagacggggtttcactgtgttagccaggatgttctccacctcctgacctcatgatccgcccaccttggcctcccaaggtgttgggattacaggcatgagtcaccggaaaagagtatatgtaaagcaaagtttctgaatgtcttttgttagctggaggggtaatcaaaaccagaggactccactactttcatcccatttagagatctttgttctcaatctgaaactccctccactctagaggtggcaatttctttgcatgtgtttgaataaaccaagtcaaaataataacttcaatgtataagcctgcaggaatctggaagcagttgtcccttttaccgccagttgtaaagtaaacaagacatgggattcaagccaagtcatcagactcagattcagtctttgcatgatgattttcttttttctagacaaggcttttttcgttcttcttctttttgttttgttttgtttttgtttttgtggttgtggggggaggggcgagaatggggagtaataggtatacaataaaaataaataaataaataataataataaaaaacctcccagactaaaagtctcgaagttcttagacattggaaatgaagttgaccttgggcttggcacagggacagaagatgccagggttggaggagcttacttttctcttggctgagatgctctgctgccaggctgcccttttgagaagatggcatgatccaatctgtactgggctcccaggaaggctctctcatcatgccaggatccccctgctagccctgtacaattccactcatcacggcaggatcttgaaagacatgacggccaaaatgcaaaatggagatgagtgacagcccagctttggcagcactgggcagaggaaggctgagctcctgagtacaaaggaaggggctagtaaaggtgacatctggtggtatctggaccatttattcttccattagttctacagccttcacagactccccttcactatatatatatataaaaaatctccagaatctgtttgtaggctgatatgagcacctggctctctattaaagtgaaagaaccctcttctgtgtatttgtgtctgtctcttttcaaacaatagtccttttcttcccttgtgttttgttatttcactttaaggcacatctactgtttgtggatggcagaagggaggcactacaattatggaatagaacatgtccatgattaatagcatctttttgtggggaggtgaaaaatgtttaagttagccaaaagcagtggcccacgcctgtaatcccagcatttcggaaggcagaggcgggcggatcacctgcggtcaggggttcaagaccagcctggccaacatggcaaaagcccgtctctactacaaatacaaaaattagccaagtgtcgtggcacgcgcctgtagtcccaactacctgggaggctgaggcaggagaatcacttgaacctgggaggcagaggttgcagtgagctgagatcatgtcactgcattccagcctgggtgacacagtgagactccgtctcaggaaaaaaaaaaatgtttaagttcagtgacaggcagtagcccactagtccaagctgccttaaagctacatcagtccaaatttaaagcaatataaccccctcttcactcatcttgcaggcaatgatatatgttagaatttattcccaaatttgttttttaaaaaaatacctgcaattttttaaaaaaatgttcttctttcaagggctctttgaatagcactttgtatctaataagcctatgtgggatgcctgtgtttcataccaagacagagtcacttgctgtgctaaggaataaagttagaactctggaataatggagtggaacttttgaaaaacaaaattccaagaagctcccctccctgggcttaacaaatgtctttgaatacaccataatagtggcctcccagggctctggaacgttcaactgctagtaagcattctatgccatgaagtaactaagaattatgaattccagtccctacttcaattcctaagtggaagagcagaggggaaagtgctacctgctcactgtgctctcctaatgcactcctaaaagctgtggctacccatttccttaaatttcaaagatgctctgagcatgtctatgtactctccttcacccatccagcagccaaatgcaaaatacagctgtctttctaggagagaaatcatgaggctagtttttatgtcaaagggacaaatggagaaaaagggtataatttctttttttttttttttgagatggagtctcactctgtcgcccaggctggagtgcagcggtgcattcttggctcactgcaacctccgcctcctgggttcaagcaattctctgcctcagcctcccaagtagctgggattacaggcgcctaccaccacatccggctaatttttgtatttttagtagagacggggtttcaccatctcggccaggctggtcttgatcttctgacctcatgatccacccacctcggcctccaaagtgctgggattacaggcatgagccaccagaagttttcaaatcaaaacttccactgtccagtagaggactgctggtttcaaacacataacttcaatatttatccttgcatcaccaacaccaagagccttttcataaagagaaaatgtaaccaagagtttcactgaaaaataatgccttcctgttggcacagctcacctctgtttagtaaagtgtagtacttggtctacgtgcagcagaactgcagggagatggaaaagtggcacatgcttgttaaaatgcagattctcagaactaacgacctagaatttctgagaaataggcccccagatctgcagtttaacaagctctctagatgattttcatatatgcggacgtttaagaacctcagtagtaatttaggcacttcatcccactaatcccttgaaaggcaactgggcatatctttaggattttcatttatattgggaaaagcaaagatatcaaaacattcaagcagcagtactctgctataaatggctaagaaacagaaattactgttactgcttgcttcattgagcagttgctattaactcccaggcacccttggggaaataattgtggccctaaggagattatactctttagttactatgtagagaatgtgaatgttaaccaaaaagctcgagaaaatctccaggttgccacatccttgcatggttaccagctacatgacctggacaatccactcactgaatcttcatttcctcaacttgaaaatggagtttatcatacttaccttgatggtttcagagtttgtttgtttgtttgtttgtttgttttgagatggagtctagctctgtcgcccaggctggagtgcagtggcccgatcctggctcactgcaagctctgcctcccaggttcatgccattctcctgcctcagcctcccgagtagctgggactacaggcgcccgccactgcatcctgctaattttttgtatttttagtagagacgtggtttcactgtgttagccaggatggtctcgatctcctgacctcatgatccgcccgcctcggcctcccaaagtgctgggattacaggtgtgagccactgcacccagcctggagttttgttttgtttctgaatctactaccaccatacgtgggaatgttctcagtacatttcacatatgcatgtcttagagcttacagtttattataatcactgatttgagaagctggagccattgctgttctatttcttctttaaaacgtgtgagtgtgggttactttaaataccacttagctcaaaaggcaaaggcagatttctagttccaatttaggtctagttgtaaacagctttctttctaatatttgtctttatatctttccctgtggtagttctattagtttcttttataaatctgatatagaaaaagtgtctgtcactgaaaaagtggggggagagttattcactaggatccatgtgttcagtgtttaatagagtaaatgcaacatacatgtatgcatgtatgtatattatgtatatattaatagctatttatactacagaggaaatttcatggaagaataggatctctcttttctagggagctgagaaagactagtagttcctacagaaaaagcaagtacctacagatttaatggtagtatatctcaaaggttaaaggtaacgatagagccacaagatttgatcagagcccatgaaaaaagctgtacaagggaaagaacaagttctgctcagcacgcacatgcaataatgtagtgaccatttctcagctgtggcttctccaagaatcatcatttagggcaatggtatctaagcagatccttgcaccaaacatcagcgaactgtattgtccctcatgacactggccacagataagtgagtaggacaggcgcatttctttgtttctttttcttctcttttcttttttttttttttttttttttgagatggagtcttgcactgtcgccctcgctggagtgcaatagtgagatcttggctcactgcaacccctgcctcccaggttcaagctactctcctgcctcagcctcctgaatagctgaaattacaggcacccacccgcaagcccagctaattttttgtatttttagtagagacggggtttcactatgttggccaggctgttctcaaacttctgacttcgtgatcctacctacctcggcctcccaaagagctgggattacagacatgaaccaccgcgcccggcctgacaggcgcatttctgaaatgcattccctccaatggagaaaagaaacccagagtaaacgaatgtacgttgtgagtaaagagaggcagctgtaggccaccaggaaatcttaaagttagaacaagaaatattgtcttgttacagaaatggcatgacatctccctgccattgaaaatctatcttgattattgttggcaactctaatcttagaaataccaagggccaggcagagtgggctcacgcctgcaatcccaaagctttgagaggctgaggcaggaggatcacttgggcccaggagtttgagactagcctgggcaacatagggagaccatgtacctacaaaaaaaatgtttttaaattagctggcagaggggacagtgggcggtgtcatgtgcctgtcatccctacttacattggaggctggggtgggaggattgctccagcccgggaattgaaggctgcagtgagctatgatcacaccactgcactccagctgaggctacagagtgagacattgtctcaaaacaaaaacaaaagaaataccaacgagaaaatccatcaacttccttttatctattatattcattcatccatgcatgtatttattcattgacttattggcaagtatttactgagtccttcctagaaaccagtactgagacctggacttacaacaaggttttcttgggatcctcgatgtagaatccttttcagacttctgaaagcatcaagcttatcctgtaaatctgtcaaggctgttatccagaaatgacaagctgaattattttacataaggcaacttaaaaatatgacatatggtttgcctttacattttctctgtgctttgtattttatctgagattatataattcgtatttaaaacgcgaaatttattgaagatctacagagggatcagcctgaagaacactagtaaaaactaaccttccagacaagaaaactggagcaaggtttggaaaacagtaaactatgatagaagaacatagaccagaaatgcaaagatcggggttctagttaaaggcaaccagtcactaactaggcttcacatataaagcagcaatgccttaacctctcctacccacctcatggtatttttataaggataagatgattacacattcatactcacagttctgtaatcattctgaaaatatactatgttgtaaatatacaaggtggtcttggccgggcgcagtcgctcacacctgtaatcccagcactttgggaggccaaggcgggtggatcacgaggtcaggagatcgagaccatcctggctaacgtggtgaaaccgcgtctctactaaaaatacaaaaaaattagccaggcgtggtggtgggcgcctgtagtcccagctacttggaaggctgaggcaggagaatgacgtaaacctgggaggcggagcttgcagtgagcccagatcgcgccactgctctccagcctgggcgacagagcgagactccatctcaaaaaaaaaaaaaaaaaaaaaggtggtcttatattctgtccttttatttattttttagtttttgagacggagtctcactctgttgcctaagctggagtgcagtggcatgacttcggctccctgcaacctccacctcctggcttcacgcccttctcctgcctcagcctcccgagtagctgggatacaggtgcatgccaccacacccagctaatttttctatttttagtaaagatggggtttctccatgttggtcaggctggtctcgatctcctgacctcgtgatccacccaccttggcctcccaaagtgctagggttacaggcatgagccacctaacccggcctctgtccttctaataaatgatatttggaaagaaaaaaggaaggaataaagggagggagagagggaagaaaataaaatagcaacaaactaagcagttgtagatacataatatccagtatccaatttcaacaaggccctctcccacatatttatttcagtgttctttgtaattcccccaagttaggtatgtatgggaggaacataatgaaccatgggcaaaactttgtatttataataattgaagccaaatggtttgggtttgataatcttctgggctttatcaaatgagcttgatcagtttccactggtacctgggtaagagaatgctgacttgggtctccagggagccagatggcctcctactcatcatattatactctcagtctataccaccaaggcctgtggggtaggataagtgagatgctatggctctcgggaatttttaagccctcatacaagtataatcttcacaagtctataaaatttcaaatagtaaatagaggggagaagggaaatataactgcagaaaccacttcctctgcagatcaaataattaattgcattttctgcatgtggttgttagcactaaaagtgcaaggaggaagtgggaggaagaggctacttctacaagaagaggccagttctttctgtcaagctttaacttgcttagatcttgaattttaaatcaaacggggaaaggcaaatttcaagctctatttactttttagcaaatcgggacttcttgtctcaatctgagtaaactcagaattctttttgggccactgtgtttgtattatggccatttctaccaaaataatttggttggtagaatttgggttcgaatcccattaaaatgtcagcagcatcaaacccttagcacaacagaaggtagtggaaatagaagagtgaaaaaagttacaaagggaattataaacctttcaataccttttcatttttatttctctaaattagcacatctttaaggctactggtcagtcagaagtaccaatcttgctacaatgaacatctgtgatttcagacaaactagttctggctccaaatgccctaaacctaaatttgattataggaagaaacttacgtttacctgagaggccaccagcctagcagtgtgctggtaactcatataatttgataggtagagggctcagtgcctgatgtcccacatgctgggactttggtctctctgtcagcttgccatagagcatacccagctatgcctagggcagaacggccctgcaatttagcaacaaatcatcatcaggaagtaattagagagctctgctgttttttgaagctgggataatcctacaggcaacttcccaattttttcctaattattttatttatttagggtcattatttatgttgacacaaaaggtcatttaattgaaaatgattggtaattctggtggtctgccccttcttttaaagaaagcatacattttcttttgcaggtccctctcttcttgtttgaaaaaaataataataataaaacgaagactaaaatgaatgcatcccaccagttgcaatgggcatcgagccagaattacagcaagcactggcgctgcaggggtaagaaacaatggattttaattggtgcctaggggtaaaggtcagctctcttggaacaatgggcatctatggtagtaattgactgagtcctctgtgggagtctgtaaatgtcagcaatgtacttccaaatggaagcacaaagggcttgggcccaaggaacaaagacagtattagtgagtggagaaaatacgtaaatcagttcgttaaataatgcactaataaagcaaaagtggtggacacacacaaacacaccacatcacagagattcaaaagaaaacagactacttcaatatcaaatacatgccttcctataagatccaacctctctttccccagcacaagttcagctgttttcctggacagcctggaatccaaacactttaattatttgagtcaagttggatgggtttggctcctaagaaaagctacatccatcccggtgaaatctggatgctgatggggatagcatccacaattaaagttgtagttattcttgttcaagggaatttgggccctttttagaaagtagtagagaaaaagatgaagtactaatcattggaacaccaggcccctcctgcttccccacaaatgcttggctgcttcttttattgctatgttttactccatttttctcatttcctcatctttcccaatattcacccactcctgtgatccagaccacctcctcagggtccaataagtttagagagactgtattctctacatcaagaatttacataaacgatctatcaaaggaacattttatgagctttaagaggcaaaagagtagaatatgtaacataataacacattattaagattctagagaatgaaagatacagtacctttaccagtataaactcgatgctcatttccaactacatagttctcccttccatctgtgagctctctgcagacagggccctgtgttatgcatgtttgtatctctactgcctggcagtcaataaatattggttcaactaaatgatatttttctgttgtgaatgtcatgactttgtgttatgctgatctgcttcattggtcagcttaagcccttttatgctgcttccctgactatgtgagattacagccctctctaaactcttaaagcctttgttgtctgtacaatccactctactaccttatattatttaattgcattcctgagctgggatggtaaactccgtaagagcaaagcgaggttcatgtttcttttatattcacctttatgcttgcagagaacaaggcacaagccaggtgttcaataaaacatgtcaattaatctcttcttaatattatacccctaaatttcatcaatagttctgactggccagtagtacttaagatacatgctgaatatatcaaatctataatgtgaattttagttgtattaattcaatattaataatgtcaccactgcccatttactgattttacaagcaagacaggaagaaagtttattgcacctgaaaataaattacattattacataaaaactgtaattcaaatgggtcatgaggattttttttttttttttagatggattcttgctctgtcaccaggctggagtgcagtggcgagatcttggctcactgcaaactccacctcccaggttcaagtgatcctcctgcctcagcctcccgagtagcttggactacaggcacgcaccaccaggcccagcaaatttttgtatttttaatagaaacggggtttcaccatgttggccaggatagtctcgatctcttgacctggtgatccgcctgcctcggcgggattacaggtgtgagccaccacctccagctggaattttttagggtttaattagcatagtaagatagcagtggaaattaacatgttttacgagtctaaatagacactcttaatcatttaaatctgaaaactacgtcaagatatgcattgtgcgcttgtggacactagtttctcatagtacatacaccgaaagactgttttcatcttcctttccccttctcctttgacaaatatttgcatctctgtgaaaccttcctagtctccaaagatagagttctatgtacatagctatcatgatacataagtactgtgctgtaagagattgtttatacattcatctcctcaaccagactgtgcaatcattaagagtaagaacaacctcttatatttctatttcccagttcttaaaaaagatctggaacaaaataggcatttaataccttctggttgagttgacaaaagacagcataaggcatggccatataatttggaacagttaagaagagtaacaatgagactaacatttgttgaatgcttgctaggtctcagacactgttctttgctggttttgactctttatttcccataactactttaggatgttgacacaatcattatattttagtttggagaggaggaaactgtgtcatgcaggggtttacaacaaataaaccaacaaataaaatgttgtctaagggcacacaattattatgtagcttagctggaatttaaggccaggtcgcctggctccagggtccattatattaaatactgttccacaactaatgatgcccctgagcaaaaattcataatgaccaccttcaaataacaaagtgtatctccgcagtgacaggaaataggtgctgagttggtatacgtgacgagtgcagaaaatacaaggtatacatataaatacaagagatcattgcacagtggtatgagggagtagctaagagagcattaaaaggacaaaaatccattaagtgtgggcagcagcgatgatatttgaatctgctgcaggggagctggagaacctagatctaggcctaccacacccccacacttgagtcataattgtgctttccttcctggcaaaaccgatttcaaccacagccatcaatatcttttacccctttgaaaccactcaggaagaacagaaagataagggtaaattgtactccctctgaaagtcttaataagttcctggtaaattagctctcctctctctgagagatctccagagattcctaaacttctactgctgaaaatatttacaattttattatttctttttcttctgccctctgtcttcattgtgctctttgtattagcattctcccattactctggttactttaaattctgcacagtaatctctgtcgtcttctctctcggctttacctctgtatccttccttctatgcctcttctcttatctgtgagaggctgtgcattccagatattttctttttacatatcttttgttttttggatacatccacattgtcattttctccactataagcatgttcatttcctggtgccagatgccatcaatcaaggcaacacttagtattctactccccaaacacacatactgccccaagcagccaggaaaagatttttctctcccagctgttatattgtatatatcccatacagcaggccttttcacctatgagcatctaagcctacctgttacctacaagctatagtttttgttctgcaaaacctaatttaagtacttgacttgaaaggttgtaaaacaagagcacattagaggtcaaggacccagtaaagtagggaagtgatgctttgaggaacaaagggacaaaaccatcaaaagaagatctggtcaagggaaaggtcaggtcagcaaaagaaatgtttgaatggaaacaatttagcccctgaggctggtggtgcactcttaatttctccaggggagaaatagtggttttattaaagattcatccacattgactttgttttcatgacagcaccaggagaaagcttggggcagttctgatacattggagtgaaacatctccaccctagtaaatatcgcaaatttcctgtagcggacagcattcatctccatccatcttatataagagcagcacaggctattcactagaaacaaatgttctagatacagtatgtcaaacacaagatgacggaaacccctgagaaaccacagggagtgtgctggaagcaaacagaccagaatgttgaaaagacctctgaccattttccacagcagagcataacttggaaccaaccagaaataatgcatttgaccttcataaaagggtaatggatgggcacttaatatttggccagccagacctcagagaacatgagctctaataaggacagatgatgagacaaaaataaataaataattagacagataactttaaaaacaaattgttctcaaagaagattgcgcagatagtctattatgcttacttgaagaatggtcagcttccaaaaggtttccttttgtatttgagaatttctgatcacttggccacagaggcaacctattttccaagaaccactcagtgatataaaaaacatgcagtttccagatcaatcttcataatatttagagagtaatttaggctatcattaccttgattaatttcatttgttaaaaaggtatcaaaccaaaagatagagtctattttttaatgaaaaaagcattatctaaacttagaagagatttataggtggacctatctattacctttctacctatttattgagctagctaaatacctgtatcttttaaaaatacataaatgtagctaatacaattttgaattataatgtcaataacatataaacttgatcatcatacagatataacttagtttttaaagtcaccaattcatgattaatatgtaatgcattagatgcttcttatatgtgatagacataacacttacaaatgaagaataacaaatatgttaattaagcaggaagcttctttctatcaaaaaaatactttgtactaggcagggcatggtggctcatgcctgtaatcccagcactttgggaggccgaggcgggcggatcccgaggtcaggagatcaagaccatcctggctaagactgtgaaaccatgtctctactaaaaatacaaaaaaattagccaggcgtgttggtgggcgcctgtagtcccagctactcgggagtctcaggcaggagaatggcgtgaccctgggaggcagagcttgcagtgagccgagatcgtgccactgcactccagcctgggtgacagagcaagactccatctcaaaaaaataaaaaaaaaaaaaagtacttaatgccacatgaagtaaagcagtaaaccacctctgagaaccaggcaaattagcagatatgggggacaagaaaagataggaggaaggaaaaagtaagttttggaatgtatgcattgatcagaatttactgcctgaacctgatttatcattaattaatttattttttactacatcagtgttagatagacacagataatatcccagaaaaatcaactaggtacttagtgtgtaatgtaacatattgtattaaaatttaagagtgtagttttattagcatttttaaatttatgaatgttataataggtgctttgatttatataaactaatatagaatatatggcaatttcgggtataggtcagtgtacagagaggagtgtcttagatcagtgttgtttttctctatgttccaaagagcccacgagttccagaggcttccgcagggacttcttggagtgacaaggggttgtggagtgggcactgctcctggcactccaaccctgtttcaaagagagcattctgcacttattattctgtagctcatttgaaacccaggggattactgttggaaaatcactccaagtaaaaagagagatgcagcatgctttcttggattttatatttttaatgttcaggaagaaaacagaacaatgcttcatggactgaaacagtataaacactcagcggtacccaaaaaaagatcaaaggagaggacctttccctttggccatcattcctcaggttaagtgtagggaagtaaggatttacttactacacgtcacttttattgaagtttggaaaatgccacttccactatgtctctgaattcatgtgtggttttttttttttttttttttgaatattgctctgttgtgcccaggctggagtgcagtggtatgatctcggctcaccacaacctccacctcccaggttcaagtgattctcccgcctcagtctcccaagtagctgggattacaggcacctgccaccgcacccggctaatttttttgtatttttagtagagacagggtttcagcatattggccaggctggtctcaaactcccgacctcaggtgatccacccacctcggcctctcaaagtggtgggattacaggtgtaagccaccgcacctggaccatttctttatgaatgaaacatacatccttgttaaaaagattagaggcaaatggatgatcttgtgtacaaagtgacagatgaaagagttaaggtggaatgagcaagtgttgcttgtccgccaagggaatgtcatgcaccccctttgatgtattatacaatacgctagctcctcttggcctccctagataatgtcaagtgagtgctatgcaaagtcctggcatttaaaatattaatcatgttcttcttggttagaacagacaaaattatacattatgacctagaaatgactaaaacctacagagattctttactgttcttgtttactcacttgaaataattaaatttatagttagagaaaagaaaggagtcaaagctgatttcacagagcatttcatttaagtttcagcctaggagtccaaaagcgaaccaaagttcaattcaaatattcagtcatgtattggacacctactgtataccaaaatcctatgctcggcacgttaaagaatacataactgattaaggcactttatgccatctaggtcctcgcattctaaagggagtattagacatggtcaagaacaactataatcagaagtgagagtaaagtgctagaaaaaagaaaacggatgtcttggagataagagggagtgagcaagtctcctcagggaaattgattaaattttatggaagaggtggcatttaaggttcactttcaaggtctaatgatcttagcttatcattccccagctgcatgtaacttcagacaagtcactaaactctctgggactcagtctccatatctgttaaagaaaagagtagaattttaatatccccaaaatcttttagattcagattcaatgatacgtgattcttcctaagagaaggtggcagatcctatcaaccattcctctttgctgtcctcaaaagtcacatacatgggcctggcgtggtggctcatgcttgtaatcccagcactttgggaggccgaggcgggtggatcacctggggtcaggagttcgaaaccagcctggctaacatggtgaaatcccatctctaccaaaagtacaaaaattagttgggtgtggtggtgcatgcctttagtcccagctactcaggaggctgaggcagaaggattgcttcaactcaggaggcggaggttgcggttgtgccactgtactccagcctaggcaacagagcaagactctatctcaaaaaaaaaaaaaaaaggctgggtgtggtggcccacacctgtaatcccagcactttgggaggccgaggcgggtggatcatgaggtcaggagttcaagaccagcctggccaagatggtaaaaccccacctctactaaaaatatgaaaattagctgggtgtggtagtagacgcctgtaatcccagctgctcgggaggctgaggcagagaattttttgaacccgggaggcggaggttgcagtgagccgagattgtgccactgcactccagcctgggcaatagagtgagacttcatctcaaaaaaaaaaaaaaaaagtcacatacatgatacacaaactactcaaccaaatgacaagaggaattaagcatgctcagatataaagagacaagaagtcaataatcaaacccttatttagaaagtgccacatataatagggtaattaaaacttaaacatctggagaaaacacagtgtttaatgctggtatgtaccaagagacccgtaggaatgaccaatgtattctgaggagctagggtcctctttatagaatgaaagtcttagaagagtctctcagcaggaatgatgtaaattaagtggtgataacacagaaatgagaaaaaactggagtgtgaagggggtgcagaaaacataaagaacaaatactgtctagttttttctttgctagatagtgtgctgagaccacaaggataaaacaactaaaagaattggcttttccaagtaaaaaaccaaaacaaaacacttttttttccttttattccccagtgaattccactaggggttttatattctttaatccttgaagatgttacacgatccttgtgaagggagaacagcttgggttagttgggggtgatgggaaaggtatggctgataaagacacacagagtatatagaagttttctttttaggcagaatacacatcaactcagagaatttgagagtgaaattgagatttcaacttttttttttttttttttttgagactgagtctcgctctgtcacccaggctggagtgcagtggcgcgatctcagctcactgtaacgtccgtctcccaggttcacgccattctcctgcctcagcctcctgagtagctgggactacaggcacccgccaccacgcctggctaattattttgtatttttagtagagacggggtttcaccatgttagccaggatggtctcaatctcctgacctcgtgatccacccgcctcggcctcccatagtgctgggattacaggcgtgagccactgcgcccagccaagttttttttttttctttgctacatttgtattagttcttcccatcaccttctgcatcccagctgttcctttccggtacaggttaaatcatcttttcttacagcagactttatgtgaccaataaacctctgctgacacaaacaagccttgggatttatcatgaactggggtggggggaactgctctccctctgagacatcgtgacagatagccagcctgcctctcctctggcactgggaccactcagccttttcttctgggctaacctcatatatcagcggccagatgcaggtttcctttgaaagaacaatctaggctaatacctaggacccctctttctatctcttagtcaagatttcttacactgacatatgttgagattacagtttttactgtaacagacctagccaaggaaagctgctgtaatttacagcaggcttgcagggaaacagtcgatggatgatcattaatttaaactgtaaataagatcctgctttattctggactctgatccccggtagtacccctaacaagctgcctgcaaaggcaaggcatgaagcctgctgtttccaacatgatgattgaagaactgctcttgtccgcacaaatggctaaaaatagctataagaatgtgaaggcaaaacaggtttccgggaatgctgagagttaccctgatgttgtcagttttattccagttgctcccactagcgtgaaaagcagagagaagtatctggtacaaaagattttgacttgctagatagcaccgcggagacctgagagaattaatacaactttttaaaggagtctgcccttttcactggaggatagcttaagtcctagaagaattggagcaaatgtgagcactgcctttgttctgcataattaacagagcctgaaatttctttctttttgttttaacataaattctcattgattggagaaaatatattcacactttaaaatgttgtgcaagtactatctctttgattcaaatatgtcctttgggtgggcggagtacatatttcatggtgataaattcaccttataagtagaaaaactatgcacaaatatactgcgatgtcaactttattgatttgtgtaccattgttaagacgttcatcgtcctccaatatttcttaaatctatcagcatctcagaaagtgaccatgaaggcctcatttatctatagaggaaaagatcccttcctttaggttcactcataacattgtgatttaaacagctcaggaccacctctgctctgaagggtaacagtcccagagaaagccattccctcatagtcatgcacagggacttctctttttgtagaactagggtgtgtcaagtcttaagaacagtaaaatgcccatggctaaatgcccttttaaacgtccttcagataactatggactaattatgcagcctgattcatggtatattgacttgagtggatttgatggttaggctctttgctgtattattacctctctgcttcccttccagtcttagcagctatatctggacttgagcatctcactccttaagtcctgctcctgaaacaatcctggagtttctggatcatcaccatatattctgcagctacagaaaagcctatagtcagatttgatatttggcatctttttttttttttttttcatgtttctctctaacagcatcagtgaaacagagactatcattgattactctgaggtctcttccaggcataaatgtcttccattttcctatattagtttacaaatggagaaaatgtaaatgattcacccagagtcacctgttaggtggaagtagattcaaggcagggacttagatttctgaatcttagttcagggatctttcaattacaaaacgtcatgccacatttagtactagaatataggacctctgaggatgagttgctggcttatttctctttacatcctacagtgcatagcacattgcctagcatacagtttgttgactgttaaattaaatttgctaaaaatgtgaactagaagaaaaattaagagagattgtaaaaatcgatacaaagccaacaaacaactaaatttcatcataaaaataaaagatataagttcagttccttaatttgggactgcatacagcagatcaaaattgtttaggtgtaattgttgatgaagtagccagccaattaagggaagataggaatgtttgggtgtagttctaaatttgtgaggttgacagtattggttgtgtggtactgtggccatcagccacccacagctatatcaatttaaattaattaaaattaaatgaaatttaaaatccaattactcagtaacactagccatatttcaaacattcaaaagccataaattgttaatgtctaaagtacagaagagcttagaagaaaatttctatcatcaagttctgctggacacttcagcaagaaaaaagaatgaagagaaaacattaattaagcttttactattctgtgctaagcacctgaaatgcctaatttcatataatccttacaacttcccacacgaggtaggtaggtactgtaactgtcccccttttaaaccgaatcccactgtgcttggagagattaagtaaatcaccatgcttatatacttggtaataggtttagctgggttttctctcttcttcttactccagagtctatgctcaactgaaaagttatgctgtttctactgaagaacttgaaatgcttacagccagaatgaacattacactttatattagtggttcttaatcctagatacctatcagaagcatctggggagctttagtaagatatagttacctgagccctaatccagagcaacagtggtggggctagagcttgcacgtttggggaccacttttgacaagcagccagaattgagagtgattgcttaagagatattttcatcaccttccatattccagatggcaaaatgcagaccctacccaaggtcactaacagtagctaatgaaaaatctgagatgagaacatagacatcagtgctaccttcataacacattatggtttagggtatgttaatgaatgacacgtttctatttcctgattaatactattagttcatgtaacctatgtactacttaacaatcgtatgtcagaatttggaatttgataatgcaagtttatgaaaataaaggtatagatgtagtaccactccccttcagggacaaataaatgtcttcctcatttaaaaacaatattttcttcctaaaaaatgacatacctgaggagtagataagctctcataataggagatgtatgacatagtggaaaaagtatgactgctaaccaagacgccttaactctagtcctaattatggccataactctgcaatgggcacaaactatttctttcctctgaatctcagttttcttatctgtaaaataacggtgttgtagatgatgatctccaaggcttcttgaagctaagatccatgctcagaagggactaatcttatcactctttccaagctactctattctgctaaatgcactgcattcatcctgacatttgtgtgcagactgaacaaactttaaaaatgaaacttcctatctgctgcaggacaatgcattcacttaaattctagttaatctatttgttccatgtcaaggaaaaactgggacatcagatgaaaatccatcttttctgctgtcttgtcaagactcattctgactcttctgattgactggtcagaactcttactagagagtcagcagcatccacccaacaagactcattctttgtagctgccttttggaaatggtaatgatctacctatccctcaccctcttacattcacagctgctgatctgaaaattatgatgtgtcagacattttacaatcttaacatccatcaacccatctttacatttctaatcccagattaactgtaatggatttttaggtagctagagtggttagccaaccaagacagaagtcacatcatgaatgagtagcatgctgaatatacatttcttaccttacgcttgttggtaggacacacatagagatagctcaaaatggttttcaaaccaactttatcattcagcttctcataggttgttccataatcggttgacctataatccaaaaagagcattaatgaggacagaagtatatgtcatttggctgcttgtcagtataatgcatgctttacacagtagaatggctctcaggaggtttctcaatgattcatgtagtatataatgatgcttaattatgtacacagtagcatcatgtgagtggttaaaatttgcatttagattgaattggtaaaaattaaaactccatctctctactgctccttaatgtacgcacattgcataaagaatgtggttaatttaaaaagattaagagatgagggtgtcccttgatttgaccaaagaattaaagagtttttagtcagatatgacatttccaaacttttactttatgtttggcccagtagaaaagcaggttctcctgatttatcaacaaattgtgttttctttcatgagtcagggaatatatggtgggtcagtcccttcaaaggtcagtcagtcttttcttattatttaagagcaagaaaatgtctcaataatcagtgagatttcatgaatttcatactccatagccttttccagtgttaagcaatcctgagtcaggaggacatgacttctcgacactgacactgttttttcctatagagcctctcagctttagccattggtcaataaattattcactcggattaaataaattgcttttaattaccttctctatgaaggtctactctatttcagaattttaatcttattatatcatcatgacaactatgtacaatagggattattatctgtctttgatgaaaatggctgaacttcagtgacttattcaaagaaatttaaaaaatttcctgataaatggacagctagaaattgaattcaggtattttcgcctaggccccatgttgctttcattatacctcagctttttttttttttccttttttttttttttaaaaaaatttaaagaatatagggctgggcacagtggctcacgcctgtaataccagcactttaggaaaccaagacgggtgaatcacttgaggtcaggaattcgagacaagcctggccaacgttgcgacactccttctctatcaaaaatgcaaaaattagcctggcctgatggcacatgcctgtagtccgagctacttgggaggctgaggcacaagaatcacttgaaaccaggaggcagagactgtagtgagccgagatcacaccactgcactccagcctggaccacagagcaagactctgtttcaaaacaaaacaaaaaaaggccaggcacactggctcacacctgtaatctcagcactttgggaggctgaggcaggcaggtcacgaggtcaggagtttgagaccagcctggccaacatagtgaaaccctgtctctactaaaaatacaaaaattagccaagcatggtggcagtcgtctataatcccagctactcgggaggccaaggcaggagaactgattaaacccgggaggtggaggttgcagtgagccaagatcgtgccactgcactccagcctgggcggagtcttgtccagagcaagactccatctcaaaaaaaataaataaataaataaaaaggacatagacataaaatgatataaaatttcctctcagctttcttttcttaggagattgtttgtaaaattcattcattcattcattcacatttgtagcactcctaagacttaccagacagtgttgctaagtgtaaggacatagcacacagcctctactctcaagtatgtcacaattttatttgaaagaaagaaatataaacaaatatttagaatatgttaagtgcaaagatagagatatgagttaacaatgcttagaaattaaagttgatttaattcgaaaaacacaaaaattgtaatcatcttaattaatttctgaaactggtaaaagttacaaattcctataggccataacgactaagcagaattgcatgttaacaacctcactaccatccattcagtatacacagtggaccaaacactggagcaagaaagctgcataaaagtgatcctggagctaggaattaaggatttattctggctggaaattcaagatatttcttcctaaaatttatacatagatggcaaacagaaaacggtcaacacttcagaggatttagatgccattcctaatcgctgaggaacaaagtactacgcaaaacttcttgaaagaactatgaaccttgaaaatgggtaagtttagaaaacaaaattagaaagagcatcacagactagatgttacctttgtaacaaaaatatatacctggcttatttcaggaccagtctctgcactactataatcaaacacacattagcttgatagtcaagaatatttgaggagcattccagagctatttcacaggatatcttattaatgaatcacaacaaaacttcttaacatcttccttccaaatctatctttttctccaaaattcatagcttgtttgagggaattccctggtattctctaagaaatatcgaagaattctttcctagcccagtccactttgttttcgcttttttttttttttttttcttttttgagacggagtctcactctgtcacccaggctggagtgcagttgggtgatctctgctcaccgcaacttccgccttctgggttcgatcgattctcctgcctcagcctcccgagtagctgggattacaggcacacatcaccacatccagctaatttttgtatttttagtagaaatggggtttcaccatgttggtcaggctggccttgaactcctgaccttaggtgatccacccgcctcaaactctcgaagttctgggattacaggtgtgagccaaggcacccggcccctagtccactcttggtgttttgtctttttttccattcttatcttaacctcctgagtcaacattctctttcttgtgtgtctcccgcatcttgctagccttattctatctccttttattgtacagttttttctattcattattctgaacaatactcacaagttccagaacaaaaaaaccagatgcaaaatctacctgggggcggggatggtgggagaagaatgaaacatgtaaatactgctatattaataaatttagcctgatgataggtggaaatcggtaagactacatgagagacaagaaaatggttcaattttcctagtggaataatgaaaaaagagactaaaaaagtaggaactagtctatagagagtgtgaagagtttcttataatttctattaacttgatccctgagctactcgatgaagattttcacatttaaaaaacaagccatagaaaggcaaatgaggattatattataaggatgctacatacaatcatccttatttgcatgtgtgtgtgtgtttgtgtgggtgggtgagtgggtgagtattaaactctaatcccaatgtgacaagatgacaatagagtgacttagtcagatttacattagcaacatttttttcagaaagcttacactatattattggacatttttatcttattgtaacataattcatccaccaatccagatccctcaaggtatctatcattattttttggtgccatcacttgtttcttgattttacaaagctcaaaagttaacccaaattttgataattctccactagagcagaattgcctatttaaacatcatggctttgtaataagcaattgatagagagaaaatgatgcattttcacacatccaagtggtacagatcagcggttgtccaagcgtgtcccaaagaactggaattagatagagtgttgacaagtttcatcggtagaaccaacaatcagccggcgtacattggtatggtggtacagaagtaaaaatagtaaatactttcaaaccagttgataaatagttactgcaccaagttctctgagtagttgttcctgcgaggcttatcacctatggtctctcactcaggggcctctcaagtttcctcacagtctagcaatcaaaagattgaggcctggcacagcagagatcctcaaaaaacttgctccagcaccaagaccaacacacctgtgctgatctgtcgatgcctttgccaatcaggctgctccccagtgggggacacagtgaccttgggttggcactgcatcatggaaggcaatttctttcttttgttattattattattattattattattttgagacggagtctcgctctgtcacccaggctggagtgcagtggcgcaatctcggctcactgcaagctccgcctcctgggttcacgccattctcctgcctcagcatcccgagtagctgggactacaggcgcccgccaccatgcccagctaatgttttgtatttttagtagagatggggtttcaccgtgttagccaggatggtctcgatctcctgaccttgtgattcacccacctcggcctcccaaagtactgggattacaggcatgagccaccacgcccggtcatggaaggcaatttctagtgcccctctgtaagtcctgattcacagctaagagatgcttccagttctagtcgcacatttatgggagctgtagtctcctatggacatgagctctaaaagagcagaggatgctttttgcccaacaaagaggttaggcagcagactggcttgtgagccgatatgctggttaaatattttaactatcatccctaggtatgggagaggacattttccaagaacaaaaaatattgagaaatatgtgattaggcaacatttaatgttcctttacttcataacttttcacaaactatattattctaatatacattgaacctcttaaaagcatatttcatgcgacattttccaaacatatttgatgataggatccattcttgagggatatctaatgagattagtgttctgagcaacacacttggggaagcataagatcaaagacaaagaaaaaaaaagaaaggtatggatcttaatttcgtaagaaagaggaactataaaattatcttaaatgaaaattgcaaacagaaatgccagcctggactaaccataaagtgactactgttgtaatagaaaaacaaaaaacaaaaaaaggaaaggatcttaaaatgtgtatcttaaatagtcataattaagatgcgacatatgcagccttgaattcttcacttgtaccatttttaaaaaatcatttcaaagcaagcatttttattttcaggctttgtttacaggttgacttatctataaatgaaaaagagagcttctgtcaacacctatactgtgccagaagaagctaaaagcttaacaaaataagcattccatgaaaataaatctgcaagtgattaaatcaaggcttactttcttctgcttttgatctttaatccttacactacgtttttacaaatatatcttagtagcttttagaacatttgaaagtatgtctctatttaagtatttactgtatacacagagctgaaataagtcgctctgtggagttcagaaaccaccatctgaggcatcccacccgccttccaagaggttattatctttttgaggtggcaaaatctcctatcacgcttgaaaaaaggatcagtataggatacagctagtttccataagagttgcagaaatgcagtgtgtgactggatttccttcactataatcttatgccatcaaatgggatgctaaataaacacagaatcattgtaatctaaattaacccataagcacaatgattggcacagaagcaaactataaatgatagcttttgttactcattttctaacatttttttcttgattgtttttggtgttctttgctcaatacttactaaaacctacaacgtgaaccctcaatgaaaaccccaaccactgaaaataattttgagttaggttgcttagaagaaaagatattcataaagcaattacaacattttaaaaatgtagcataatttagtctatcatatcttgaaggatatgtgctagtagttttaggtggtacttggatcacagagttaatggtaagaactggaatataagcaataaagattccacactctgcttctataataattatgtcacaattccatttctgaatagaccattatgcttaaaaatcctaacagaagccgggtgtgatggctcatgtctgtaatcccagaactttgggaggccgaggtgggtggatcaactgaggtcgggagtttgagaccaacctgaccaacatatagaagccccatctctactaaaaatacaaaatcagccggatgtggtggctcatgcctgtaatcccagctactcaggaggctgaggcaggagaatcgcttgaactcggaaggcggaggttgcagtcagctgagatcgcgccattgcactctagcctgggcaacaggagcgagactgcgtctaaaaaaaaaaaaaaatcctaacagacaacatcataacaacgaatgctctttgagtacatacaatgttatctgagctcttcacatgtagaatcctatgagatggacactgatattaatatcacatgttacaaataaggaagactaaaaagtgtaactagcctgcttaagactacagaacttgggaggtgcgccgggcgcagtggctcacgcctgtaatcccagaactttgggaggccgaggcgggcagatcacgaggtcaggagatcgagatcatcctggctaacacggtgaaaccccgtctctactaaaaatacaaaaaattagccgggcatggtggtgggcgcctgtagtcccagctactcgggaggctgaggcaggagaatggcgtgaacccaggaggcggagctttgcagtgagccgagattgcgccactgcactccagcctgggcgatagagcgagactcggtctcaaaaaaaaaaaaaaaaaaaagatcttgggaggtgctgagtgcgcactggccagcatccttaactccatactgccatgcctctgtcaaaagccaccgggagaaatctgcagttaaggagatgtattcagaaaacctagttgagcattttttggtaaaagaaacattaactaaaactctttgaggttgtatatggtgtagaccaaagcctggcttttctttatacctattaaaaggcagacctgccagggaaaattgattaaataaaaaaaaaaaaagtataagcagaaactctcacaaggatctatgaggaaaagaaggtatatcctttatctgatccagcctgactcctgtgaaggctgaaaatatggacaaagtgattgggctcaaccagttaatgacttgatgatgcctcattaagattagcaagatatctcagtctaatagaaaaagcaagttcttgaagcaaaacacaactggaattagtcactcactgttacccactgcagtgcctacatgtattagttggactcctagcccacttatgttgcccagtgcaatgccaatacgtcaaaactagattcctattcagctttaactctgcttatttttagcaaacaggatgtctgtggtcaggagttccttcttagaaataaaccagctgaagttagcaaaatccaaaactgcagcttactcaacctctgaagaacttctagcttcattataatccaatttccatgctgaatgacactcccaccagtatcatgacagttgacagtcaccatgacaatgactggagcagaccaagaaaaaatagaaaagaggcagctccttgattccaggaaagtctcactcccttcaaaagaaaagcataaatattcctccccttgctcttcaacccaaccccctatgttaaagataccctgtatttgtaactgcctggttctcaggagctgggaaattaatttatgagctatgttcccacttctccaattccatgatgattgaataaagacagtactgcttgacactcactttcagttttgtgtattggcttttgcaacaccaaacaggaaaaagccccctttggggtaactgagacccccaataacatcactatctagtaggcggtcagtgccctggtttctacaacaaataaatctctcagtactccacagaatttcatgtataatttgcattccaattgtcacctaataggattgcaatataattgtgagctgcctgatacccaatccctctcttttctctgcctcctcccaactccactcacattccagtcttgtcccttcacttggaaaggtttttttccagatacctaatagacaactgtcttattgctttctgaacaatgctcatgttgtatgaagtgacagcctccctcacccacccctcagcacactctgcccttcctaggtgcttttattttctgttcacaatatttatccccatctgatagatttttacttatttttattgtgtctttctccatgggaacagggctgatgtctgttttgttcacagatgtcttcctagcactcagaacagcgccctgggcacagtaggcactatttgcttttgactacttgctagcctgatggaggcttgcttttcttgtgttacccagtggacttccatgaaataaaaattgagaagctcatatggtttggcaaggacttttggctacaatagcccctgctgttagaagataaaatcagccgtgtggaaagaagggacactagggtggtgactcggttctatgccctctactttttttaaattaataaccttgatttttagagcagtttcaggtccacagcaaaacagagtggaaaataagtagttctcatatagcccatccctacacatgcatagctttccccattatcaatatcctccttcagagtgttacatttgttacaatcaaagaacctataacgaaggataatgattacccaaagtccacagtttacattagggtacattcttggtgttatacattccatgggttctgacaaatgcataatgacatgtatccaccacttgacatcatagagaatagtttcactcggtcaaaaatgcttggtcctcttcctattgattcttcctattcccctaacccatactaaccactgatccatttaccctctccatagttttgccctttctagaatgtcatatataggcataccttgttttattgcactttattttactttgcaaacattacattttttacaaattggaattttgtggcatcctgcagggagcaagtctattggtgccatttttccaacagcatgtgctcacttcatgtctctgtgccacattttggtcgttcttgcaatatttcaaacttttccattattatcgtatctgttatggagatccgtgatcagtgatctttgatgtttctattataatcattttggggtgccctgaaccatgcccatgtaagatggcaaatttaatcaataaatattatgtatgttttgactgctccaacaaccagctattccctatccctttctccctccttttctttcctcccacccctcaggcctccctcttgcctgagataaatgatattgaaattaggccaatgaataactctacaatgtcttctaagtgttcaagtgaaagggggagctgcattaaataaaaagctacaaatgattaaacttggtgaggaaggcatgtcaaaaggcaagacagggcaaaagctgggcctcttgtgtcaaacagtcaagctgtgactgcaaagaaaaagttgttgaagaaaattaaaagtgttactccactgcacacaagaataagaaagtcaaacaggtttattgctgatatggagaaagttttagtggtctggctagaagatcaaaccagctacaacatttccttaagccaaaacataacccagagcaaggccgtaattttcctcaactctatgaaggccaagaggtgaagacgctgtggaagaaaagtttcaagctagcagaatttggttcatgaggaaaaaagccttctctataacgggtaagtgcaaagtgaagcagcaagtgctgatacagacactgcatcaggttatacagaaaatctagctaagatcattgatgaaggtggctacagtaaacagcagatgttcaatgtagaggaaacaacatccaatcaaaagacgattccattagaatttcaaagctagagagaagtagccaatgctggcttcagagctttgagggacaagctgactttcttgttgggggctaatgcaattggtgactttcagttgaagtcaatgctcttttatctttctgaaaatcctggagtccataagaattatcctaaatctattctccttgtgctctatacatgcagcaatgaagtctgaatgatagcacatctgtttacagcatggcttattggatattttaagcccattattgagacctattgctcagataaaaagattcctttcaaaatattactgctcactgataatgtacctagtcatccatgaactctgatggagatgtacaaggaaatggatgttgttttcatgcctgctaacacaacatctattctgtactccatggatcaaggagtaattttaatttttaagtagtattatttaagaaatacactttgtaaggctacagcttccatagatagtgattcctctgaaagatctgggggcaaaataaattgaaaaccttttggaagggattcaccattctagaagccattaagaacattcataattcatgggaggagatgaaaataccaacattcataggaagttggaagaacttaattccaatactcatggatgactttgaggggtttgagacttaagtggagaaagtaactgtacatgtggtgaccataacaaaagaattagaagtggagcttgaagatgtgagtgaattgctgtaatctcatgatcacacttgaaccaatgaggagttgcttcttatggataagcaaagaatgtggtttcctgaaatggaatatattccggtgaatgtggtgtaaacattgttgaaatgacagcaaagaatttagaatattaaataaacttagtagataaagtaatggcaggatgtgagagaatgaactccaattttcaaagaagccctaccatgtgtaaaatgatatcaaaacagtattgcatgctacagagaaatttttcatgaaaggaagagtcaattcatgtaggaaactttattgttattttattttaagaaattgccagagccaccttaatcttcagcaaatatcaaggcaagaccctccaccagcaaaaagattataattcactgaaggctcagataataattcacattttttagttatattatatatatatatatatatatattttttttttttggatggagtcttgctctgtcgccaggctggagtgcaatggcatgatcttggctcactgcaacctccacctcccaggttcaagtgattcccctacctcagcctcccgagtagctgggactacaggtgcacgccaccataccccgctaattttttgcattttaatagagacggggtttcaccatgttggccaagatggtctagatctcctgacctcatgatccgcctgcctcggcctccaaaagtgttgggattacaggcatgagccaccctgcccagccataaaatatttttgattaaaatatgtacattggtggccaggtgcagtggctcacgcctgtaatgccagcactttggaaggctgaggagggcagatcacttgaggtcaggagtttgagaccagcctgggcaacatggtgaaaccccatctttactaaaaatacaaaaactagcctggtgtggtggcatgcgcctgtaatcccagctactcgggaggctgaggtgggagaattgcttgaactcaggaggtggaggttgaaatgagccaagatcacagcactgcactccagcctgggcgacagagtgagactccatttcaataaaatacacacacacacacacacacattgtttttctagacataatgctattacacacttaatagactgtagtatagtataaacataacttttatatgcactgagaaagcaaaaattcattcacttgctttattgtgatatttggtttattgcagttgtctggaatcaaatccacagtatctgaggtatgcctatagttgaaatcatacagcatctagcctgttcagattggcttctttcacttagtgatatacatctcagcttcctgcatgccttttcatggcttgatagctttttttctaagtgttgaataatgtccctttgtctgggtgcaccatagtttccagtcacctactgatctcagtaaatctcagttgcttccaagtttcgacaattataaataaaacttctataaacatccatgtgcagaattttgtgtaaacatgttttcaactcctttgggtaaatatcaaggtatgtgattgctggattgtatattgagtatatttgttttgtaagaaattgccaaactgtctcccaaagtgactgtatcattttgcattctgaccagcagtgaatcagagttcctgttgtttcacatccttgtgggcatttggtgttctcagtgttttagattttgcccattttaataggtgtatagcagcgtatcattttttttatttgtaattccctaaagacatacgaggtttaacatattttatatgcttactggacatctgtatatgttattattttattattttatttatttttgttttttgagacacagtctcaccttgtcacccaggtggagtgcaatggcatgaccttggctcactgcaaccgccatttcccaggttcaagtgattctcctgcctcaggctcccgagtagctgggactacccttgtgcaccaccaggcccggctaatttttgtatttttagtagagacagggtttcgccatgttggccaggctggtctcgaacttctgacctcaggtgatctgcccacctcagcctcccaaagtgctggaattacaggcgtgagccattgtgtctggcctattctttcatgagatgtctgttcaggctctttgtcatttttaaaaaatggctttaaatataaatttcttaatgttgagttttctctgttttgtgtttttgagatggagtttcgctgttgtttcccaggctggagtgcaatggcgtgatctcagctcactacaacctccgcctcccagtttcaagcaattctgcctctgcttcctgagtagctgggattgcaggcatgtgtcaccatgcccggctaattttgtatttttagtagagatggggtttcaccatgtaggccaggctggtcttgaactcctgatctcaggtgatccacccacctcagcctcccaaagtgctgagattacaggcatgagccactgtgcctggcccttactgttgagttttaatagttatgtgcatgtgtgtgtatgtatttccccaatttactgatacgattgacaaatgtaattgtatttaaggtatacaatataatgttttcatataggtatacattttgaaataattaccacaatctacttaattatatgtccattacctcaaacattaactgtctgtgtgtttatgcagtgagaacacttgagttctctaggagcatatttcaaatatgctttgcattaactagagttactatgttgtaaatgaagtatcctgaacttattcatccaatagtgaaaagtttttatgctttgactcatatttccactttctcccaacccccagccactagtaaccaccactctactctctgttactatgagtctggctcttttatagattccacatgtaagtgagatcatgcatcatttgtcttcctatgtctggcttatctcacttagcataatgttttccaagttaattcatgttgcggtaaaaggcaggatttccttttttttttttttttttgtgatggagtctcgctctgttgctcaggctggagagtgcagtggcgcgatctcggctcactgcaagctccgccccccaggttcacgccattctcccacctcagcctcccaagtagctgggactacaggcatctgccaccacgcccagcttattctgtttttgtatttttagtagagacgggatttcaccgtgttagccaggatggtctccatctcctgacctcgtgatctgcccaccttggccccccaaagtgctgggattacaggcgtgagccactgcacccagacaagatttcctttttctaaggttgaatcatattctactgtatatataatacattttctttatccattgatttctcagacacttaggttgtttccgtatcttggctattgtgaataatgttgcaatgaacacagaagcaccagctatctcaagatagtgattttatttcctttggatatgcacccaggaataaaactgctggatctatatggagcatatttaaacttttaggagccaccacattgttttccatagtggctgcatatttacactcccaccacaagtgtacaagggttccctttgctccacatcacttgttatcttttgatattttgataaaaaacatcctaatagttgtaaggtgatatttcattgtggttttaacttgcatttccctgatattagtgatgttgaacatcttttcatatactattggctttttatatgccatctttggaaaaatgcctattcgtgttctttgcccatttttaatcaggttttttgtttaattttgctatttacttgtataagtttcttatatattgtgatgattgtttctttgctatgcagaaacttttttgattaatatattcccacattttgcttttggtgtctgtgcttttggtgtcaaattaaaataaaatcatttctaagaccaatattgaggagattttcttctatgttttcttctaggagtttcatggtttcaggacttatgtttaagtttttactcaatttttaattgattttcatgtatgatataaaataaggatacaatttcattcttttgcaggtgaatgtccagtttctccaacaccatttactgaatttctttttttttttaattattattttttttaaattatactttaagttttagggtacatgtgcacattgtgcaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatggccctacaaaggacatgaactcatcattttttatggctgcatagtattccatggtgtatatttgccacattttcttaatccagtctatcattgttggacatttgggttggttccaagtctttgctattgtgaataatgccgcaataaacatacgtgtgcatatgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttgtccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttagttactgtagccttgtagcatagtttgcagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcattcctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattatcttttttggttgtgtctctgcccggctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttacttctgtcttcatttcgttatgtacccagtagtcattcaggagcaggttgttcagtttccatgtagttgagtggctttcagtgagattcttaatcctgaattctagtttgcttgcactgtggtctgagagatagtttattataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaagccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagtatgttgaatattggcccccactctcttctggcttgtagggtttctgccgagagatccgctgttagtctgatgggcttccctttgagggtaacccgacctttctctctgactgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggtaccattctctgcatcactttcaggtacaccaatcagatgtagatttggtcttttcacatagtcccatatttcttggaggctttgctcatttctttttattcttttttctctaaacttcccttctcgcttcacttcattcatttcatcttccattgctgataccctttcttccagttgatcgcatcggctcctgaggcttctgcattcttcaggtagttcttgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctctcagctcgtcaaaatcattctccatccagctttgttccgttgctggtgaggaactgtgttcctttggaggaggataggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttagaataccctgccctgtgaggtgtcagtgtgcccctgctggtgggtgcctcccagttaggctgctcgggggtcaggggtcagggacccacttgaggaggcagtctgcccgttctcagatctccagctgcgtgctggaagaaccactgctgtcttcaaagctgtcagacagagacttttaagtctgcagagtttactgctgtcttttggtttgtctgtgccctgcccccagaggtggagtgtacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccgtgggtggaggaccctccgagccaggtgtgggatatagtctcgtggtgcgccgtgttttaagccggtctgaaaagcgcaatattcgggtgggagtgacccgattttccaggtgcgtccgtcacccctttctttgactcggaaagggaactccctgaccccttgcacttcccaggtgaggcaatgcctcgccctgcttcggctcgcacacggtgcgcgcactcactggcctgcgcccactgtctggcactccctagtgagatgaacccggtacctcagatggaaatgcagaaatcacccgtcttctgcgttgctcacgctgggagctgtagaccggagctgttcctattcggccatcttggctcctccctgatgcctttcctttctaggagagagaaaggcattcccaagacacccaagagcctctatttggtaaggtctcctttacaaatgtgtatgtatctcaagctcacaatattcctcagagctccaattacctatgtctaactcatttttgacaccttcatttggatgcctcatgggaatagatttcaaatctatcaagtccaaaaaggagtcatttccaccctgccctcatctcccctgccacccaccacacacacgccctacggccctattctaggcctaggagtctacctatcagtaaaacatcactatcttctagccaattgcaaaaaaacacagaaacttggagtcatttttgttcctgtccctcatctctcacatgcaatccaacaacaggtcccagtgttctaccatatctccactgccactaccttaatcctagccacctgcaccagctagcttgaaacctactgaatttctttgtatattgtatatgacaggccttcatcagataggtcttttataattttttcccagtctgtggcttgtcttctcattctattggtattatcattctcagagttttaaaatttaatgaagtctggattacccatttttttcatagattgtgactttggtcttgtatgtaaaaagtcatcaccatatccaaggtcatttaggttttctcctagttatcttcaggagttttatagttctgcattttacatttaggtctatgatacattttgagttaatttttgtgagggctgtaaggtctgtgttcaaacttccttttatttgtatttatttttgcctgtgggtgtccagttgtttcagcaccatttgttgaaaagacttttcctcattgcatgggctttggtcttttgtgaaagatcagctgactatatttatattgttctatgtctgggctctctactctgttccattgatctatgtatctgttccttcacacaataacaaactgtcctgattactacaagtttattgtaagtcttgaagtcaggcagtgagtgctccaattttgtttccttcccttactactcagttgactattctgggtctcctacatctccatataaactttagaattatttgtcaacatccacaaaataacttgctacattttaattgagattgtgttgaatctatagatcaagttgagaagaactgacatcttggcaatattgagtctttctgtccatggatatggaatatcttttcatttacttagttttttaacatcctttatcagagcttcatagttctcctcatacagatcttgtgtgcgtatgttgttaaatttatgtctattttcttttttggtatgctaatgtaaatggtaatgcgtttttaatttcaaattctgcttgtttgttactagtgtatattacttttgtatattaaccttatattgtacaatcttgctacaattacttattagttttttcattgttgttgattctctaagattttatacatagatgcttctgtctctgcaacaaagatagttttatttcttccttttcaatctgtataacttttattaccttttcttgtcttatggtattagctaggacttccagctaaaaaacagtggtgaggagatattcttgccttgttctgatcttagtgggaaaactttcgagtttctcaccactaagtaagatgctagctgaaggtattttgtagatgtttcttgtcaatttaagaaagtttcctcggctgggtgcggtggctcacacctgtaatcccagcactttcgaaggctgaggcagtcgcatcacaaggtcaagagatcaagaccatcctggccaacatggtgaaaccctgtctctactaaaaatacaaaaattagctgggcatggtgttgcacgcctgtagtcccagctactcaagaggctgaggcaggagaatcacttgaacctgggaggtggagtttgtagtgagctgaaatcacaccactgcactccagcctgggtgacagagcgagaccctgtctcaaaaaaaaaaaaaaaaaaaagaaagaaaagaaaaagaaatttcccgctatccttaggttgctgagagtttttaccatgaattggtattaagttttgttattttccctcatctattggtatattatgtgattttatttagcctgttgatgtgataattacattaattgatttttgaatattaaaccagctttacatatcttggataaaccccacttggtcatgatgcacaattcttttcaaacattattggattgaggggttttgcatctttgttcatgagagataattgtctgtaagtttgcttttttctcctaatgtcattgggtggtttttgatattggaataataccagcatcatgaaatgagctgagaagtattccctctgcttctgtattctgcaagagtttgtagtaaattggcataatttatttctgaaatgtatgggaaaattcaccagtgaactgactgtgcctggtgctttctgtttggaagattattaattattgattcaatttctttaatagttacaagcctattcagatttctacattttcttatgtgagttttggcagattgtgtctttcaagaaattggtccacttcacctatgttattaaatttgtgggtagaaaagtgtacataatagtcctttattgtctctttagtatccataggatctgtagtgctctctcctctttcatttctgacattagtattttgtgctccctctcttttttcttagcctggctagaggcttatccattttcttgatttttttttttttccaaaaaaacaggttttggttttgttgattatctattttcagtcttgttgatttatgctctaattttttattatttcttttcttctgcttattatcaatttaatttgctcatttttccctaattttctgaggtgggggtttaaattattgatttcatattttttctttttaaatatacactttcaacattgtaaatttccctctaagcatggcttttactgcatcctacaaactttaattaattttattttattttcctttacttcaaattatagtttctcttgagattttttctttgatcgatgtgatatttagaagcatgttgtttaatctctgcttattttgaaaattttcagctatttcttttattgatttccagtttaatttcattgtggttgaaaaacagacattgtataatttctatttgcttcagtttgttaaggtgtgttttatggttcagaaagtggtctgtcttagcaaattttccatgtgatcttgagaagaatgtgtaatctgttggtgttaggtgatattgtctagagatatcaattttaccctgttggttgatggtgttgttgagttcaaatatgtccttataatttttgcctactagatctgttcatttttgaaagacgatgttaaggtctccaattataataatgacttcatctttacacttgcagttctaatcagtttttgcctcatgtatttggacacactcatgttaggcatgtgcatattaaggactcatgtcttcttggcatattgactcccctttatcattatgtaatgcccctctttaccctgataattttctttgctctgaaatctgccctgtgtaaaattaatataatgactccaaagaccttctaattagtgttagcatggtatatcattctccatccatttacttttaatttgaatgtatctttgtctttgaagtgggtttcttgtagacaacatatagttagggcttgtttttctcatccactccatcaatctctgtcttaattggtatatttaggccactgacatttaaagtgattattaatatagttggattattgcctatcacatttttaccattttctttttgtttcctttattctttgttcctattatctttcacatgttttctgtcttttgtgattttaattgagcattttatacgaatttattttctctcctttcttagcctatttgttttcctcttctttttcactctttttagtacttgctgtagagtttgcaatacatatttaccactaatgaagttcacttctaataacaacacactacttcatggggagtgcaggcactctgtcataacaacttattcctaattctccttcccaattcttgtattattgatgtcattcatttcacctgtacataagcatacctaagtgtgtatgtgtgtgtgtatatatatacatgagcatacgtaattgaatacattgttgctattatcttgaagaaagtggtatctgtgagattactactcagaagaataaaggtttttgtggtacattcacttattcattctgatgctcttcttttccttacatagacttgagtttctatcctgtatcattttccttctctctgaagaacttcttttaacatttatttcaaagcaggtctaccagtaacaaacttcctcaacttttgtccgtctgagaaaagtctttatctctccttcacttttgaaagatagttttgcagggtacagaattcttgatgttttccattattttttcctctcagcactttaaatatttcatcccactctcttcttgcctgtatagatctgagaagtcagatgtatttttcatctgtgcctctttacaggtaggtgttccccattctgccttaaaaaagttttttttaaatctttgattatctgaattttgaatatgatatacctatgtggggttatgatggtttttgtggttgttgctttgttttttgacatttatcctgcttagtgttctctgagttttctagatctgaggtttggtacattattttgcagaaattctcagttatcattgcttcatacattgcttgtttctttctctttctttcccttctgttattcccactatacatatattacacttttgtagttgccccacagttcttgctctgtatttgcacttcgatggtctttttttaagttttggaagtttctgttgaggcatcatcaatttcagagattcttttctcagccatgtccagtctaccaatgagctcatcaaaggcattcttcatttctattacatggttttcatctctagcatttcttcttgatcttttcttagaatttccatctctctgatgacattatccatctgttcttccatgttgtctgctttttctattaaagcccttagcatgttgatcatacatttataaaaattatcggtttttctaattctgatattcctatcatatatgactctggttgtgatgcttgtttaatctttagaaactggattgtttgcctcttagaatgcctgaacagctgacatgaggtactaggtaaaaggaaccatagtcaataggcctttagttgtgtgatggtaatacggggaagcgaagagggagacacaacattttttttttttttttgagacagagtctcgctctgtcacccattctggagtgccgtggtgcaatctcagctcactacaacctcagcctccctggttcaagctattctccagcctcagcctcctgagtagctgggattacaggcatgcctcaccgcgtccagctaatttttgtatttttagtagacacaaggtttcaccatattgaccaggctgatttcgaactcctgacctcaggtgatccacccacctcggcctcccaaaatgctgggattactacaggcgtgagccaccccgcccagccaggcaaaacattctttagttctatgattaactctcagattttttgggagtctttgcccctggaatgtgaactttaccagtgcttctcacatttcttccctgcttaggtggaacataatagctagaggaagttgcagttgcttatttcccttccccctagtcagttatggtctgacagatccccagcaggtgaggctctgttaactagtttctcctgagggcaggtcttgttaagacagaatgctctggcgtatttcaaaatggttacttttgccctctccctgctggaagtacgaaggtaagttcccccaccagttgtcactgtggggagctggtaaagctcctggaggtaaaactcacaaaagtatgagggcctctctgattaggtccccacgaagttcttaactctcagacatgtccacactgagcctcctgcaaaccatcaactactgtttaagtttttgtaacttagcactggttcctgtggaagtttctgcttgttgagtttctgctcaggtaaattgtgatttgctgtgtctgactgttggtctttccaattcgggggacagcatttgtcctgtgacttcacttgtaggatgatctgaacagagttgttaattgttcagtttctttagcttttaacttgctaggaaaatggacaaactgtgaacttcttacatgctggaccagaaaccaggagttcacctctcttccttctgatcagaaaatctctgcctggcacccatctcctgattactctaagtgccctgaaagcagtgaacatatctttgttcacccccagatccccagtccccaggacagtgctggcacaatcaggtggcttctccacatgaagggtgaatgaatgcctaatgggcacgtactgaaccagggatgagccaagctgctccttcggtaaggctttagaaagcatacagatatcctgcccatctccttccctacccaaaaccccacagacggaagatgccttatttcagaaacacagagccatactgccaaggtcacaaagcaaagactcaggctatagagggaagcttgggcacaggaagcatcagggcattactcaaatcactgccaacaagatgtcctgaaagcggaacagtgttcacctctaaatcaagcagctgcagcgtctgtgttttgtttctttcttaaaatcattaagagcagccacttccattgctcctagtgcatttggtggcataaaaatagctccgaaagccaagggcgcattgggtgcatcacagactctgctccttaataacttaggatgcatgaggttaaagcagtgagaataatttagggtttggaaaatgtttgcgagtgagtcgacatttaaataacttcattatcattcattgacagattttttttaacctgtcagtgcaactgatatttctattaccatgttataacaaacccctgcacattttaaatacagtcactggattccactagtctacccactgtcaagaaaatatcttcaaatccatttttcataatacctcaagaatataataggcaatctacatcaaacgatgacgtggagctgaaggaaattgtctcctgctttctaaggaatctgccccgaaatacgtttgcctgtcagcctaaacatataattcaaatgtgctgccgagacattatggtgcattctgagctgaatgagcttccctctctttcctggattccctgaacctttcagcgtaacttgcagaattagctaaggggattaaacagtaggttaaggggaagtcatgtaaaattgacataaaaatatttccattctgtcatgtatcacagaatttttaatatcacatcaaaagcttttattctttaaatatgttacttttatgttaataagggatagaagttctcatctatctagcagtctgttccatttttcttctcctaattatatctttattctgtgttcttgatgtttctagtcatacagatccggtgagataagaaatttgggtgcatttggctgggcgcagtggctcacgtctgtaatcccagcacttggggaagccgaggcaggcggatcacgaggtcaggagattgagaccatcctggctgacaaggggaaaccccgtctctactaaaaatacaaaaaaattagctgggtgtggtggcaggcacctgtagtcccagctgaggtaggagaatggtgtgaacccaggaggcggagctggcaatgagccgagattgcaccactgcactccagcctgggagacagagcaagcctctgtctcaaaaaaaaaaaaaaaaaaaggaaagaaaaatttgggtgcatttgattggggttgtgtgcagacagtgacttttctgctgtaggttacccttaccactgacatgtctgctggtttatttttgagtataaaagtaacttacattggccctgatacctggatctctattttgcataagaaagggcaaagtaatttaagcagaggtctcctgttcatctttttaggagcaaattggagtactatccttcactagatgatgtccatgacatccttcttatacaaacacacagttgtctgtgcccaatgtatccaatatgtaccatccattctagttcttactgccattcctagggcaggccatcactatttctgctgtggctagaacttgttgcagtagtccaggtaaatttactagcagctccccctcacagatgcggcctctctcatacctccatgtctttgcaaaggcaatatccactgctaagcagacaagctggtactggtgaggagggcatagggcacgtattccttctcatcttttaacattctactccacagttttcttcccagggatgccactcctgaccatgccaatcaactagcagtcagcctttgttctttcttccatgacaacccagattccctggcattgtatcgttgttgtcaatgctcacagttgtctgtgctaatagactgcattttctaaaggcagggatagacaataatttatcctttcactcttctttcagccgatcacaattcattcatacacttcaaggctggaatcaaatatcctttctttttttttgagactgggtctcactttgtcaccaggctggagtgtggcggcgcgatgttggctcactgcaagctccgcctcccgggctcaagcgattctcctgcctcagcctccccagtggctgggactacaggtgcgcaccaccatgcccaggtaatttttgtatttttagtagagacgggttttaccatgttggccaggctggtcttgaactcctggcctcaagtgatctgcccactttggcctcccaaagtgctgggattacaggcatgagtcactaccggccaatatcccttctttcattgaaccttttcacatccctctgctgaatggaatgcctctctcctttatactgtatgtgatttatttgaatctctccttattggcctttatatgctgccatgtattacatttacatgcgtttgatctcgcttaccagatggccatctactaggagcaaaatgcatttatgcttactcttctgtatctctctccaccatttagctgcttcttacaatccagaaggtgctcagtgttgctaggttgaaccgaacacactatcctgtaaagttctcctttatcaccagaaaattcagtttgaaaaatttcacatttgggttttgcatttccttttggagggtttgggagcaagaaaacttcagggcttccagctgagtttgtgttgggtaggaataattatgagacataaatataagagagattagtgactcactaaggaagaactcatacaaatgcatatgcaaaatgtattatatatcagtttgtttaaatgtctataaatacagctatggaaaataaaatatccatttgtcagttataagggtaaagataaatttgggaggagagcaacttatctttttagctttgtgacatgttctatcttttgatacaaccccaatctccaggtacttctagtctgacaggtagagcatccttcatcacactggggtcaaatcttcataggctgcattaccctacactcctgaattatgcggtttatgaataacagtgaacatttattgaatgcttaagataccacacactgggctaagcacttcataaggattacctcactgagttctctaacatcgcacgagttaagtactggtatgatccacattttacagatgaggagaccaagacttaaggaagatgatcagcttgcccaatgccacataggagtgatgaacatggcctagattcaaactcaggcagttaggctccaaagtcagcatgcttaatacagagatatggtgaattgtccatttaaatagggtactattcgtagaatgatggcagtgtgtctgaaaaagaatagatttttcctaatggagctcccagaacttacatcacctgccttccaaacaacgaaccactgctgtttgtaatattggcgagttgtcatcctaaattcaattttttattagaatgaggatccttaatccaagcttctagtaaactagttcaactgtattaaaggtaacagggattactgcagacttccccccagttgtgaatgcactgtacttgaaatgaaatggcatacatacacacgtcctttatcttagagcccttgttagaaaatgaattggagctccaattctgccaatgtgtttcactctcttctcacacggtactcagttggctgaagacgcagtgttattgtcccgacttaagaatatgcaaaaataggccaggtgcagtggctcatgcctgtaatcccagcactttgggaggccgaggcaggcagattgcctgagctcaggagttcgcaaccagcctgggcaacaaggtgaaaccttgtctctactaaaatacaaaaaaaattagccaggcatggtggcatgtgcctgtagtaccagctacttgggaggctgaggcaagagaactgcttgaacccaggaggcagaagtttcagtgagccaagatcgcaccactgcactccagcctgggggacagagtgagactccgccttaaaaaaaaaaaaaaaaaagaatatgcgaaaataaataaaatacttaccaaatgaagtcaatgttacttggctctcctagcttttccatcaaaacatacatatgcaaattatgaaaaatgtattctagaaggacaagctacgaaacatatagcagtgacaatggaatttacttgatcccttaaatttaaaatggttcaaataccctcaattggccgggcgcagtccctcacacctgtaatccaagcactttgggatgccaaggcaggtggatcacgaggtcaagagatcaacaccatcctggccaacatggtgcaaccccatctctactaaaatacaaaaattagccaggcgtggtggcatgcacctgtagtcccagctactcgggaggctgaggcaggagaatcacttgaacctgggaggcagaggctgcagtgagccaagattgtgccactgcactccagcctggtgacagggcgagactccatctcaaaaaaaagtgtaagctgtcctctaggtgtcatagtataatgtcagcttgttaggtttctttcttttcttcaccatagatgatgagattttcagtctcataagatacatgtttaactgagcttttgttacctttagttttccaaaggttgaatgaggtaaaaaaatgagtaaatcaattcctcatctgtaattggagacaactggaccagctgatctctagctttgactctaacatttaagaattccagtatcagggagttttagggaactgaacatctatagtgaaacctattacacacgtgaaaagttaaacttatggataaatatcatccccaaatcactggagacattcagggtcagagtgtcagggtgaacgcacatcttctttgtgtattacatcctgtctgttttctacttaatttcttgaagggtgaaataattgatgctatccagaaaacatatgcttgcctatttgtgcatatcattacaatgtcttttaatatcaccatttattttgtccctacccattactttgaggaaacctaaaaatcctagaaaattagagcttcaatgacatttagaaataatctcatctctcttcaatgttttttttaagtggcagaagagtttacgcccaagttagtcctcattaaaacacctgttctccatttcacccccgacccaacacacacagtttaccttccttattaactgtttcacactttcatacaatttcataggatcaataaaatagttttcatataataaaaagtttggctgggcgcggtggctcgcgcctgtaatcccagcactttgggaggccgagacaggcggatcatgaggtcaggagatcaagaccatcctggctaacacggtgaaaccctgtctctacaaaaaaaaaaaaaaaaaaaaaaaaaaaagtttcagcattctgattctgcagatgaagtagctgagacttagattaaagtaagtcaagcatttagttgagaccaaagtcatgaaaagaatccaggttttctgattctcatggtaagatatttcttagaattatacattgtcaaatatgcaaaggcaccttcaactcgtcgattaaaaaaattttgtaaagtctatccattttagaattagctaatactgtaagaaaaaatctgataatatttctttagaagttgatttccccccaaacaaacaaacaaaacagaaacaaacaaagagggctacaaatgtaaaaatctgtgtcctgctacacttcagaatcatacccagctgaaaactgtagttacatttgggcaagaggcaaggtctaagagaacattaaaaataaaaatattatatgaaatgcttacagagggctgggcacggtgactcacacctataatcccagcactttgggatgccaagagggggcagataacttgaggtcaggagttcaagaccagcctggccaacatggtgaaaccctgtctgtagtaaaagtacaaaaattatctgggtgtggtggtagacacctgtcatctcagctactcaggacactgaggcaagagaatcacttgaacccaagaggcagaggttgcagtaagctgagatcgtaccactgtactccagcttgggcaacagagcatgactccatttcaaaaaaaaaaaaaaaagtgcttacagagaatgcattccagcatccctcatgaaatagagatgatttttttttttttttgccaagatccccttcagtcactgatctctattcctccagtctgcatgtagtgattcccaaccaactcacaggcaatatctgtttcacaaaatctggatggtagagctgacagagggtggcgctctaatatgcaccatcacactagacacactgacatttgcccacaagtcccaagagaattgccagattcccattgccttcagattttccttaaaaaaaaaaaaaagcaaagtaatacaggaaaagctgccagtcccatctcacaatctttccagagtcccttccctggattcttgaatgctttgagatgaacactgtgtagacgaaaacactcagattcttcttggcttgggttctttctgtggcaaaggctagacctgaacagccagtaacagatgctggaaaatgttcacccaaagcccaagactttgattcttcaaaacccgcacagtatgtagcctgtgtgaagttaattcaattattagaaacttagtatagaaaaaaatctaaagttggctcactagaaacaggtagtgtgcttggctgtcatggagaaaaatgaaagtagtgagtaaatacatattcaactgaaacaaccaggtgctcacattgggactaatcaagagaacaactcagtccacggagaacagagaaaagcaaggcagaatgacggtccaccagggagcaacacaaagccagggtaacctcccccgcccagggaagcagcgggtgagtgtgtgactctgggaacccacgcttctcccgtggatctttgcaaccctcgagtcagaagatccccatgtgaacccactccaccatggcctttagtctaacacacagagctaagtgggggcttagcagagcagccactcgagcacatgcagagacgtgggaaccttagatactcgggctttctgagcttcccggcaaaagcagctgaaactctggcaaagcaggaggttagaccctcatatacaccctcaggaaaaggctgaatccaggggaatgagtagcattcatcttcaggccctactcccacaacacatcaggataagacctgctgatgcggaactccagccagccactggtagcaacaattgcacctcactgagctggagctcctagggttggggggtggggtaggggttgccatattggctgtgtggcagacttagctttttcagccttcgggctttggaaagaccaaggtaaccaggggctgaagtggatctccagaacagcacaactgctctatgaaaacgtgactagactgctttttaaagaaggtccctgatcctgttcctcctcactgggtggggcctcccaaaccagggtctccagccaccctcagtggtgttcactggccaacagaggtttcaaacctccctgagacagctcccagagggaggggtgggccaccaactttgctgttttggtgacttagctgtcctgccctttgggctttggagagacataggtgaccaggggctgaatcagacccctggcacagcacagctgctatacaaaaatgtgatgacagctgctatacaaaaacatggccagactgctttttaagcgggtccctgatccagttcctcttcactgtgtggggcctcccaacccggatctccagctacctcctacaggtgcatttgagctggcaatgggtccataccttcctgggacagagctcccagagggaggggcaggcagccatgtttgtggttttgcagccttcgctgttgatccctccaggtactggaaaacccaagttgactaggaactggagcggacccccaacataccacacagcagccctattaaaaagtggccaaactgggccaggcatggtggctcatgcctgtaatcctagcactttgggaggcctaggtgggtggattgcctgagctcaggagttcaagacctgcctggggaacatggtgaaaccccatctctactaaaaatacaaaaaattagccaggcgtggcagcgggcacctgtaatcccagctactcaggagactgaggcaggagaacgcttgaacctgggaggcggaggttgcagtgagccaagattgtgccatttcactccagcctgggcgagagagcaagactccatctcaaaaaaataaataaaataaaataaaataaaaataaaaataaataaataaaaagtggccagactgtttgggaggcccaggcaggcagatcacctgaggtcaggagttcaagaccagcctggccaacgtggtgaaactccatctctactgaaaatacaaaaattggccaggcgtggtggcatgcacctgtaatcccagctactcaggaggctgaggcaggagaatcacttgaacctgggaggcggaagttgcagtgagctgagatcacgccactgcactccaacctgggtgacagaatgagattccgtctcaaaaaaaaaaaaaaaagtcgccagactatgtggatgcctgttcccatatctcctcactggccacccccgactagggctattgagccaatagcagctctgtaacttcctggacagagcccccaggggtaactgaaagcctctatgccactgactctgcagtggaactgcccttgctaccctccaacaaacaaaagagcaaagaccctaagtgccttatccacaccaccaacaagctgcagtcaacccaagaagaggaggtcactccatctcccatggatcccctccaaccccactcattaccagacagggaacctgcaggttgggcccatcgcacagacccgctatcctgagctgattacactgagcgactgctgacctgcatctctctggggtagagtccccaggagacatgcaaaagacctttagccacaccactactaaggtctcttcctctgctatctccaagttagggaaggaacataaaccctgagatttccccagagctgcagtgggcagcccaagagtgccaagctgcgatctgcagccagaactcaagggggagaaaagcccacactttcagagcactgagagggaacaaggctgcaaaggagaggaaacatggggaagccacacaaccgagcaaggatctaccaactgacaaatacacctaagcaccacctactggatcatacctcaaagcctcagcaccaaaaatatcttgctaaaaaccccacttgctaaaagaagtcagcttcaaataaaaacgctgcagaaaacctcgaccctgtgagaacatttagaaaagacatctattgactgtacttaatctacactgcacttaaaggaacacccacatgcagagatgagaaaaaaccaatgcaaagcctctcgtaactcaagtggccagagtgtcatatgtcctacaagtcaccacaccagtactcctccaacaagagttcttaaccaggctgagctggctggtttttgtattgtccatgaaaacttccccaactttgctagagaggccaaaagtcaaattcaggaaatacagagaatctctgcaagattctacaccagaaggtcatccacaaaacacataatcatcagattttccaaggtcaaaatggaaaaaaagaatgttaaaggcagccagagaaaaaaggtaggtcacctacaaagggaatcccatgaggctaacagtagacctctcagctaaaaccttataagctaggacagattggaagcttatattaaatttttttttttttttgaaacggagtctcgttctgtcgcccacgctggagtgcagtggtgcagtctcggctcactgcaagttctgcctcccaggttcatgccattttcctgcctcagcctcccaagtagctgggattacaggcacccaccaccacgcccggctaatttctggtatttttagtagagatgggtttcaccgtgttagccaggatggtctcaatctcctgacctcgtgatccgcccgccttggcctcccaaagtgctgggattacaggcgtgagccaccgcacccggccatattcaacattcttaaagaaaaaaaaattcctcaccacagatttcatatctggcccaactaacttcctaagtaaaggagaaataagttccttttcaaataagcaaatgttgagtgagcaatggaacactaagtatagaaaggaaataccactaccagctaatagaaaaacacacttaaatacacagaccagtaacagtataaagcaaccacaaaaacaaaccagcataataaccagctaacaacacaatgacaggatcaaatccacacatatcaataccaaccttgaatgtaaactggctaaatgccccactttaaaggcacagagtgtcaagctggatgaaaaagcaagatcccatgaaatgctgtcttcaagagacccatctcacatgtaatgacacctataggctcaaaataaagaaatggaggaaaatcaaataggaaacagaaaaaagcagatattgctatcctaatttcagacaaaatagattttaaaccaacaaagatcaaaaaagacaaagaagggcattacatcatagtaaagggttcaattcaacaagaagacctaactatcccaaatatatacacacccaacacaggagtacccagatttataaagcaagttcttagagatctacaaagaaacacagactcccacataataatagcgggagacttcaacaccccactgacagtattagatcattgagggagaaaattaacaaggatattcagaacctgaactcaatattgtaccaaatcaatctgatagacctctacagaactctccacccaaaaacaacagaatatacattcttctcatcgtcatatggtgcataactctaaaatcgaccacataactggacataaaacaatccctggcaaatggaaaagaaccaaattcataccaaacacactctcaggccacagtgcaataaatgtagaagactaaaaaaattgctcaaaaccatgaaattacatggaaattatgcaacatgctcctgaatcacttttgggtaaataatgaaattaaggcagaaatgaagatgttctttgaaactaatgagaacaaagatacaatataccaggatatttgtgatacagctagggtagtgttaagaaagacattaatttctgcattaaatgcccacatcaaaaacttagaaagatctcaaattaacaatctaacatcacaactgaaagagaagcaagaacaaatcaaccataaagctagcagaaggcaagaaataaccaaaatcagagctgaactaaagaaaatcacgacatgaaaaactattcaaaagatcaatgagtccaggagtttgttttttgaaaacattagtaagacagacatgccactagctcgactaataaagatgaaaggagagaagatccaaatatacaaaatgagaaatgatgagggaggtgctaccaccgaccccacagaaataaaaataaccatcagaaactactatgaacacctctatgtatacaaactagaaatcctagaagagatggacaaatttgtggacacatacaccctcctaagaatgaaccagaaagaaattgattccctgaacagaacaataacaagctctgatattgaatcagcaataaacagtctaccaaccaataaaagcccaggaacagatggattcacagccaaattctaccagatatacaagtaagagctggtaccattcttactgaaacatctccagaaaactgaagagaagggactgcttctcaactcattccatgagactaacatcatcctgataccaaaacctcgcagacacacaacaaaaaaagagaaaattttaggccaatatcttcgatgaatatcaatggaaaaatcctaagcaaaatacttgcaaactgaatccagcagcacagcaaaagttaatccaccatgatcaagtaggcttcacatccaggatacaagcttggttcaacacaggcaaatcaataaatgtgattcatcacataaatagaactaaagacaaaaaccacaggattatctcaatagatgcagaaaagacttttggtaaaattcaacgtcttctatgttaaaaactctcaataaactaggtattgaaggaacatacctcaaaataataggagctatatatgaaaaacccacagccaacatcatactgaatgggcaacagctgaaaacattccccttgtaaaccagcacaagacaaggatgccctctctcactgttcttattaaacatgttattggatgtcctagccagagaaatcaggcaagggaaagaaacagagggcatccaaataggaaaagagggagtcaaactgtcgctgtttgaagatgacatgattctatacgtagaaaaccccataattttggccccaaagctccttcagctgataaacaacttcagcaaagtttcaggatacaaaatcaatatacaaaaatcactagcattcctatacactaacaacaaccaagcagaaagccaaatcaggaacacaatccaattcacaactgccacaaaaaggataaaatacctagaaatacggctaaccaaggtggtgaaatatttctagaatgaaaattacaaaatactactcaaagaaatcagaaaagacacaaacaaatggaaaaacatcccatgctcatggataggaagaatcaacatctttgaaatgtccatgctggccaaagcaacctacagattcaatgttattcttatcaaactaccaaagatactcttcatagaaaaaactattttaaaattcatatggaatcaaaaaaggggctcaaatagcccaggcaatcttaagcaaatagaacaaagctggaggcaccacatttcctggctataaactataccacagggctacagtaaccaaaagagtgtggtactggtacaaaaacaggcacatagaccaatggaacagaatagagaacccagaaataaagccacacacctatgaccatctgatcttccacaaagttgactaaaacaaacaatagggaaaagactttgtattcaataaatggtgctggaataactggctaaccatatgcagaagattgaagctggaccccttccttagactgtatataaaaatcaactcgagatggattaaagacttaaatgaacaactcgaaactatagaaatcttggaagacaacctaggcaataccatcctagacataggaacaggcaaagattgcatgacaaagacaccaaaacctattgcaaccaaagcaaacattgacaaattgaatctaatcaaacttaagagcttcttcacagcaaaaaagaaaagaaagaacaaaactatcaacagaataaacagataacctacagaatgggagaaaatatttgcaaactatgcatctgacaaaggtctaatatccattatctataagaaacttaaacaagtgtatataagagaaaaacaaccccattaaaaagtgggcaaaggacatgaatggacacttctcaaaagaagacatacatgcagccaacaggcatatgaaaaaagatcaatatcattgatcattagagaaatataatcaaaaccacaatgagataacatctcacaccagttagaatggctattactaaaaagtcaacaaataacagatgctggcaatgttgcaaagacaagggaacacttatacactattggtgggagtgtaaactagttcaaccgttgtggaaagcagtatggcgattcctcaaagagctaaaaacagaactagcatttccctcatcctcaaggagctaaaaccagaactaccattccacccagcaatcccattactgggaatcccattactggaggaatacaaatcattctaccataaagacacatgcatgtgaatgttcattacagcacaattcacgatagcaaagacatggaatcaacctaaatgcccaccaactacagactggataaagaaaatgtggtacacatacaccattaaatgctatacagccatcaaaaaggacaagatcatgtcttttaggggaacatgaatagagatggaggctatcattcttaggaaactaacacaagaacagaaaaccaaataccccatgttctcattcataagtgggagctaaatgatgagcactcatgaacaccaacaagggaataatagattctggggtgtaattgaaggtggagtgggggatgagggagaggaacagaagaaacaacaattgcctacttggcttaatatctgggtgatgaaataatctgtacaacaaacccccatgacataagtttacctatgcaacaaagcttcacatgtatccccccaacctaaaattaaagttaaaaaaaacttggtgtagcaatgtagtgtgatagttcatttatttattcaacaattatttatggagagtctaccatgttccatgacttgttctggccactgtcaatgaaacaaataaagaaaataaaatacaaaattgatgtcctcatggagcttaaattctagtggaaatagagtatgaacaataaacaaacatataagtaatttttaaagggatggtacataccatgaagaaaaaggaatcagttatggaaaatagatagttaaaatggagcatactactttatatagcatagccaaagaaggcctccttgaaacgcatttgagaataaatctgaatgacataattgggccaggtgcatgtgttgaggaagtatataagaggcagagagaagatcaagtgcaaggacaccaagtcagaccaagctcaggatatctgacttatgaccaggtggtgagcatatttgaggcaaagtctgtagctgaggaagagagctgtagcaaagatgatcattcaccacgataactgtgcctaaaccacaataagccttgcagaccatgtgaagtcagtggagggttctgagaaaggggagaacatgactttactaaggttttaatagaataatggctctggagttacacttggaagcttagctcccaaatgcaaaatagggataggcatgcctattctcctaagaatgttggaaaagttaaacgagatactccctagaaagttctcagcatgtaataagctttaccaatataagcagttactactgtggttgcaatggttagtcataataatttgcttccagggaacacaggagatataatctgaggtaccaaaagacaaaattagataggacagaaatttatcattatcttgaatctatttatcttaaatctcaagggaagaaacaaacataaagaaaaaagaaaataatggaaagtaaagatgcatcatgtttcttaaaattaacataatttccttggccaggtgtggtggctcacacgtgtaatcccagcactttgggagttcgaggtgggcggatcacaaggtcaggagttcgagaccagcctggccaatatggtgaaaccccatctctactaaaaatacaaaaaattagccaggcgtggtggcaagcacctgtagtcccagctacttgggaggctgaggcaggagaatcacttgaacccaggaggcagaggttgcaatgagccgagattgcaccactgcactccagcctgggcaacagagtgagaaaccagaaataaatgggtaatcccagctactcaggtactcaggaaggctgaggcaggagaattgtttgaacccgggaggcagaggttgttgtgagccaagattgcaccactgcactccagcctgggcaacaagagcaaaactcggtctcaaaaaaaaaaaaaaagaaaagataatttccttgatatttatattcctagaggatatttagcagggcatgttaataatagtggggcctatgtaatttgcatgttgggcttcaaggactgaaatactccatacttgaaaccaggtatcattttcacaaaacttcagaaaacactgtttgaggaaggtgaattggtggcatataatgttagagaacagactttctgataccatggcctacataaactcttcctaaaccattttggccctatgacttatttattacccctgccaaagtcacctactttaattttctacatacgttcctgctttttagatgcctatttttcaaactatatttctctaattctctcaaaaaataatatatcctccaattcacctcaattaggcagcattttcaattttcaatagctggctccaatttctaattacaccaataactccttcacctcgaggcctttgtaattctctcacttcagaacatttagtgtttatacgcctaccttacaagaaaagcgatcaggggtcacccttccaaaaagagtcagtgccagggcttgtcacagtaatgggctctgaagtcgccaatgcaggttttgccaatgacctgctgagtgaccttgggcaagctgcccaacctctctgggctgtgctttaaaaatgctgattgacctcacaaggttgctgggaggaattactactaatcaacctgattgtgaaacatttagtcaatatagagtactttataaatatttactaatatacaatgagctcactgcatctaagagccaggagatttgcataaccacagaaaactctgtctggaccccacaatagcagtcaacattgtgcctgaaatggttttttaaatcttatatattatcagcattctgggatgatttcggttttttatcctaagtgaggagaatgaactagatcagggaagctttagaagtcacttacaagtcaaagaaaacaatgatctagtccattaaagtggcataattatatgcagaaaacaaattattatgacattcataataaagtgtgtgtacaactgagcttatcactcaagaaaccaagtgaactaaggacaatatatgacagacactgttttggttactttggatacaatactcaataaaacaagcaaggatcctactcttcaagagcctgcattttagcataagagacaatcaatccaaccaatctgactgttgacattttcttgtttacatatgtactcagatgaaaacaaaactgtgttgcagtaaaaagtgacagtactttacatttgatgaccttggaaaacctctcctagcagatgacataagctgggaggcacatggctgtgcactggaaacagaacaaactacaagtgcaaatgcctttaagatgtattagaggaaccacaagacagtcatatgcttatagttcagacggtgatgactagaaagaggcaggcagttgctagatcacgtatggcctttattggagtacaggataagacatttggattttattatgtgtaaagtaagaaatcatatgagggatttcagcaaagacatatcatgaactgacaacatttttgtgttttttctgcttgttttgctttgtttttattttttaatgtattattttatttaaatagcttttggggtaaaagtgatttttggttgcatggatgaattatatagcggtgaattctgagattttagtgcacccatcacctgggtagtgtacatcgtacccaatacgtagttttttatcccacatcccccttccactctcctcctcctgagtctccagagtccattttatcactctgtatgtctttgcttactcatagctcagctcccacttctaagtgagaacaaacggtatttgattttccattcctgagttacttcacttagaataatggcttcaagctctattcaagttgccacaaaagatattgtttccttcctttttatggctgaatagtatcccaggatgtatatataccacgttttctttatccattcgttggtcagtgggcacttatgttggttccatgtctttgcaattgtgaattgagctgcaataaacatacatgttcaggtatcttgttcatataatgacttattttcccttgggtagatactcagtagtgggattgctggattgaatggtagatttactctcagttctttaaggaatctccatactgttttccatagaggttgtacaaatttacattcccaccagcagtgtataagcgttcccctttcaccatattcatactaacatctattgttttttgactttttaataatggccattgttgcaggagtaaggtgttatcttaccatggctgtaatttgcatttccctggtgatattgagcattttttcatgtttattagctatttgtatatcttcttttgagaaatgtctgttcatgtcatttgcccactttttgatggtattatttctgacaacatttttgagggataattttggctgctgaataaaatacagagtgacagaagtagaaaaagtagggaggccagttaagtgacactgatggcttggactagggacttatgctaggagtcatttctgggctttattttttcagttaggagtataggctatgatcagttatcatttgcctcaaaatatagtcatttataattattttgatttataaatcaaaataatttctatttattatttatattttctagttatgacttttaatatttcttcaatttaagctcttcttcagcataattctgattcagtgcctgaaccttccttttcacttagaaccaggcaattgctgaagcattctggttaaagatacactgtaaggaatgcagcttctctgacattgagggcgcggtttttataatcaacatgaataattcagcagtgcattatttgtgctttattattgtttgcttcaacttgaactgtagttagaagttatgaactttttttttaatcagcagaagctcatccatcactctgcatcccttgcatctaccaggttataaaattcactatttatagcaacaattgcgatgtgaaatgagaatcagtattttgttcctctgatacctaaccttaggtcaagcacaggatctagagatggatttttacaggaagtgaaatgaaagcacactgctggagattaatgccagtctggttgctctagggaatgccctctctggctgcttcccagaagaaaaatggtaagtaatgtggattgtatgtcaaatctacacagtgggtggcagtggaatgacggacaggatgcccaagtggtctggcatcagagtccatgagcctaattttctcaaaatgagtgatgatctcctaaaatcctgttcagagattgcttgggaaagaagtctccaggactcattacttaattcgttcagtcttcagctctttattatatcatttatgttgttagctctgctctaaacttctttcccatgtcacaatataacttctcgtgtctcttgcaaatactaccaacatgaatagccactttaatcagtccttctcttctgataactgaagagggggcattttcatgtcattaagaggttttttcagagtaagcttctggaggacaaagactgtgcctgtactgtttcctttgtaaagtgcctagcataaagtctttactaattagacatttacctaatgattctgataattatgaagctaatgagaatcactggttatttttatacctctgaaaacatttcaactcttttgtgctttaatgtctgaaaatctttagggagaacttttcttttgccacagcttgatttttctacaaattatgaacaatacaaaatcttctcaaaaattcagggatcaaactcaggctggttaatgggctgtaagagaaaaatgctagcatcagtctacttttgaacaagtagaactctattcaaagaataaagtgggaatgggcacactagctcatgcctgtattcctagcagtttgggaggtcgagcagggaggattgcttgaggctaggagtttcagaccagcctgcacaacatagaaagaccctgtttctacaaaaaaaaaaattagttgtgcatggtggtgcaatgcctgtagttccagtttctcagtgagttatgattgtgtcactgcactccaatcagggtgacagaccgagtccatctcaaaacagaacaaaacaaaaaactgaatataggcccagcaaaaacatgggtaatgtttggtgacaggtgggaaataaaataaatatttgacctacgtatctaggatttgtgggattcgaattctagattagaatctgggaatatgccggtcctgacagaatccagtccctcggggaagccacactcagtgtacagcttcagtgaggaattactcctacagatgaatcacctttgaaatgcagaaccgtattctggttctgtggtgcagagaagagaggcaatgggaggagacatgccacaaaaaagcaggcagattcttccataatacctggcagggtattcttacagacatagtgtcccacttttcagagggtggaaacaactctcagagtagtaaggagggttccaaatgtcagtttgtctgactccaaagtccttagtcataatctctacccgatactatctctctaacatactatccaagagtgaattgaatattgctggtttctctactcctactcctagtctatgaatgtccccatggtataaatggccaggtcataccatacatgacttcaggtctctgtttctggcaaggtagtaaatttttatgagcggaccaagagcagacagggctttttttttttttttaagtccagatactacaaaattccctcaccttgccactgtttctcagctggggtaccactgtcttctgggggactccttgtgggaggttataaacttgtcacaataattcgggatatacatactgcagggggcctgggaatatgctatgttctgaatgtttgtgttcaccctaaaattcatatgttgaaacctaattaccaatacaatggtattaggagctggagaccttggggcggtgattaggttataagggcagagacctcattactgggattaacacccttattaaggggctgccttgcccctttctgccatgtgaggatatcatctatgaaccccataaagagcctttgccagacaccaaatctgccagtgccttgatcttaaacttcccagcctccaaaactgagaaaaaaatttgttttttataaactacctagtatatatatatatatatatatatatatattttatagcagcctgaatggactaagacaggaagttgatgtcatcacacaaaatttttatatgtccctctgggtttttgtgtaattttgtgtaaaatttatatgtaattttacatataaaaatttctaggttttttgcattttttacatatactaatgtttacagaatgtgactcccatgtaagtgaggaaatactgtattcttttttaaaaaatttccctgggcgcaatgactcgtacctgtaatcccagcactttgggaagctgaggctggcgaatcatgaggtcaggagattgagaccatcctggctaacacggtgaaacaccgtctctactaaaaatacaaaaaaaaagtagccggacatggtggtgggcgcctgtagtcccagctactcggggggctgaggcaggagaatggcgtgaacccgggaggcagagcttgcagtgagccaagatggcaccactgcactccagcctgggcgacagagtgagactccatcaaaaaaaaaaaaaaaattcattgataacttaccaagagtgagcaatggtgagcatgccgtttaagaaagtcacataactgatgaccacactgctcacggaacttgccaaccctactcacttgtatcagtcttcacagctcttctgacaactttattacttttggcagtgtaatgtctaaacactcacatactaaaatacatttttaatccattcagttattatatattacactctttttatctctacattgtattacagttaggggattatttagttatttttaaccacatgtgtaggtgagtgtaagtaggcagaattttccctcctcctctcctaaagatgttcttccctaatgaataggttagatgacatgacaaaagggactttgtagatgtaagtgtggttactgatcagttgtccttaaaatcaggagattatcctggattatccaggccgacctgatataatctcatgtgctcctaaaggcagaagaaaaagagagatttaaagtgtgagaaggacagcccctgccattgctgaagatggagagggccaagtgaggagagctgtgggtggtgtgaaggagcagagaacaagccttagctgtcagccagcaaaggcacagtgaactcagacctacagccttaggacctggatgtgccaataacctgaatcagcacagaagagaatgcctccccagagcccccagatgggagtccagccagctgataccttaacatcagccttgtgaaaccctaagcagtgagcaagctgagctcatctggacttctgatctacagaattgtgtgaggtaatatatggatacacttttaagatgctaaatttatggtaatttgttaggaagcaatagaaagctaatgtagtttcatgtgagatattagttctgctaaagctaataacgacagcacaaggtggttggtggctaaggtgcctggaacgcaaagtgttcacagtatcattatttggaacctgggacaggtattgatcaggcttcaataatagttccaaatgaagtctttaggtatgagagttccatttgacttgttgaataagcatgctctgtccttcctgatagtcaaaggtacaaaaagaattgttgcacttcagtcttattacatttaaagatactatgaaataaagactagctttggtgctaaaaaactataaaatcatcttttttgtgttaaaagaaaaaatacctatgaacatatttaggaaaacaaaatttttcagttgaagagttcctaaatatgtcactgaagggcattaaagggccaattttctaaaggagagtctgtctggcatttatgaagtggggagaaggatacagtctgttaaagattcagattcatgggtttctttcccaaagcttctaaaccaacaggtcttggaagtgctcagaaatctatagtctaataagcttcctagaattagtacaatctactttgagaaaaggtttaggtaagggaattatatgaagagtgtttgaaactccagaggataaacaaataggctaaaaataacctaacaaacaatgaagtagaagagaaatggaagaagagtatcagtataactctttgtgcaaactcagctactaccctaagaaacaagcagtaggccatttcgaaagcagaataagccgggcacggtggctcacgcctgtaatcccagcactttgggaggccgaggcgggcggatcacaaggtcaggagatggagaccatcctggctaacatggtgaaaccccatctctactaaaaatacaaaaaaaattagctgggtgtggtggcaggcgcctgtagtcccagctacttgggagaatggcgtgaacccaggaggtggagctttcagtgagctgagatcacgtcactacactccagcctgggcaacagagcaagactctgtctcaaaaaaaaaaaaaaaaaaaaaagaagcagaataaatctcctcaaaggacatgacaaagagcaatgactttagaacagagaggttatgcggtccagtaaaatgactttgggctttagggacagctagaccttcattaacatccttactgattcactcacaaagtcactacaggaattttctccatctttttaagttttagtgtcttcctctgcaaaataggaacagcagtgcctaatccttaagtaagtgttgaagattaaaataactatcgtcattttggcaaactgtagctatttaataaatacctattcttttgtctgctctctgttagaaacaaaagctccaaaggtgacaaatatattccaaattgactaatcccactcctggtctttaaccttttcagagaaaaaagcttgcatcccattattttttaaaggccagaaaaggaaattcattaacatctcttagtcatttgttccagtaacatcatttataccagaaatgccttcttcaaatcccacctaataaaactggaacctattatctatctacaacatgtactcatgaagtagagaagaaattaaaatgagacagctaatgtcactagagaccaacgggcttaacagcaagagctaagaagattcaaatttgttgccaccttactaagccaccatttttagaatagatttcttacccgatatcctatttatcccctgtgaattggtaataattatggtaacaatccccctttgatatgcttgtattcattcaaccaacatgtactgaacattctattgtatgccataggccctgcaaaatactgtgggcacagaaatgaatagaagttggttggttgctccctaggatctctgagggcaagcttggctaaagtgaaatctaagttactacctctttcagatgctccacggaggcaataaatacctaagttctctgtgtctggatttagtacagttgcttctgagttattatttgtcattcccagcttcacccaagatacctggagaatgaactgcaattcccctggttccaccattatgctgtgaatctgagcatactattgggaatatggtctaccagaggtatccaatcttttgacttccctaggccatattggacgaagaagaattgtcttgggccacacataaaatacactaacattaatgatagctgatgagcttaaaaaaaaaaaatcaccaaaaaagtctcataatgttttaagaaagtttatagatttgtgttgggatgcattcaaagccattctggactgtgagttgggcaagcttggtctaggtcaacatttggcaaacttttttctgtaaaggttcgggcactacatattcttggctttgtgggtcatagagtctcatttgcaatttttcaactctcccattagagcatggacaatatgtaaacagataggtgcagctgtgttccaataaaactttatttataatcaggtggtaggcagaatttggctgttgttgaccctagtctagatactttaggctaaaattcctagttgctgactttttagctttttaacctgagattacacacgcacactcacactcacacacacacatacacacacaatctatttgtgtggaggcggggacaaaaacacaaaaacaaaaccaaaacagtggttttccttacaaagggattcactagagaattttaataagaatgagattaaccatgaattacattggatggagacgcagcacaggcttggatttggggctctgcacttgacaacctcctgatgattgttgaggtggaacactgaatgactccatttcaaaaacaaacacaaaaccccagcaaaactttcatagaatcaggttccattctgatcacactgaatgaccatccccacatacacattatataacatttcgactacaaaagccgtatgattgcagaaatgattgttgaaagacctagaagaggttctacagaaggtgtcccagcatctttggagatatccatccagtatgttttcctcaccatttgtagaaagccactggcatttcagagtcagatggttttcaatttgatttgattttagaagacccacttgtagccgacctgagatacacgtatgaccaacataagcatgttataggccttcaaagtgcttctgaatgacgggtgaggtttataagtttagcatatgttgtcaggaatgttaataaaatcttcatagattttttcttttacccttcgatcttgcagattctacgccatgctcaaagactgaatgggggccataggagctaaagtgcaacatcatttaaaaatataattagcaaatgtatttttttttttttttgagacggagtcttgctctatcacccaggctggagtgcagtggcacgatctcggctcactgcaagctccgcctcctgagttcacgctattctcccgcctcagcctcccgcatagctgagactacaggtgcctgccacctggctaattttattgttgtatttttagtagagacggggtttcaccatgttagccaggatggtctcgatctcctgacctcgtgatccacccgcctcagcctcccagagtggtaggattacaggcgtgagccaccacgcccggccttcaaatctattaaccaatggtcttggttgtatatctattgccagctctactcatttctttgacttaagcttctctgactcaccagggaaaagaaaacgatgatgtttctgatcttgcacaggtaagttgacctttcatacagtgtcacagcaggaagaacctggcttgttcactatttttatatgttggcatctgcagtccggtacagtcttgctcaaaattcataatacacccatagctagagttctgagccaatagattgttattttttttgctgagaacataagtcatttctcaagccttaatatatatctacaaccttgcttcctctccctaattctgtaaactacttagcatctgggaaagctgtaaaaacttactctgtcttctcttatttcctcttttcctctctccttctttctttctctcattgtaactatattcatggcactcccgcaatgttctgtgagaactaaggctcttggattccactgatatgaaaatttaagcattaaattcctttttacaagattttgaatagtctagccacagcctattgtggaaaaaacaacttcctctcaaatagagtgctgagataacgtaagattatctaagctataaccacctttctctggaagcatcaaagattgtcttttgtcttatattctgggaaagctttcccactcagcaaatgaggcaccttaaccttcacattctattttttttttcttttaaatttatggacaccatttagggagatttcaattcccattaataatatgtgcaattgatctacatttaagagaatttaatcatgtcttggtgacaaatttagcttaaagcagagcttcacttaggacttccaagtaaatttccattgaaaaggtcaatttctaacatttgtcagttaaagcccataccagacaaattaaattctcctccacttgtctgctgcgtgaacactttcaatgctgaatatcaccagcggttgtcaattaggaaaactgccaccctgcccaaaaaaaatcataattgagaagtttttaaaagaagacttgaatgtttatccaatagttagaattttttttcatactaaaaagtgatctatctcatagtggcaatgaaaaaacaaaataaaacactgtcttactggattttgagtaaaatcaattcaatggtataagtatgtgaacatctattactaggaaagaagtcagggcagggcctaaacttttactgaagcttgagtttcactgggatacaaaagcacctgagcaattagaaattaacatgtaatcatcaaggataaagactgataaaatcatggatcccttgttatactgaagacagtgtgtgattttggatagtagaaaatctatgttgtttagaatttctgtggaaggctttacaaaacaagaaggatattgtaaatagccaatttagacagataaatagaggctaagtgctacaataatcatataattttttcttcttgcttctctgtattttctaattttcaactgtatgtatgattttttttagaaatataataaagtttttaaggagaaaattggggggggggaacttgaagaaaggggaaagaaaaaattagttttcaatttcctctagtcagcctcagatcaaatagaactggatgttctggtttctctcctttttggatctcaattattgaatgcttcataatttagtctgaagaaaagaattcatggccaaacatctaaaaatgatttttgcccatgaggtcagcagcaaaggaaagagatttggcaggtcttacaagaactcttctttcattgttgcaggaaacgtgaacaactaacagggctatctggaggacagtgaaggaacaggcagcctcagaataggggaagcaaggatgctcaatgtatgatttacatgcgtatcttctaatatagtgtaagaaaaggtaatggtagccatgtgatattgtttggctgtgtccccccccaaatctcatcttgaattgtagctcctataattcccatgtcttatgggagggaccaggtggaagataattaaatcacgggaatggtttcccccatactgctctcatggtagtgaataagtctcacgagaactgatggctttataaggggaaatgccttttgcttggctctcattccctttttgcctgtcaccacataagacgtgcctttcaccttcccccatgattgtgaggcccctctagccatgtgcaactgtgagtccattaaacctctttcttggccaggtgcagtggctcactcctgtaatcccagcactttgggaggccaaggtgagcggatcacctgaggtcaggagttccagaccagcctggccaacatggtgaaaccccatttctactaaaagtacaaaaattagcctggcatggtagcaggcacctgtaatcccagctactcaggaggctgaggcaggagaagcacttgaacccaggaggtggaggctgctgtgagccaagatcacaccactgcactacagcctgggtgacaagagtgagactctgtttcaaaacaacaacaacaacaacaacaaaacccaaaaccctctttctctgtattgattacccagtctcaagtatgtgtttatcagcaacataaaaatggactaatacaccatggtggattattttctacattattttcctggatttcttccagaaattagtaattcttagtaattcttagaatcaaacatcacacacacacacactctctgttatcttgggttgagtgacaacactaactaagctgtcccaagattatagaggaggctgtcttttccaagtaccctgtgattactatcgatctgttcagctcattgcaactcaaccttaccaggctggtcaggaaagaaggaagaaggatggatgttattaaagatcctgaatacctactctgcaggtatcattcattagaagtaaactaaatgtaccaacattcacacatacagaaaagctatgcagcagatccattctctttctagaatccagaccctataatgccataaagctcagacagatttaagtggaagtttctactgtgaaagtgtaacatggaagttcaaatgtattagacgatacaaataactgagcaaaggaaaggctagagtagttgtcttcagcaaccagcagttatttattaagctatcatgtgcccaggactatgccaggcactaagcagagaatgtttagaaaaagaagaccagggacctagagactgtgaccttgaaaatataatggtcttcataaatgagagttgatggcttctgaaacagagtagaaatatcaattacaacaagtcttaccaacagattcataaacaccaacagagtaccagtgaaagcacacatcagtcacatgagacagtattaatgtattatcactaattaatattaatatattgtttaacaactggccataattgtgctttttcaatacatgtaataacattcaacaaattgttaaaactaagcaactgttgatacattaaaatgaaaatgacatttaaaatatgttaatgaatattattttgaaacaatatcactatttgaacttagcaataattcacatctttacagtattttgggttaaaaaatagaaatcaagatggcaaaatcatgcctgacattcagtaattttagatggattagagagttatcagaaaatgaaaaatgttattactttggtatagagactataagttcaaatataacctcaggaggctgaggcaggagaatcacttgaacccaggaggcagaggttgcagtgagcggagatcacgccactctactccagcctacacgatggagcaagactccatctcaaaaataaataaataaatataacctcctaataaaaaagcatatataaagtgcttagaaaatagcctttcaataagtggtaattattagcagtaagacaaataattagcttaaaacatactcctgcactgacagttacagaatcactcttaaaaggatctagtattgaagactttggaaatttgctttcttaagctacattctgtaatgtttacatgactattattttttcattacaaatacattgttttctaacctgtgggcaacttattgatatacacagtattctgtattctttctgttgcatacagatacactctaactgaagatggagtgactacgtagacaaagctgcaaactgcatgctcacctgaacaggttactcttccctctatcattgacttattatgtaacatgaagcaaattccaaattcccaactccttgggccttagtcttgccaactataaatggcgacagtactggctcctctctgcaatccatggtgtcatacggataagtgaaatagaatctgagaacgttctttgggtttttatagaaaaatatggaacacaaactattcttccattcttcagaagctgatttgaggtaatagtttatagaataaatggaaaagaaaaaaaagtaaaatactattggcccaatacagaagttaagtctcaggccttctaacttcatagtctccttataagatcaaactgactgaggctgctcaacaattggaaggtatttggtgctggtgcctgtacattaaggaggttcgtgcctttaacatttttttcatgatagaaacagcactggaaaagaagaaaatatcaagactatcatcaaaataagcaaaagaaccaagacggccctatttaccataaaagtagggtcagtatttagctaagtacctggaaaccatagatgaccaataaatatttcttgaatgaaagttttctatcctggttttactagtgggaaatcaattagccttggttacattacataaaatgagggtagtaataacgtgccttgttggcttcacaggtttctattccgtgaccaatttaagtgtcacttcgataaccatctcaaatggaaataacctactctccaactggaatgaatatcctatttgcatgtcaaaagataaatataaccaacagtgcaaagcatgaaatggtatcttatatcctcagattgtaagctggtaagagtaggagaatctatgtcctagaccttgctccaaacattgtgccagccactgcaggaatggaacggagtttacgctggataaactaattaaccacagatgtgaaagcatctgtaaaatttgaaagtatttaaaatcacaaggtgcggttttagaaaggtttatgtgacacaaaaaactactgggaataaagatgtgaaaaacatcaaggtcattccaataaacgctttttttcaataggaggtaaaattttttgtagaaagaatacttgtctttactcaaaagtattcagaaattagaaacaattttctacaggttcacagaaatacggggaaaggcaagttgttactttttgagatactaggttaagcatcctcttctctggttccccaggcagccaaaagcttggcagaaagctcaatctccttgcctcaagacacttagtgccgtaatggacatacaacctagccaatgcccctgccaactctcttttcagcacagcaccaaggaaccaagaaaaacagacagcaattgtagggccttaccaccccaaatgtgctccactgaccagcaacaatggcgtcacctgggagctcattagaagtatagactctcacaccatacaccatccataacaaaagagagccccaggtaatttgtgtgtctattaaggtataaaaagcacttcccggccaggcacggtggctcatgcctgtaatcccagcactttgggaggccgaggtgggcagatcacaaggtcaggagatcaagagcaacctggctgacacaggtgaaaccccgtctctactaaacatacaaaaaaattagccgggcacagtggctcacacctgtaatcccagcactttgggaggccaaggcaggcagatcaccaggtcaggagatcaagaccatccttgctaacacggtaaaaccctgtctctactaaaagtacaaataaattggtcgggcggtagtcccagctactcgggaggctgaggcagcagaatagcgtgaacccgggaggcggagcttgcagtgagccgagatcgcgccactgtactccagcctgggtgacagagtgagactacgtctcaaataaaaaaaaaaaaaaaaaaaaaaagcacttccctagacctagcttgatattaggacaccctgctcttctgatgactttacactactatttctcaattacactactatttctcaaagtgcagcaggcaatggaacaacctaagggtaaattatctggggtttttgtaaaaatacagacttctgggttctaccacaaacatagtaaagttaccgggatggcaagcagaagtctgcattttaaataatcactcaaagtgattctgatgcacaattaattttatgcactattcttccttgttgactgaaaacccttggctatttccctcccatttccctttctcactgggaactctgacatttcaggttgtctttctctccctctccccactcaccatttacaaagattgaacctttttttctatctctaaataatctagggattgttttcctctaataaaatggctacactcttgattaaggaatgtgataagactgccatcaattaccttaattgatctgacaacctgattatacctagaaaggggaaaatttcctcagtggagccttattaaaaaggagaaaaaaaaacaaaggtctatataattaaaatgtgatcgctagcgatgagtatgtaaaatcagccctgagaggcattagtgatgggaaaacttttctaaatgacatcttaggaagacaaaggaacagaaactggtcaaataaatcagtgggctactaggggagaatgctgaatagaaacacaagggactcgtctcaattcttaagttaccagaagttttgaaattaacaaatccactcgtggcttacgatgtagagagccctaacattggccctgtttgtacctctatgaaccaaagtggaatgtcagttactggcaccatttgtggttttacatttatatacatacatttttttttttttaactgggaaatcatgctaaaagtaaaagcttgagaccacatctcaataggaattgaataaataatcctatgaagcagagttcagagcatcgattctactttatagtaaccatgacagctccagcaaaaagagcagcaaacaacatgtgttcctgattcaaggataattcctctagtagtatttatgatacattttcttctctgactcactcttagtggaacatatcttctgaatttatcccctacttgagtaacccccaggccttcaggaacagtaaagcaacatggttcccgtattactttacataacaaaaatatctaggtcctaagagtgctaagaaacagaatattattaattaggatgaactgtcacactggagtacttgatgaaattaatcaagctgatgattggtctggaggggataggaagctgtttttatagtgcacctgtaaattgtgctaataaccggtggccccttagaaatctgaagaaaaagtatttttagatgaacaacaagttagcaaaaagttgatagagtgatcagaatcaatgaaaataccccttgtacagtgagtattgagtaggtatcaaatatatgaatgaatggacagatttgagtttcctgttctcttgacctatgtcaagacaacaaagtaatcagaagtttcaatgggaattctttttttttttttgagaaaagaccttgctctgttgccctggctgaagtgcagtggcatcaccatagctcactataacctcgaattcctgggctcaagtgatcctcccactttggccttccaagtcactgagattacaggcatgaaccacggcaccctgccagggatcttctttaaactgagtataatgatcctctttgacaattacacagaataaagattaaaaaagaccaaaaggaatcagcatcaaagaagatttttgtcttaatttagggcttcaactaaaccaatccatttttagtttgataaagacatacaggagaattaacaggctgtagttttgacaatctactcccatgcctaaatcacttaagaaatgtactgttctttcatttcgtgtgagggtccagggctggggagcaggaggtaaaccattccttcttctaccacagcgttctcaattgggtaagcatcaaaattgccttaattctgaccaattcactccaaatgtaacattctatgccagactacatttgcacgtgaccctaaatatgcttcacacaaagccttctccatgtctcagagcaaaggttcctggcattttataacctacatgagtttgctactaggctgatctgcagatgtgaaattgaatgaaatggaccgagatttcccttgaagccaaatcaaatgggaacacgtgtcaacaagtcaccaacactctttggtgaccctagagttaaacaacggttcaaataggattgcaactgcaatccacttgtcttattcgtaaacaaccttttattctaagtcacctggagtttgacttagtttaaacagatgtggttatttacctacttcaaatagtctctggacaatgccttccatcacagcatattaactggaaagctcagcgactgtgtaatttttatgctccacagaacacctagcacatttcactcttctgggtaggcacttaccaaacttttttcacagttcaaagctttaaatttgaataacaaagttgtacatacatatatgttgggactttatcaagacccatgatttatccacccatttattcattcatttatacattcattctacttatttcacaatttttcatgaagtcttctttaggcaagatgtaaatataaatgaggatagttcaaccctgccagagttcatagtgtgtagtattactggccaaataaagaagtcaagtctccagccctctaacttctacatgtctccagataaattaaactccatttaccaaaataggttatctaagaactgcacatttcaaatgaaaaattttaactgtattttttatagtgtctaaaactcactcaataaaatcacagaaaaaaaagaggcatttggaaagcccttttttttttttttttgagatagagttttgctttttttgcccagactggagtgcaatggcatgatctcaagtcactgccacctccgcctcccaggttcaagctattctcctgcctcagcctcccgagtagctggggttacatgtgcccgccaccacgcccagctagttttttgtattttttttttttagtagagacagggtttcaccatgttggccaggctggtctcgaactcctgacctcaggtgatccacccgcctcagcctcccaaagtgctgggaatacaggcgtgagccaccgtggccagccttgaaaacttttatcaattgccattcccctatcatcacccaagcatagggcttttggtcaccttcaataaataccttcaaaaataataatggatgaagccaacaaaaggaatgagaaacatttgttttgatctaaaacatttagtttagctcagattttataacaacacatacatttaactatatttattttttattcttttttccttattagcctataagctctctgagggcaggggctatgtacttctcataattcatgtattatctgcacctagcacaatgcctggcatatattacatgcaataattatgaaataaataagttaatgatgaaataaatcaatgcggtataattttacacaccgaaaattataaacatctctaaacagctttcaaattaaaacatgatgttgccacatgttgcatgcaaaaattattagaaggttactgcagatcatttcagtgcatgaggaaaggtaatttcttttttcttttgtagaagattcacaggaaaaaaatgcaagtggaaaaaaataggagaaagagtggagttcagctcaaatgacaaactaaacatttttattcaatacttcatagccttcaaaaatggataattatccctccagctcttcgggccagcagcatgaggttgaatacatcatcagttctgatattaaaacatgagtttgcaagtaaacaggaagtttatcttataaaatggaagctttttatttgcacagaagtttttcattaataacagagatggactttcaactacttactacagctgtggctctctccctgacatatggagcttcttaaaagaaaaaaaatacaaattaggagaatttttcagcaaattcaattccttttctctcccagaggggtgggtggaagcagcaggtggcaaattcgtttttatctaataacatttgatcatgtgacatattttatttccacagttgatgtaacttaatgaacagcaaattgggaaaatccgtcagcatgtaggaagttagtggggcatgtgtgcatgtgtgtgtgtgtgtgcgcgcgcgcacgtgtgcgtgtgtgtgtgtgtgtgtgtgtgtgtgtgtgtgtgtgtagggagaatagaaaggcctctgtggtgcagataaggggaaaaggttgctgttacatgttctgggtagaaaacttttttttctttttttaaagacattagttccaatccatgttgacagcagtctaaaggaattataagggctaaacagaccatctttattaaatgagatctggtgatctcaggcaggtcctaaaagaagtagatatacaaaaataaaccccaaggctgacagcagaaatgctggagacctccatggtagagttataagtgctgtgtggaataaactcgcatagccaatgaaggaagatgaggaactgaggaagccatcaatctgacagtttccactaagaaaagcagttgctcatgagtttcaaacaaggttatacttagttttaggtacatgtagtaccagaaaaacaggctttctaagctggtaaaataaaaaaaagacttgttattttatcacattgctgacattgccaaggatcctaaattctagaagaaagccaggagttctggctagttcagaaacagtgtaatcttgagtaaacagttttgtcacaagccttggctttctcaactgacggaatggggataatgagagtaaacacattatttggcatttgagaggattacatgagtatttttttgtaagtaccccaacatattagcttttttcatgattgatataaaccagatgtcaactgggagaattcctgatgaagaaaaccaggtaaatttggcctagtcaagctttcatactgtactcaccctacttcatctgtcagatgagtgctaagacctcacagttagatgatttcctgctcaccttcctcaagtccgttttgtgctttctctgtcccttccctttgtagcaggggttttgaaacatctggaattcctaggaaatgatatgaaacagctgtgctagaggtcctcacttaccttagaccctcattaattctatgcatgacctgtgatttttaggttttgtttaaaaggtaaaaataaattggagatgaccaggtgtggtgactcatgcctgtaatcccagcactttgggaggcttaggtgggcagatcacctgaggtcaggagttcaagaccagcctgacaaacatggtaaaacctggtctctactaaacatacaaaaattagccgggcatggtggcgtgcacctgcagtcctagctacttgggaggctgaggcaggtgaatcgcttgaacccaggaggaagaggttgcagtgagctaagattgtgctaccgcactccagcctgggagacacagtaagactctgtctcaaaaatactactactaataataaaataaattggagaggatgtggagaaactggaacacttgcataatgttggtgagactacaaaacggtacaaccactatggaaaatggtatggaggttccttaaaaaattaaaaatagaattgccatttgatccagtaatcccactcttaggtgtatgtccaaacagagtctcaaagggatatttgcatgcccacgtttatagcaacaatagccaacaatagccaacaatagcaactcaactactcactgatgaatggacaaaatgttatcatacatatacatatatgtgtacacaaacatatatatatgtgtgtgtgtgtatatatatatatgcctacatacatataatatttagccttacaaaggaagaaaattctgaaacatgttagaacatagatggaacttggcgacattatgctaagtgaaataagccagttacacaaacacaaacactgtatgattctacttacatgaggtatctaaagtagtcaaattcatagaaatgaaaagtagaggccgggtgcagtggctcatgcctgtattcctagcactttgggaggccaaggcgggtggatcacctgaagtcaggagtttgagaccagcctgaccaacatggtgaaacctcatctctactaaaaatatagaaagtagctcagtgtggtggcagatgcctgtgatcctagctactcaggaggctgaggcacgagaattgcttgaacccaggagacaggggttgcagtgagccaagattgcgccactgcactccagcctgggtgacagagtgagactttgtctcaaaaaaaaaaaaaaaaaaagaaatgaaaagtagaatagtggctcctagggattaggggtaggggagaaaagacagttacttaatggatacagagtttgaaatttacaagatgaaaatttttttaagatctgcttcaaaacaatgtgaatatatgtaacactagtgaattgtacagttagaaatggataagatggaattaagatggttaattttaggttatatgttttttacattgttttacaaaacagattaaaatgaactttgacacactagatccactctccctggaaactttccccaactaaagcaccaacccataacatattacaaatattaacactttatataactgaagctcagtgttagagttcacagggagagatgaaatgactcaaggtcacaggttcagatgttctgacacattactcactccatttccataatctatgcaccaaatactgtttttttttttttttttttgagatggagtcttgctctgtctcccaggctggagtgcagtggtgcaatctcggctcactgcaagctccacctcccgggttcacgccattctcctgcctcagcctcccgagtagctgggactacaggcgcctgccaccgcgcccggctaatttttttgtatttttttagtagagacggggtttcactgtggtcttgatctcctgacctcgtgatccgcccacctcggcctcccaaagtgctgggattacaggcatgagccacctcgcctggcctgttttgtttgttttttaaaggcagggtcttgctctgttgcccaggctggagtgcagtggtgtcatcacagttctctagactcaagcaatcctcctgcctcaacctcccaaagtgctgtgattacaggcataagccaccatacctggcccccaaaactgtttatgtgcattggtccagaaatgacaaaggtttttagaatttattgtccatgatcaatttgctgttgccttttaggatcctctatctttcagcttatccttaatgtgtgtcctacattaaaaaaaagatataccttttctattcacttctccttggcctgacatcttaatattttacaatcccatcataaaaacatcagcttttgtggttgggtttttccaacacctccataccatttccacactggaaattcacctctgggtatctgtgtgtgtacatgtatgtgtgcttgtgtatgtgactcaaaagccattattccttcccaacactcaaatttcctttcaggaaattaacctctctatcactaaaaaaaaaaatgtcatgaataggggccagaactaaaggggccaaaatccttgtccttccactatgcagagccacagagtgagactgtaaccaacgcttagtcaatggtacacgtgagctcaggactttgaactttgagaaacataagaatggaacaaacattcggtgtctaggcatttgctaaacagcatcctgacttgttaaggttcctatttttcagtcctctggtgcagccttggccactggccattccttcgctgggacccatggcgattctgtaaacatcagttatcctgcagataaattccccttcagtgaaaacagccagagtggattgttgttgctttcaactggaaaacattgcctgacgatgtttatttccacagctctttcaaaagagcaatgccgtggttgtaatctcaagctcttagggcaatgtgaaatccccttattctcctggttctatatggaaaggttttgaaactgtctccatgtttctaattccagtcttgtcattttgctcttcagatttctttaaacccatgctgatcagatactgttctgcccaatgatgtcctaaaaacatctattaaaataaacccacttacagcagagcctgctaatcaccctcccacctaattagatgtctgacagccaacatcggcaggactgctgtccttctgctgggctttctatgcaggagttttacaggtacattaggaaccagttaaccacctgtgtcataatcttcttcctctgtttactcacgaaaagagaaccatttcaaccattccgaaatgagcatggcactggaaacctcccagcatcaaacaaatggccactgtcactgatcaaaagataatttttgcgtagggggtcaggggtagctgtcagggtgcaaatctaggatacgctgctgagaagatgtaggtggtgtggctgacagcagctggagccagacttgtgggggagtggaagacacagggctgccagcctgattatatcattctccttattccctcttgggttttccttattttttcccaaagaaatagctcctaattgtaatgatcaattctgatggttctttttccattccaagccattcattgttgcctttatctttattatctccttttcccacaaacccaaaggcccatttatttatattctgtccccagctcctaagtaaaggaactcactgcctggtcttgacttctttggtcagaatagtgctgggttttggcctaatttctttctctagtttatagattaattgattttagatttacatggtccttagtggtttaccaggtggattcttactccataaatcattcatttctcaaaataatctttccaggtagtgaaggacccattccaaagtcctaccagtagaacgtggtagtgctgagaacacagaaccaagccatatttttttctgtaatagttataagccaaccctattctaacacatttgctcttcctgtcagtcacatgaacccaagtggcagccatgaagttccctctctgaattcctcactaagccctggggatttaacaatatgggtttggcaagaaaagtaaaacattctctatgtagactgagaactaaactaggcattaataggagaagagtaagggaaggaatggtggatcctaaagaaagataaataagcaacatcctgccctattacatgtcccagtcctctcccctcaaaagcgtccaactctctctccagcaccccatgtggataagctgcgggactatgaagtcagttgtctagtctgaagttctaaaaatcatccagggctgcgccatctcacttacttccttttcattccacctgtttactattacttaaatccatcctgccaccagggctttttttttttttttttttttgtccaaaatttttacagtagcctctgaactggtctctatgcttccagggctgcatttccacaaagtatcttccaaatgtccctcgaagatctttctgtgtagagtcttttaatgactcccaagggctttcaagatagattcaaaatcccttaacttccttcataagttcctggcaccagcatggatctttagattcaacaattaccacttgcccaaatgaatgcttccttccaagtatacagggttacatgtaaatagcagaataagccatgttatttcactattccatccttttgcactcttcctctctatatattatatacgtatatgtatgtgtgtatgtacatacacacacacatatttttttcctccatgagatgtccatctcttccttctctgcaaggctattacctactcctcaaacctcagaaaagaagctcaagggacatctcccttgggaccatccttcccaaaccgcacactaaataggcatattttccgtcaagaattctcatgattgctcttcctatgaattttcattacatcctgtttttgcatttgaaacagtgaacgcttaccacactgttggcttacttctctgtttgtaaaaacaaaagtatgagctacttgagttcagagcccatgtctcagccattatatccccggtacctttccctgtgtctggtaacaatgcctgtttaatagaattgaaatcaaaagctatattgcttttgattatacagtatacaatgtccacttatatcctattaatagccctactgctctctgtggcttttctctagttgcaagagtctcgctccccttcagtgattacagagtcagacagcacatgcaggtgaattaacactcactgtagcagccctcaaccaatggccaaaaagaggttatataaatacatccctcctataggataactcagaggtgtgctctacactgactcctacactttcacagtgagattaagcttcaatcatccccactggtgaatggctccagtggctccgtaacgttggctgacattccatccctaacttccccactctccaaactttattttcaggggttgtcttgcaaataaatgacttatatccaaatcctaccctcataatctgtttctggttgaactcgactaagacagtatccaatactatgtttttaagtttaaaaacaattatataactcagtgaagtaggaattcatatcatccttattacacagatgagggagctgaggcacagataggttaaaattcggtaaatttagagcatgtcattgaaaggacaatctatcataaacttgtctgcatattttggttttggtttgtgtgtgtgtgtgcttttttcccactaactttcttcttctgatctctttagcatcattaatgaaaatgctcacatatcagtggctgatggtgcccttgattcaaaaggcagccctctggagaaggattatagcccagcacctaaaatagctgagcctggcaactcagtagagtggtaaactaaacttttccctaaaataacacagagatcactcaagggagtcagcaggaacagggttgccattgtgattacccaggataggagggattaattcacaggtattagaaagcagcccaatgcaatgcacaaagcaaaagtacatttctatagttttttttattttgttttgtaatttttatgcaaaccagacatggtagaaagctacgtaagagacagaaatttatctacaacataaataatggagaggaaaacacatcaaggtgttcaactttataaaaattaaaggtatgcagttttttggttttgttttgttttgaggcagtgtctcactttgtcacccaggctggagtgcagtggcatgatctcggctcactgcagcctcaaactactgggttcaagtgatcctcctgcctcagcctcccaaagtacctgagactaaaggcatgtgccactatgcctggctaattgttttgtattttttgtagagatggggtttcaccatgttgcccaggctggtctctgactctgagctcaagtgatctgctcaccttggcctctgaaagtggtagaattacagggatgagccactgtccctggccacaaagtttaaaaaattagattttactggccgggcgaggtggctcatgcctgtaatcccagcactttgggaggccgaggtgggtggatcacgaggtcaggagatggagaccatcctggctaacacggtgaaaccctgcctttattaaatatacaaaaaaattagccaggcatggtggcgggcacctgtagtcccagctactcgggaggctgaggcaggagaatggcatgaccccaggaggtagagcttgaagtaagcagagattgcgccactgcactctagtttgggtgacagagcgagactctgtctcaaaaaaaaaaaaattagattttactattctatcacaatattagcaaatactaaaatatgataatgtacaatactcatgtaattagtaaaataggcactctggtataatatcaatgagagtataaattggtgaaatctatttgaaaatgcatttggcattttataataggtttcttgatacagaccctcaacttgacctagcaatttttaaaatagtccctaacctttagtccagtatcttccccccatggatttgccttaagaatacaactcacacccatatatacttacatacaacaaaaatttgtcttgaaaattatcaaaatattatttataatagctaattaaaaagaaatcaccacatgcccattaagacaagaaaaagaaataaatgatttaaccatacattagaatacttaaacattaaagtttgagattttgaaaactaaaaaatggcatgagaaaataatatagagagcttaaaaaatgcacggcttataatttcatatatggcatgaacttattttaaatattaataaatcaagataaaagaaaatcacatgaagagattcataggtataactggtggtggtcttatgggttacctttttatttacatgtataaaatatgcatgcatactttttatatttacatgaagttattttaaaacatgaatttgctatacttaggaattaaacctataggtggttattcctgcataacaagacaccagggattaaattaaaattactgggccagatgcagtggctcacgcctataatcccagcactttgggaggccaaggcgagtggatcacaaggtcaggagattgagatcatcctggctaacatggtgaaaccgtgcctctactaaaaatacaaaaaattatccaggtgtgatggcaggtgcctgtaatcccagctactcaggaggctgagttaggagaatcgcttgaactcaggaggtggaggttgcagtgaatggagatcacgccactgcactccatcctgtgtgacagagcaagactctgtctcaaaaataataataacaaaataattagctggtaaaacaaaataatttatgtagtgctctctttgcctaattcatcctccaaatctggagggttcatgcttcctttctccattttaatgtttccaaccataacatccaccattggagagtcttgtggttcatgggcatttgctaattctaaggattcatggactcttatgaaagcatttgtttttgcggtttccattaaaatggcagttgacaagtatacaaagcagtaaagccaaggccatacatctggtaatgaattgctttcctgactgagaaaaaagaggtttactgtgagtgccagttgtttcttgtcctctccaagagttgcagcagaacaaatgttacagaatataaatctacagtccaagacaatcctattgttacttggctctgtgttaatttccgacaccatcatctctccataatcaacaaatttgcctgaaattttgtaaattaatgaacattgtttgttttggaagatcaaactgactcagcaggactttttcagagaaaagaaaagagtgacgattttgaagggaaagcaacaagaaaccaaatgtatttttaattacctttaaattacattaataacaacattctcagtaggacaaagggatcaaattctacttactatgagattttgcattagcttgggaaaatgttttctttctgctttggttggttctgctttaggtactagtctgtagatatttgcaaatctcataatttatgtccatgcttgtatgcatgggacaaaatagttttatttgcctgtttattgtggtctctctgaaacaaatgatgggttgcatcattaccactgctttccttataatgacttagaaaaatcatccttcttccctcaatcctcacttagaatccagcaatcagaactcttatctcttgaaaaacacagctgttttgtgcttatagatgaaacagagataaattaattggcaacgcctaagtttatgaagttgctactgaaatcatagatataatccagctcctttaaatttctctccagaatactttcagtagttgatactaggaatatcctcagtatacagatctaatatcattatttatcttataggtggtcatggaatttgccaaatttagcagatttataccaaatttaaaagttagacttggtctaaatgtttatttaacaaacttttacttcgtgttttttatggtcattgaatatcttcagctctaatcaagacacataagggccttctgggaatttaccttctactggaggaaaggaaatatacatatcaatggctcagccccaaaaggggaaaaacaaaaagtgccacagagaggaatgcatgtaagtaccatgggcatctactgatggggaaaaaaatcacagctctgggtgtgtgaggattgtagaggattgttgaggagagcaagcctggtgcctaaactgagacttgggatagatcattaactgtcagggcatccagacctccatcccatactttggacaaacgcacaaagtcataaaaagatgcacagctacgtggcggagtgcagctaaactatctaagtaagattttagctaaactatgccatgtttagaaaaatcttacctaattatcccacaaatggatccaactgatagacccgttttggcccatttgtattgagatattccatctagactaagaggaaaagttggcaatgaggacttctgtactagcaatgttaatttactaacttcaagaagtcaaattacgtaattaaacacatcttaaataaaaacaatgttagaaatcaaaaatgccctacaaaaactattgaaagaggaaataataactgcaattacagactaattagaaaataatgaaaatgcaaatattgctgtcaaaaacggaatataacacaactctactgtgtagatgaatacatgtttaactttaaatactttcataataaagttaaaaagtaaatatttaattgaagaaagtagaaaaataaccacaattctaaaatagcaggaggaagcaaataaaagtaaaggcagaaaaggttgatttagagaaggaaaaataaaagaaaaataccaaattgctaaataaatccaagagttgtttcttaggaaaacataattagtatactatattaagcattaatgtatgaacctggtgaatttatttagaaaattaagttggagaaggaaaagataaatgcacaatctttaaattataaatagattcctcttttcaattccatgttgatatatttgaaaatctaggtggaataaatacatttctaagaaaaaagatattgccaaaatataataaagaaaaatttttaaatgttaccagaattgtggagcaagactataaaactattcttgtcccataattagaaaactattctttcctcctccctacattgccctgttcaagaaaagtttgtagtggatggctattttgcaagtgatttaaacatacataaatttcatttccaggtaattttctaattaaaatagttataatagaaaggaaaacatttgcaaaacaagctgagagggttagggctgtttttccaatactacatcatttggctttggtccaatctccacttctgtgagtctcaccttctccctcaataacacaagcagagggtgcatgtttacacaagtgtgcctgtatgcatttgtatgtatatcagaatgataaatgttatcgcatgtctgctaactctatcaaacattgaaacactgaattttagaattaaaaggctctaattagctttaaaacaatcccataatgtattatcagtctctctgataatctgcaaactttttgtactatctctgaggtcataactaacttaatttctatcctctcataactcaatctcatctacctcacatcaacactctttcatcctttgggaaaacttttaggtttaaccacttgtattagtccgttttcatgctgctgataaagacatacccaagactgggaagaaaaagagaaaaagaggtttttgtttgtttatttgtttgttttgagacactctgttgcccaggctggagggcactggcatgctctcggctcactgcaagctcagccgcctgggttcaagcaattctcctgcctcagcctcccaaatagctgggattacaggtgcccaccaccacgcctggctaatttttgtatttttcgaagagacaggatttgccatgttggccaggctggtcttgaactcctgacctcaggtgatctgccggcctcggcctcccaaagtgctgggattacaggtgtgagccaccgtggctggccagaaaaagaggtttaatttgacttacagttccacatgactgaggaggcctcagtcagaatcacggtgggaggtgaaaggcacttcttacacggcagcagcaagagaaaataaggaagaagcaaaagcagaaacacctaataaacccatcagatctcgcaagacttattcactatccccagaatagcacaggaaagactggcccccatgattgaattaccttcccctgggtcccttccacaacacgtgggaattctgggagatacaattccagttgggatctgggtggggacacagccaaaccatatcatgactataacttaattagaacaataacaggtgagtctgagttcagatacaaacctgagaatccagatacataaattaaatgttctgcttggattccaaagcatctgtcatcaatagagtatgggatgttcaactgtaacacccagggaaggggctgagtacttggttgaggaaatgtgccatggactaagttgctgtaatatcaaagaatcagcatccagacacaataaaggtattatagacctaaaacaatgctatttcactgtgctttttcttccaagctaacatattgacaaagattgaaaaagaatgataatactcattgctgccaagtgtgtggggaaacaggcacccaaataacttgccagtagatgcatatttagtgcaactgttctggagagtaactgtgtacatggttttgcagaatctttgcaagattttcttattatttcctagcagtgactttgctaggtcaatgggttttatcccagtattacatacagtaataacacactggaaagaaactaatgcttaataataggaattccaataaatattttatgacatacccattaaatattgtgacatattaaaataatatagattcatactgactgacatgaaaatacgattagtacacactgataggagaagaaataaaggatacagttcaaatatattgtcattaaactaactacttgtgtccatacatacagaaaaaaaggaagtatatatacctaaagattaacagtttttatctgaaggtgctaagattacagtggattctatattatttcaattattttaatattgaagtcttaaaaataagtaaatattactctgataatcagcaaattagtaaatatgttcttattttgatgacaaaaatgagtatccatgaataatgttaaaaaattatgtcacggttaggtgcggtggctcacacctgtaatcccaacactttgggaggccgaggagggtggatcacctgaagtcaggagtttgagaccagcccgaccaacatggagaaaatctgtctctaccaaaaatacaaaaattagccaggcatggtggtgcgcacctatagtcccagctacttgggaggctgaggcaggagaatcgcttgaacctaggaggtggaggttgcagtgagccgagatcacaccactgcactcaaaaaaaaaaaaaattacatcacatatacagaaactctattaatactgaaattactttcttgggagagttttattaatagccacagaccattatcctttctctgacatcttaaaagtatccatcatttgtcactcagcatatggtgccttaagttcttaatgaccatttttctgggtagagatctctctatacaggtcaggactatatgtcatttcttatatgtatgtatttatatgtccctctatggatttgaatccctggactctaaatggcagctgatatagtgtcacactcaagtattttcattttttttccctaatgttgtcgggtaacagttccacgggttatgagctgtgggcatatgccagcaccccttgtcctaacttcctaactggcatatgtcttaaatacgggttaggagtttttaccattgagttgttctaagaagtttcatgagcacaccattacgtagaatatagatgtcaaacttgaagctgatgtaacagcctatcaacactgatagtttccaggagccctccgctggatcctcttttattctaatgagcatttttgtcccttctctgggctggaatgaatgacttctgtcccctctctgggctggtgtggatgacagaactttctcggattcagccacagctgaagagagctatggctgaagctctgctcgggggaatgtgtcccctgcaaggcccaagctggatgcatcttcagtgggattcattatccattctgtccattctttcccaagagcccagcagcccttacacacagcatgccattaacaatggaggaagcctgccacagaacggcgctctttgaggcaatggaaactaccctacgtgagcaggctgcacagctccgcttttcccagtcagcctctgagcagttcattggtgacttcaagaacgaatccaatctacatctatggaagccattaaaatctgccctaggcatcttcagcctccaccacccaatttctgtttcttcagccatctttaaactgtccatttactccattatttttttttatcttcatggtacttgtatcctccctgtcttctctgctccttcagattcttgggaagaaatgtttgcctgtcttccaaggtcagctctttcttgagatgcacacctcagctaaccacacaacagccactaagcaagcagttccttgccctctccacccttctccttcactgggtgtggtatcctaggctccttgatgtttgggagagaggttctgacacgggcttttgaaaatccacagaacatatggtctttgaggactgcattcaattttctcctggctgcctggctgccttgcttgccctcaatctattgctctcatgctgaggacccttgctgatttcactagggtgaaaagaatgcatttccttttgtcacaagtcaccatcttttccttgcaaagtagctataggtatagagtggaaggagaatacaaatgacagagagagagagagagagagaatatactcaggaatagaaattgagaggtagaaatgcagactcacacccagatggttacagagagagggattctttgcccccagaccatgcatcagaccagctctgaaattcacattctcatttctctacttaacctctgcaaaacagcatatgggcatgcctttcctagttactatgcattactgtctaagtagggggtggtggtgtgtgcttatctatccagctgacagcttaaaatccctttatcccacatccttcccaagagttgtgtgcattctgtgaatgattaattttttaaattatttttggctccaacctggtttctccatctcttttacaaatcacctccagtggacctccactgtccatgaaattcgttctcctttcctcaatatctatgcacgtatacacacacacatatgcactgaccaaatgatacctatccacccaatatgattgcaggtattgctatgcatgtggttgctgatatggggggaatggttaagtctccagagcttgtcacagtggggaagaatccatgttgtatatcatggcaagaaaatgactttaaaagctatatagcaattttcactcactcttacctacatactggaatttaatagccatgcctctctgtttcagcaaggccaaataacttatctaaatatataatgcaaagcaattctattctctgtggcttctacctctaaactaatatccgattttgctctccttggcacatgcaacaagttttaaatatagttgaggtggaagaaagtagttgataactgggctctggatacaagaaggctgatttcctactgatgtgaaatttgggataatctacttaacaattctatgcctccgtctctttacattgtgtgtgtgtgtgtgtgtgtgtgtgtgtgtgagacagtatatatatatagagagtgagcgagctcacaagcgagagagagggccacattttatatagttaatgacagtatcatattatggggttgcatgaagcttaaatgagaggaaaaggtgctcatctggcacctggcgcagagttaatcctcttaaatgtttgccttagacagggggtcatacaagaggtctcatcccatcagtcactgaagaaatgtgtagtatccagacagatcattaccaatgatataagttaatataaccgtcgctcacagaaggcaaaaacagccctagtaatttgacagttgtttttcaatagcacagttttcctccactgaacatatcaaattattatctactgaacaaagatacacatacaataataatgtgaccagagcagtattgcccatccatggtccttcagtgtgctgccagcaggattctacctgatcctggaccatggcacgtgctattgttcacttttaatttttttctttaaatcaacgatatttcttagttttgttctaagataataactatgacatcataggtctaatgagccgttaatcattgcttaatgtgcataagtagcaataactaacattttaaatctgtctatccacgtttcaactatgataattacctggatttggaagcagaataataagacttgaattactatcccatctaggtcttatatatttctgatgcctgttcttgggtaaatcacttaaactctctaagctccaggtgcttcatttggaccagttcacagatctcttgtaaagatcaaggaagaaaatgcaagtcaaagtattctgtaaactgtaaagcatggtgttaattttcagtaaatgtccaagaactctttgttgcgactgatgacaccagtagattagctttcaacaacagaaaagctggcttttcaaagggaagtgaatgtccttcattcataagctccctggttgatgtgtctcactcaggatttacagcagagtgtaccaccatccggtgacacattgagattcccttctgtagtagcaggggggtcactgctggtatagctaacaccaccctcgtgtccactgaggacaacaaaacctgcaaatgtccttttcttctcctcttaaatttcatattttttttttcagtcacacagcctcagccctatcctatttatagattagctgcatgcatcagtaccagagaaccaggatcacgaactcagtattgggcagcgtagtccccacaggcgatgtcactgaccccactaaatactgtcagcacctgcagtcacagcattggcacctggcatttctcggctgatccaagaactcctgtggctttgcagagtacttacaccagtggttctcaaccctggttgtccattagattcacatggggagatttttctcaatgccaataactgggacccatcccaaaccaatttaattaggatctgttggtggaagcgggggactcaggcatcagtttatattaaaagctgctcagggactgggtgtggtggctcacgcctgtgatcccagaactttgggaggctgaggtgggtggatcacgaggtcaggagatcaagaccatcctggctaacatggagaaaccccgtctctactaaaaaatacaaaaaattagccgggtgttgtggcgggcatctgtagtcccagctactcaggaggctgagacaggagaatagcgtgaacccaagaggtggagcttacagtgagctgagatcctgccactgcactccagcctgagcgacagattgagcctccgtctcaaaaaaaaaaaacaaacaaacaaacaaacaaaaaaaggctgctcagaagtaaaggcttcttctgccactttaggttaactgtggccagacggtaaggctgcacctactgagcatggagaaaagtaagaatgaaatccaattattgtgcttagtttggccaaatcccataagtcagaataactgaacatgaaacaaaacaaaacgaagcaaaacacaatagtgcccaccccgacagtccacctgtaccgcttttttttacgagatgatccttttatttcttacatgggaagatcttgttaaagtgtgaatttctgattctcactcccaacctaaagcaatcagaatctctgtttgccagggaatttgcatttcaataggtatcccagagcacctaagcccacaaaattttcggaccaccactttctaagtgattgcattaaggatcactgtataatccttctggggttttctgccctgattgcaaaacaaaaagaaatataaaatatagattcctggttctaccccatgcatccttggtgtagtgcctgcattgctttttttgtttgtttgttttgttttgttttttaatggagtctcattctgtcgcccaggctggagtgcattggtgcaatctcagctcactgcaacctccacctcctgggttccagtgagtctcctgcctcagcctcctgagtagctgggactacaggcgcacaccaccatgcccggctaatttttgtatttttttagtagagatgggggtttcaccatattggccaggttggtctcaaactccagacctcgtgatccacccgcctcagcctcccaaagtgctgggattacaggcatgagccactgcgcccggccaggcattgctgaatttttttaaagattcatatagagttctgattaaaagccagatcgtgagcctgtgtgataatggcaatgccactggactgcaaagaaaaaaaaaaaacgcaaggcttacattgctaaagtgtcttttctttgaccaggtgtcatttcctaaacaaactcctccatgtcaattctcttcagagtgagaaaaagaaagtctctttcttgtccatttgccttttgcatacagaaagggacacaaatttagaaagtatttaaagcagtgggcgcttcgaatgttcattattcaatgccagaaccaaagcctccccaggcattattaaacacattgatgaacactgtggctggatttagagagaagaaaggtgctgctggaactgcaatacaccaattcttcatttaaatatcttgtaagtaaagacccaggaactgacttcatggattttcatgtggaggcgatagtatttacatctcaaaagcctactctacggctttctcagttatgctggctattggggattcctgaatgagcacaggatgaaatgcaacttaattctatctattaaggagacaagggtttcgtagctgggtgctgtgtatggtgaggaggttattatggcatgaacaaatgcaaactcaagccaattattgcttcaactcctgctgagcttttcagtagaactttaacgcatgcaaaatggagtactagttcttgtctcagctcataacttcacacagaaagatcatttttcctgtaaatgctgaaggcagggtgaagcccccagagcaggccactcaaatctcactcagcaggtggccattggaactgggcatctgagggacaggagcctaagaaatgtccttgagttgctacattcttttaggaggcaaaagtgaaaaataagagccacctgccactcacagagaaaagaaaatacaagttgagtcccttctgtgcttgtaggtcctccccaaaccaaaccaaaccaaatcaaccaatacacacatccagccagtgggaagatggctgtgaagttcccatctctcccaagtctgtgattgacttcaaaacactatcatcaatcatgctaataagcacttaaaaagtaaatcaaaggctattaaaacacttttgacattgagcttgcttcctcaagcaaactataaatgcccagaatttacaacatttgctgaaggaagggaggaggatgctgggttttaaaaacaaatttattagcttgtttcttatgctgttttttttctcctttctcccattgggacagtaataaactaaaactgctagatgctgttacagactgttaaattcgtagttaaggttcatatcattatccaagctattctggatttccggggggtgatttataagtatgtgcgagcaaaaagccacaaaacactgtctcttttaactaaaggggcctggggctatatgaccaacatctatacacaatgtgccaggcagtaaaataatactgtatgtcactcccctcacatgcaaaatactggacagaaccaagtaagactgtgaaataaactgagatcaatggcggccatgctctgtcattattgtgcatggtgactctggataagtcatttatcctctctggacctcaatttcaactgaaaaaggcatgaattgacctagataactttttaagtcctattccaagctacagtcctattatcgaattatccaattagctcattagccagcacaatattaatcagttacctcaggacttatacgaatgactagcgtgggaccttaattctcatctctccaaattatggcggtggaagtggtgccctctcatgctggcaaatctgatttctagccattcattcactttctcccttcaacacatgctcaacattgatcttggatttatactcccattggctccttgctcagtttccaatcagtggtgctgacagctggatgttcccatttcaagcatgtggagtaacagacacgagactgtgactggggcaagacagcatccactaacagaaggatgagtgtcaggttttcattaagcaggagcacagtggttgcttatcttcagctcagttccagacctgcatttggtaactatgcttaagtgtctcaaactgacctcaaagtcaacttttccaaacctgaacttgtgatattctcctccaaaatgggtcctgttttagagtttcttctctcagtgaatggcaccactatctgtcctgttaggcatgctaggcacctagccctcatctttgacacctctatccctttaactggttcatccccaagccctatcatttactccctgagaatttcttaaatagaaacaaaccaatgcatttctaccaataaaaccttagcttatgcattatcctttccctgtttctataatattttcctacatgatttggcagcacttcctcttcgacctttcaaaatgcatatttgcccactccttcccctcctcatcccactccactgccatcctgccaacctccctcctcctcctccctacctgtgtggtctcatttcacaccccactctcccaggcccactctactctagtcacattggagtcatttccattcctctttcttgttgtgcttcttggatccacatggcgatttcccagagaatttgatatgcatgatatatttggggaacatagtagactcacactgaaaaaaagctgaaaactgaggttgtgtggctgttttaagtgaggaagagtggcttcattacagatgtctgacttccaataatgtattgcccccttccagtttgttgcactcccagagtgttttgggacacctggaccaagtgagagcaacaaagtaggaagagcgagccataacctattttgaagggacctggctccaaattctcctccaggaggagcaatggaaacttctaggagaaagccaattgataagaaaggtgcaggaaaagattgcttgcaatgaaaggtatcctaaaaaccttgatggctctatcgagacttccttctaacctacttcacctggtcaatgtctacacacctcttgctcatcactttactgaaaaaatcttccctgtcactcttgcctaggtagaatcctctagcataggctttcataaagataaagatctgcacatcccagtacttaactctgtgaatacattattcaattaattatttttttattttagtgcattctctttcactaaaatgtaaacattctgagagctgaaatcatttctgctttcggtcactaatatgtttccaaggtctagtacatcaaaggcactcaaactatttatttaatgaatgaatgaagtggaaagttgattgatggcaatacattttttttccattatactattggctattccaggtccaattttttgtttctaattgtgtatgtgtgtgtgggggtatacacatacacacgattgtatatatgattatatattatgtatatatgtattatgtatattatatacatatataattatgtacataattatgtattatatataattatgtgtatctatgcacacgatgatatataattgtgtgcatatatatacacacacacacacacacacacacacatatgcacaattagaaatcagaaattggacctggaaaaaaaatttataaaataataaattatataaatatatatatatttccattaaagatctcttctacataaagttgcttatatcagcttcacaaagtagagggtttactttccaatttttcttttatttttttgagacagagtcccactctgtcggccaggctggagtgcagtggcacgatctcagctcactgcaacctccatctcccagactcaagcaattctcctgcttcagcctcccaagtagctgggattacaggcatgtgccaccatgaatttttgtatttttagtagagacggggtttcaccatgttggccaggctggtctcgaactcctgacctcagataatctgcccgcctcagcctcccaaagtgctgggattataggcgtgagccaccgcacccagcccactttccaatttttcttttttatcctgtcatttttcacctggccagctcgttctcagctgaagtatgatgttcttggagaggtgttcccagaccatccaatctaacaaaactcctgtataatctctctcagggcagctctaattttccattccaaatatgattaccccaatatacagcaaattttgagtttctttttttaacacttgtgtttcttgataaactctaagcttcttgaggactggcactacatctattttgctataattgtaattaatacccaaaccttgcagagttcctggtacatagttggtgctcagtaagtactgttggctgaaaaattacttccactaaatggtctatagctttggtatcctctgcatcaaggctctatatctcttgaggaaagacatgatatttttgcttgtttagtatccccgatggtactaaacccacagttagattaggctggggattattaaccctggaggacagatgactctttttcatgcagtacatgccccgtgtactacagcatgtttagcaacatccctggcctctagatgccagtagcatcttccacaccctgttgtgacaaggaaaatgtttccagacactgccagatatcctatgtgggcaaaatctgcccctgacaccctgctgagaagcagtggattaagtgcttaatttaatcaatgttgatgaatagattgcaaggtggcttggcaatctctgggttctaaagagtccctcagactctgagagaaattgttccactacagccaaggtacagaacaaatatctaaaaatatctgtcagctcctatgagtggtgctcgcttcaagtgcttgaaactgatgccaatttggccaggagcctatgctaacttcttccttagtaattgttttctcaatagctgcagctcattttgaacatccttggaacagtacataaatttttatcttatttactatttcctgaactcgccaattaagtttccatcattgtaacttaaaaaaaaatcttcctgtccaggacatcctcctgagggtaagaatatgcacctgttttactgaagtgccttctgccagacagcagagaacccaagaaaagacatttctttttattttattttttgatacggagtctcgctctgtcgcccaggctggagtgcagtggtgcgatttcagctcactgcaagctctgcctccctggttcacgccattctcctgcctcagcctcccgagtggctgggaatacaggtgcctgccaccacgcctggctaatttttttgtatttttttagtagagatggtgtttcaccatgttagccaggatggtctcaatctcctgacctggtgatccacccgcctcagcctcccaaattgctgggattacaggcatgagccaccgtgcctggctaaagatgttttcttaatagcgaatatcctggttgaactttgtcatttgctacataccctcacatacaatgtctcaccaaacagtatgcatactgaagagaggggagacagggagacagggaagaggaaaaatagaggaggagagggagaaagggggagaaagggagagagtggggcagggaatattcagtggtcaaaaaagcaaaaaacaagcaattatctcctcaccagaagtttcaacatctgggctcagatgaacagaataggcaaggctgaaaaagttttatacttaattttactgaaaaattaactaccaggagctttcataataacttcctgttgtataatttgaaaataattgaaaattgtatagtgtattatatttttttttccttgggacagtatcattctgttgctcaggctggagtacagtggcatgatcttggctcactgcagtcttgacctcctgggagcaagcaatcctcctgcctcagcctcccatgtagctgggaccacaggtgtgcaccaccacacccagctaatttttgtatttttctgtagagatggagtttgccacattgcccatgctggccttgaaatcctggtctcaagtgacccaccaaccttggcctcccatagtgatggaattattggcatgaaccaccatgcctggcctgcatattgtgcatttgaatgtcttctacagtacagaccacttaaatacttctatttaaagaggtgatggtatgatagctatgcccttttcactgaagaaaggtaaaatatttgccaaacctcacacaatattagtgtgaggtactttcacccaggtcttctgattttaaaccatatggggtttttcccccttcagatcccagtgactcttaaatggaaaacatctaatactactgatttcccattttctgtcctgtgagttgtactctttttctctctcttcctctggaatatggtctgcctgggaagaggatgtttactgggacccctgtccaggaacatgtaaggattcctgaagagatacacattgcttcattatcagataccttggtttaagtgccttggctggattctgataggtgtgtgtgtaacccgcaataccatagagcatgaagtgaaaaaaatggaaattccctgcgctatttggttcaggagatgcctaacggtactacatagtaaatgtcatgaaactactcaaaagcattggataggtttttagttcttgcttctagcaaaaaaataaaaatgtataaataaagtcacacttttttctatagattgggagcaacagaatatgagtggagtgaccatgtatgtcctggttggctcaggacaatcctaatttattcccattgtttcaatatgaatatttatagtgcccattcttaaaagggttctagtttgatcaagttaaacaatatagtcatgctaaatacggcttgagtttcacaatatacctgattggtttaacatatcatcaggtttcagatttagtcacttttaaaatgggtatgcttcctcctcagaggttgctgatgacgatagaaaggttttagggagtaggtggtaaatgcctcctccttccaaagttatatcatcacttcccaaaaaagaagctttggacagacaccactgttacccccagtcaccactttacaccagaacaatgaccccaatgaagagaaatgcagacagtgagcacaagctgcagggagccaccgcccacccactgggactcaagaccaacattcacatccaaacctatgtctgtaaccacagtggtaagcaaacatgactagtaacttaaagcatggtctttctttaggttttcttcttcgggagcaatctcccttgctcctggatacaaactctggcaggcccccgggctttctatttattcttttgtaatagatagtcccagagtcactttaaatcacacgcatggtcttaatttctgtaaataaaatgtccggctgaagatagtaatcaaaatcctgtatacaactatattaaatccaccccttctccctcccatgtcctcatccctacacccaccctgtccctgaattcccccacccttttcaggctgccacctgcactgcagaaaggacgtgtggtcatctgctctttaatgagcctaatggagtttcttgactcaacttgccgccttgctccaggaaagcaagagagaaaagcgtgtaggaagtgagggctgttcttttgtggctgggaggtttccagcactctgggcctggcagatggtgaaagtgactctttttcttgggtgcgctctttagaatctcttgctggatctctgccttgtggtcttatgacctggatgggtgcatctccagtccaaatagtgggtggagtcacccttctcaactgcttgtcacctggcagctcaactctagccctcttcaccatgaggcctgcttgtccctccagagaagtctgttgaacgagacctgagaggaccccagcaacagtctccatggcatgctcctgggaaaacactcccatttttccagctccaaggcaccacggcaagaacatctctagctcatcgtcttgcaggtggtcagctcttgcctctccctcttcatttcccaggcaggcatcagatctcaatctacaaaccattttgattatctcagtcaagtgttatgttccagtttttaaagccccaaatttggagagatacaggtaaagctctcttgaagcccatacattcatggggctcaaagtgaggggaagactcctcctacccctatgtgatggggaaagaaaatagcccagaactctgatgcctttttctcaagttctcttcactcagctccttacatacaagacctacagaatgcctctgcttccctggtccttatcaggctccactgatgcaacaggaaccaaattcctgacatagggaaaatggacttcagagcataatttcatctagatatatcagacttacaatgttctctcactttctcctctcttaattccatttcaatattctttatctgactcctctatttgattgaagagcgcaaatcgtattaaacagaatcattatataatcatttaataacaaatgttattaaaaagaatcatctgcttaataactcagtgcaagggacacagggagtcgggaggaaggagaaagtctatctcacacatgccttggaaccatgacatccactgcattgctacccctatagaaactataaggactcaataaaaacaataggaaactataaactctgtcggtattaatgctaagggtccagtgccccaaaaggcaaaaccaggtaagcaagctgacacctatcctccaactattacaaattcaatctgaacaatgcttatttctttgctatgttgcctgcatttccagaaaagccctctctagggtctgacctcatataattcacgcaccttattcccataagggaaatctaagaaattgctttccatcgtgctgcatctcataccaagttgagaaatcccctctgatctgctgaacttctgaagtcccagaagtagaaaaacattaagaaatataagaaaggtcaaaaatctgaaaatgccacttgtaaatggacagtcttattgagcagacaggtctcctcaggtggtgaacaaagcttacattagagcttaggaaagaatgaaagggataagtttctttcagcactttaattttgagccaaggacaaagttatgaatttcagaggcgggttccaggtgacatacgctaaacacacaactaccactgagcactaacatagaacctcaacagagtaagaaatgacagggttgccttgctagggatgtgggagataagagcagctgacttctcaacatgaagactacagcagactctggcacctggatagatcttctgtcatcccctgaagggcttccaacaataaacaaacaacacaaatagacaaagaaaaaacaaaagcccgttgataataaagtcaaaactttgataccatcaaataacgaaaccagtcaaagacattttggggattttttttattaggcttcttttaagggtagctttaggttcacagcaaatttaagtgaaagtacagagagttcccatatgactcctgtccccctcccttgtacacacacagcctcccctgctatcaacatctaccctagagtggtacacttgttgcaactgatgaaccaacactgacctattattatcgcccaaatccgcagtttacgttagggttcatcctagacttatatattctacaagtctggactaatgtataataacaatgtgtccaccattttagtatcatatagaatagtttcgctaccctggaagtcctctgtgtttgatctattcatccctcccttcctgcaacccatgacaaccatgcagccttttcttttttttttttttttgacatggagtctcgctctgtccccaggctggagtgtggtggcgcaatctcagctcactggaacctccacctcccgggttcaagcaatttccctgcttcagccccccgagtagctgggactataggcgcacacgccaccacacccagctaatttttgtacttttagtagagacggggtttcacgatgttggccaggatggtctcgatctcttgacctcgtgatccgcccgcctcagcatcccaaagtgctgggattacaggcgtgagccaccaggtccggccaaccatggactttcttaccgtctccgtagttttatcttttccagaatgtcatgtatttggagtcatagataatgcagccctttcagattggctcttttgcttagtaataagcatttaattttcctctatgtctttttatggcttaatagctcatttctttttagctgaataatattccattgtatggatgtaccaaaatccatccacttaccaaaggacatcttagatgaattcaggttttgaatgaactttgtgtgaatatataagttttcatcaattcagttgggtaaaggcagcttgattgttggatcttacagtaagattatgtttagttttataagaaactgcgaaactgttttccaatgtggctgaaccactctgcatttccaccagtaatgagaatgagagttgctgttgctccacggcctcaccagcatttggtggtgtcagtgtcttggattttagccatcctaataagtgttagtggctatcattgttttcatttgcaattctcttacatggtgttgaacatctttccccatgtttatttgtcatctgcatatcttcttcggccagttatctgttcagatcttttgcccgtttttgtttgcttgcatgtttgtttgtgtttgattttttaaagaaagctttttttattattgagttgtaatagtgcttgtatagtgtggataacagttctctatcagataggtcttttgcaaatattttccccaatctgtggactgtcttctcattcttttgataaatggctttaaaataataatctggctgggcgcagtggctcatgcctgtaattccagcactttgggaggccaagggcagatcatctgaggtcgggagttcgagaccagcctgaccaacatggagaaaccccatctctactaaaaatataaaattagtcgggcgtggaggcacatgcctgtaatcccagctacttgagaggctgagacaggataatcgcttgaacccgggaggtggaggttgcagtgagccgaaatcgtgccactgtattccagcctggacaataagagcaaaactccatctcaaaaaaaaaaaaaaaactaccttttaattaaaaacaatttgctttagtgagaaatgcatgataatgatagtgtctgaggaactgctcagtgattgaaaggaacattttattgtattagataaatgatatggtaaaaataaagcaaagcaaaattaaaacatgcaaataaaattttgataatttttaatattatgaaaattccacagttatcgatctatctatctatctatctatctatctatctatctatctatctatctaatttgcattgggcaggagctactccaaaacatatggaggcaaaaggcaaaagaggaaattgaaaagaaaggaagcgtaagaacaagaggataggtggtatggaaggactttgtcaaaaataattgtccaccatcctcactttctatttttacagatgttggtgctgctgctagtgacagccctgagaaacagatgaacagggattcccaagtctttttttttttcaatttttacatttaactgcatggatttttttttttttttatgttaaggcaacctgattgcagtgtgaattaatgcttttcatcttgacaagaatggacaagcaagatgtattccttgtgtaactttcataagtatctcaggtttatatgttttcattctgttttcaacaaacttcagatgttctgatctatgcaaactgacaattcttttcctcactcacaagatatatttacattaaagaaacacatactttctaaaccatatttacttcaaaaattattttaaaaatagtacttttatatgctatattatatatcatatcttatgtacttaaaaatcattttgtaatgattgagtatttgcaaattaaaatatcaaagctctggcagtattgctcatttggagaagaggaagactcacaattctgcataaatgattgtcttctctattgtttgttttttttttgtacagcagaaaggcccttttccctatcctatctgcctctgccagaggccagagcagcctcagattttcctccagggccctttgtgggccagcactcaggctgccctctctgcatgattagtgctgcacaaggtatagcattcactccatgcttctggattcctggatgggacccacacttaactggctgtccctgcagcagaaacttactcaaattacactgacaccctgcttagcatgaaattagcttgaaatacagaggctaagaggtggcccctcctgatggtctcaagcttgcttactgatatgtaacctcttcatatcccaagacaaagtcagattgagtctctccaatgccagcagcaatctcttccctcactgttccctccacttaacaaaggcttttgagaagtaagaatattttagctcaaacaacaagctttcacttttatatctagataacctaaaatttgttcatgcagcattttacatatcattacttcaagtatatttctgtgtttttatgatgaaattgtaccttcccagcaaaacaacacaacagagaacaattgcactgtatatttgatggtaacactagagcccaacggagggtccattccatggagagataaagctaatgattttggtaagacttggtaaggggctgcaatgacaggtttattgggctctctaaaacagttctgttcctggacaactgtgtataaacaatttatgaaaaataaataatgttttatagactttatcagaaatttgatatttaaacaattctaagacactttggaagaaaaaaaagactgaaaaataatttcctagatggcaaatcacgaggcttatatcaaatattatccatcaatgcacaacacaggagtagattcaagatatggcaagtgcattcaatcccagctaaagcatagttatttgtatccttaagagttatgtttatcacagcattctttgtggtaatgaaagaatagaaatgacctaaatgataagcagggggttaatgtttttaagataaaaataaagtaaatccatacaagccattatgcagccattaagaatatgtgctttttaaataatcgtgtgccttgaataaaaagactaaagtcaaaaataactgagttttaatagtagcttgcttcctaaccagctatttaatactgaactcatctccttatcttcctgagcctcaactgtctcatctgaaaagtggggattaaaaaaaagtaactgcctgaatgggctgctgtgagaattaaatgagatgatacccttgaagtgcttagccaattataaagttaccttttattgaacatttactattattaggttgaggctcataaaactgccatttttatagttcaaatgtagtcaacatttgaaaatctcatatcgttaaaactaacaagacagtaaacaaactagagtataaagtctcatccataggaacaaacacaaatatagcaggtttttactctgaagtaaaataattattaatggattttagtagcattaatggattttagtagcattaagatggtactagatcaagggtctcaaaccatagccattcttcctccaaaatttctaaggaatatatatacacacacacacacacacacacacacacacacacacacagagagagagagagagagagagagagagagagaatgacaaatgtctatgttggttgtagtatgagtttatccatccagttactggagtgaaaaataaatagaaagaaaaacaatataataatacataatacaatactacatggctcagagttgtcaccacagttttttggaggtaggtacttggatgagagtgacaggatagaaaaaacctgagtgcatgatcctgtcatagccagaccttgagcctctaatgtaatactgtgtccagaattggtggcttcttggtctcactgacttcaagaatgaagctgtggaccctcgcagtgagtgttacagttcttaaaggcagcgtgtccggagtttgttcattctgatgttcggatgtgttcggagtttcttccttctggtgggttcgtggtcttgctggctcaggagtgaagctgcggaccttcacagatgagtgttacagcttttaaggcggcgcgtctggagttgttccttcctcccggtgggttcgtggtctcgttggcttcaggagtgaagctgcagaccttggcggtgagtgttacagctcataaaggcagtgtggacccaaagagtgagcagcagcaagacttattgcaaagagcgaaagaataaagcttccaccactgtggaaggggacatgagcgggttgccactgctagctcgggcagcctgtttattctcatgtggccccacccacatcctgccgattggtagagccaaggggtctgttttgacagggcactgattggtgcgtttacaatccctgagctagacacaaaggttctccacgtccccaccagattagctagatacagagtgttgacacaaaggttctccaagtccccaccagagtagctagatacagagtgttgattggtgcattcacaaaccctgagctagacacagggtactgattggtgtgtttacaaaccttgagctagacacagagtgccgattggtgtctcaatccctgagctagacataaaggttctccaaggccccaccagagtagctggatgcaaagtgtccattggtgcattcacaaaccctgagctagacacagagtgccaattggtgtatttacaatcccttagctagacataaaggttctgcaagtcctcaccagactcaggagcccagctggcttcacccagtggatcccgcaccggcgctgcatgtggagctgcctgccagtcccgcgccgtgcacccgcactcctcagcccttgggtggtcgatgggactgggcgccgtggagcaggcggcggcgctcgttggggaggctcgggccgcacaggagcccacgaaggcggggaggctcaggcatggtgggctgcaggtccccagccctgccccgcgaggaggcagctaaggccaggcgagaaatcgagcgcagcgccggtgggccggcactgccgagggacccagtacaccctccgcagccgctggcccgggtgctaagcccctcattgccaggggccggcaggctgctccgagtgcggggccgccaagcccgcgcccacccggaactccagctggcccgcaagcgccgagcacagccccggtttccgctcacgcctctccctccacacctccctgcaagctgagggagccagctctggccttggccagcccagaaaggggctcccacagtgcagcggtgggctgaagggctccttaagtgccgccaaagtgggagcccaggcagaggcagcgctgagagcgagcgagggctgtgaagactgccagcacactgtcacctctcaataccccacagaagcaaagccacatgtgagcatgcaacctcacatctcacatagactattagcagaggtgtcctattctcccgggaagggagaaagaggagtaggaaaaagaaaggctaaaaggtgtctcaaaaggggaaaaggaattaacagcttctgaccacctacccccaatacctattttttatctattttttgccttttagcaaataaactttctgtatttttccattttttagtgaaaatatatatacctatatatatatattcactgaattataaaattaaaattatatatataattttataggaaaaatagaacaaatctttttaaaattgcagttacatgcaattaaagcatgctgatgatgagacatattaaatcatccataagaaatgcacaggctctcataggtatgaaagcaatggctccttctgtgtcactttatctccatgaatatgcttcagtagttaagaactgcttcatgttcaagggtggcttagccttagaggagagacttagaaggggattatacttttagatcagaagagaatgaatttttccccagaacaaatgatttctaaaacccttagaaattgtgcattactcatcctttttctatcttctttccactatacattttatgtgggatccctgtggcagttaatagaaaaattcaagtcacaaaaggaaagaaagaaagaagggaaaagacctggggtatcagaattaaaaagagatgtgaattggcccattagggaaaactgagatctacagagatgtggcttatgtttactttccctccctactaacatggccttttataaaaagaaaagccctgtctcttttctttttccgtctctaacaatgaaaccacactgagagagattagagtgctaatcagcttctggaaaagcagatcaaccaaaaaacgcctacattgcaggctttctggttcattttccctccattgttttagtagcctgagtttatgggaaatcaaacttcgtcaacttaagctgctgttcctggctgaattttggagtagtcagcaaggttcctataacaaacaaatgaccacacacaattgtgagggcacaggcatgtgcacgtgcacacacacacacacacacacacacgtattaatcagagcacttggttgctgagatcccagcaagaaagatgaaaataaatggagtatggtcattaaaaatcctaaactaatatttcgaatatggcataaaatgaatgcttgctaacagagaatggatgggaggacctcttttgcttaagaaaattaatgatggccgggcgcagtggcgcatgcctgtaatcccagcagtttgggaggccgaggagggtggatcacaaggtcaggagattgagaccatcctggctaacacggtgatgagacatattaaatcatccctactaaaaaaataccaaccgtctctactaaaaaaagtacaaaaattagccgggtgtggtgctgagcgcctgcagtcccagctacttgggaggctgaggcagaagaatggcgtgaacccgggaagcggagcttgcagtgagccgagatcgtgccactgcaccccagcctgggcgacagagcgagactctgtctctaaaaaaaaaaaacaaaaaaacaaaaatgaattaaaaggttaagacagattggttacaaaatcaccaggaaaggtcactcctaacagactcattatgcttatgcttagggtaaacagtcatcagctaccctgcaaaataagtggcagggctgctgtatattgaatacaaattatttgcagaaccctcagctctccttgcttcattttgctactgggatacacggaagctggcattgtatgttcatgtgtgtatttatgtatctgagcatctcattataaattattatcttcacattcaagaaaatagccagctcacaggcacaacaccaacacaggagggctttataacatcgcatgcttgaatcaggtgcattctgtttcatcttgctttgttttggtttttttcttcagaatttggaaagatatgatggttcttaggagtcagaactttttctttttttaataatatggttagtcagataaggcttctaggtgaaacttcttcaaaagtccagggaacctagtgttctaatgcttccccactaactccttctgaaaccacatctgctcaaagccttctcaatcaagacatggggaatctgcccttcaaagaaaaggtaatttcagcagatctcaggggagttttgcaatcagaatttcctaagatacaactgtggtggaactggctatgaaatgtattaatgctgataactgtggttttataatccccaccaattaccacaaattatagccgtgtgattctggaaaaaccacatgctgtggagttgaatcctggaaaaatatacactggttgtctaatttccttcctaattttaagaagactcataaaaatccttgccctacccttcttctcctagaagactctcagggaccaaaaatacttgagaggcatttgtacttaaatcctatgtagcgagctccagaaatacttttttggctgttaattaactaattcaatgttgataagcctacttaatgtacactccagtaaaccagtacatacaaagaaacgtggtcctaccatcaaggggtttacagtagcagtaggacagaaaagtgatgaaataaagtcaacacaatggagctacaaaaacaactgcaagagcagaatctcagaagtcagaactcactgagaagagcatggaagcgggtggggaaaatacttggtaataaggacaggaaactgtttcaccatgctggccttcagtgtaaagtcctctgaaagctggcaatctccccaagtgcacaaatacagatgtttgctcgtttgtaactcctgaaccagagagccactagctcagaggcatcatcgtgggaaagccccctgcagttttcagagatgttgccttatgaataatggaaactttcaagaatgattttggtttaagaacagggataagtcctttttttagggttgtgtatgtcagcactctgccctggtaaattatctgcagacagcatagtctatcaaaatgaactcactgctgttcatttttcctgcctgccatgctgtgtattaactatcatccattattttaaaaacatttctggaatcaaaggtaagagcaaaaagaaaaacaaaagggtaataggagataaatgcactgcaaatgctggtcatacatgctagtaagacaggaaaaatatctcatggggaaaaacaaaagccaatttttccataacagcagtaatattcacagacttgaatgcttccaggaagcttaggaaagcacagggtttggggacgttgacagttataccctggggatgttctcatggggaaaggtgtcaagcagatcattagtcaatttgatcccccatttacaaagcactgatgttatgtgaatttttatccccttccatacacactggtagaagcatactatagtattaatatagtctacaaatatattattatttttgagaattacatgatttttttgatatatttgagtatatcctgaaatttttaaaaaaacaaagtagaaagcattgtcttgagtaaaaataacttcacatttggctgctgattgctcccctgataccatgcatttggcatcaaatccccctttcctgaagcaactcacagcactactgtcacctgtgttattactggaatcttaagttgttatttaactttgtcactggtgacaaagaaaaggtataccttgctgccttagagtgatagtgatctttctccccagttcccaccacatgtgtgtatgcctgtctccagctcaacttatgcttgcttcttggacaaaatgacaccttagcaagactcaggaaaatgaaaatgttaactatccaagagaaacaaagcaccataattccaagaaatccagaccaagttttgctctaaggacacccttgacaaacatgcaaaatgagcttgtctgctctgccttctgtagaatcagaagcaccttcaaggtgagcactcccctcgcagcaatggtaaattttagctggtttgtgccaacacagttgcaagctaaatgcttaactggggattagactccaattcaaaccactttccaggcactgcctcctcactttataatgttatagaatgattatcaatagctgtgattctgaaaccaatctgagacccgggcctctgcaatttaaagcatatcagtgatctctgtcaacattaattttccccatcctaatttgtatttctttcacaccacaaagggatctaagtttatgatttacctggacagcacgatcgtgttcaggtctaaatgcaaaagagattacatgtagatgatgaatttgcatccttgtaaatgcagaatattttagccatgacaaatggcaagatgggagaacatgttcactgaaactaggaagcccagaaataaggtatcagcaacactaatgagcagctcagtcaagcaaaccccagaaaaataatgggccaaagttcatcgattctctgtattttccagattaaaatcacctgggtagcttttacactacctgtgtcctgggctcagtcctagagattctgattcaattggtcttgggtggggccacacatatactattttaaaatgtcccccagaagatgttaatgttcgcaggattgacagccactgagtataaaatgtatttagcatatttccaggcttaggatcaatagaatggtagctaaaatataatcaatgatttattaattcattgatttattaaacaactagttaatgagtaccactatgtggtaactctggtgctacaaggccaagaagttgcaaactaaacacttactctcaaggagtccaatagtgaaacacaatgatatctgaacagacagttgtatccaggatgcccccccacccccagctatggcagaggaaagcacaaaggtcaagttttacctgctccaactcccaagtaaggatagctaacacccacagaggactctacaacttgtagagcacacggagcatcattaactttaccagatatcaatagcaacttcaactatgaaaaacatttttggctgggcgcagtggctcatacttgtaatcctagtactttgggaggccaaggcagatggatcacctgaggtcaggagttcaagaccagcctggccaacatggcgaaaccccatctctactaaaaatacaaaaattagctgagcatggtgatgcatgcctgtaatcccagctacttgggaggatgaggcagaagaatcacttgaacccaggaggcggaggttgcagtgagtcgagatcacaccactgcactccagcctgggcaacagagtgagactccatctcaaaaaacaaaaaaaaaaaaaaaaaagaaagaaaatttcaaaagtgaaaatataatagacattggcgtggatgtggtgaaaaggaaacgtttatacactgcttatgggaatgtaaattagtacagcctcttgggaaaacagtatggagattttttattttttattttatttatttcttttttttagatggagtcgcgcactgtcacccaggctggagtgcagtggtgcgatctcagatcactgcgagctcggtctccggggttcacgtcattctcctgcctcagcctcctgtgtagttgggactacaggcgccaccaccacacccggctaatttttttttgtatttttagtggagatgggatttcaccgtgttagccaggacagtctggatctcctgccctcgtgatccacccgccttggcctcccaaagtgctgggattacaggcatgagccactgcacccggccagtatggagattttttaaagaactaaaagtagatctaccattcaatccaggaacccactactaggtatcacaattcacaattgcaaagatatgaaaccaacctacatgcccatcaacgattgagtgtataaagaaaatgtggtatatgtacatcatagaatactactcagccataaaaaagaacaaaataatgtcctttgcagcaacttggatgttgctggaagccattattttcagtgaagtaactcgggaatggaaaaccaattaccatatgttctcatttaataagcaggagctaagctatgggtacataaaggcatacagagtgacataatggacactggaaactcagaaaagggagggcggaaggggaagtgaggaataaaaaatgacatattgggcacaatatacactactcaggtgatgggtacactaaaatctcagacttcatcactatacaattcatccatgtaatcaaaaaccacgagtaccccaaaaactactgaaattaaaaaaatacttacaaataaaaaaaagaaaagaaaataatttttggaatacccacttacaaatgaggaaactgagactcagaagcatttaggtattttatagttagctcttttcccagttagcttttacaatcagaagagctgagtttcagttatgtttctacctcttagaatgtgcctagagggtccttaaaatatttactcttcactgtaacctaattgatcaaattattattatccctaatatagaatatagaaataaatgtccaaagagatatggaaacttggtggagataatattctaatatttaccattttaagtcctctaatttagtagtcacaaaatacctggcttcctacctgcaaaatgatagtgggttgacctgtctgggtctacctgcagtcaaccaataatgagttataatggatacattttttaaaaaaaattcctagaagaaataggaacagcaatgttttatcattagcattccaaaatatgcaaggatacctgctgtaaacaaggcaaatatttggggcagcaattattagaaatgtagaatgttagagctaggttgaaaatcagtctgtctagtacaaattctttttcttaaaaatgagaagaccaagattctatgaaataaaacaatttgcccaagatcacacaattagtggcagtgctaagtttagaacacaggacatgctcacacctactctcaatatgcacagaacatactatttacttctcacaggattcatcaaagtgataatgtccctttttactgttttgattgtctttgcaaaagtttgagggaaattcaagtaggtgaagctatttcaatttgcatttagaatttctaacatttctagaaagtactttgaaacttgagaattaaatttaagaactggtagcctgtaaactcaaattacccctattatcatctgattggagcatatctgaatgttaactattctttactgcctcctgaaaatctgcaaaagtgatctttgcagtatggtgcaggaagctatctattcttaaatactgactaattgctgaaaatctcacttccccttttctctaatttttgacttggcctcaagccatcagttgtgcttagactttgggacacagcccttcaccagtctttttccttcctgtttccatttacatcctgactggtatctcatgggcactcagttgcataatcttctaaggcaaacaacaagatggttgctaactattccatggaatcctgttcccagaaacagcacaaaactgagatgaaatgcagtgaagagctactcaagtccaagacaggaacatagatttggttagacaatctcagagcaggctttttcctaaccctagtgcatctttcagtggaccaacaccaataccttctggcatcaagcagagaagaatgtatggaacatgccactaatggagggaactcacatttaatgagatcctactattcatctggagcttcaaatatcttcttccttgcaataagtctatatgagataaatatgtgagggaataagtttttgtgaatgctggcagagctactgttcaggaatttcctgaactctgatttcctccaaagatcaggtatggccttgatgatgagaagactggcataaagccctgagaaaagttgtatcttcattcccttaagaggaagcatcaactgcaaagactgctcttgaatataatgcaaggttcaactctaaggggataatggaaaacaaaatagttgacttctcagatatggtaggaaactattcttcaaggacaaaattactagcaattcttcatgaccactctacttctgataaacttatgctgtggttaaatactataaactcaatctaatcttaaactagcatatatgtgtccactccagtctaaaatgcagaagtactaataaccccatttaccagatgatacggtttggctgtgtccccacccaaatctcatcttgaattgtagctcccataatcccatgtgtcatgggaaggactcattgggaggtaactgaatcatgggggtaggtttttcccatgctgttcttgttatagtgaataagtctcagaagatctgatttttttttttttttgagatagagtcttgctctgttgcccaggctggaattcagtgacatggtctcagctcactgcaccctccgcctcccaggttcaagcaattctcctgcctcagcctcctgagtagctgggatttacaggtgcccaccaccatgcccagctattttttttttttttgtatttttagtaggagagggtttcaccatgttggctagggtggttttgaactcctgacctcaagtaatccacccttgtcggcctcccaaagtgctagaattgcagacatgagtcactgtgcctggccaatctgatggttttataaagggcagttcccttgcacatgctctcttgcctgctgccatataagacatgcctttgctcctccttcaccttccaccatgattgtgaagcctccccaaccatgtggactgtgagtccactaaacctgtttttctttataaattacccagtctcaggcatttcttcatagcagtatgaaaatggtctaggctgggcacggtggctcatgcctgtaatcccagcactttggggggctgaggcaggtggatcacctgaggtcaggagtttgtgaccagcctggccaacacagtgaaatcccatctctactaaaaacacaaaaattagccggacatggtggcaggtgcctgtaatccccactacttgggaggctgaggcaggagaattgcttgacctcgggaggcggaggttgcagtgagccaagatcaagccactgcactccatcctgagcaacagagcaagactctgtctcaaaaagaagaaaaaaaaaaaaaaaaaagaaagaaaggaagtggtctaatacaccagttgaagaaaatgaggtccagagagggcatccttaaccacagcttggacagattaggtatccatctcaactctatcttctttacaaggataaataattcagaagagaagaggatgtagaaactagggcctggcagggagtgtcaaatcaatgaagaaagcaggtccaggaagtagagagaagagggaccaaaattcaaaatctcaatctgctctagtgtacaggcctatttcaggaacttagcacatcaagttgatgtttgtcattatacactggcttggtagctacaccttgatctttgccctactacaacgagtctaataagaaaaatggcctgaagatattttcagtctgatgatatcctgtagagttttatgtttggagagatggggaacatggatgacttagttcccaagagcagaagtggcaaattgatggacctcaggccaccacgctagctagtatagctaagctaatcaggacgaccatggatacagccattacagatgcaccctgcatcctgcagtccagacagtagctgatctcacactattccttcctccttcccacatgcttcctggtgacaggaggagcaattgtatcatgtgcttagatggcccaaagaataagcaggcagcaaccatttgagtaacagttttgcggttctgtagattccataaaactactcaaataaacaaacaaagtggttattctaagcagagtccacaaatccctatgtcatatcagcatcagaacatcaacccctgacttctggggagctgccaaaatgggaactcagaggccagacctctattaacagtgcagcacttggtgtcagcaaaactctgactgctaaggttattgtaggctgggacatcctgctgcctagcaaaagtatagtctccatgttgtgacattaatttgttaagttttgaagagagagattattgggactgtgtttttgtaaccctaaagggaaaacgtcccatgtaatgtagaaggaagagaatagtgtaaattctgactcgtttttgaggtcagaagtgatagattcctaattgggagaagggcaataccaaatttaagaaaaataatctaggaaactgacagataatggcaaaattagaaagaaaactgacatcacaataaataccaatcaagttccaaagatttccggacatttcccttgccccagcaaagagaatgtattcatcaacctgcaggcatggctaatccaagtcttcgattatttcaaagggtatacgtttggaataatgcaatgaatataaatttcccaattaatttggtttaggattggagatggggaagacaaacttgtgaaattatcttatttctttcaaactcagatagttcacactggtctgactcaatgttctcattcaaaaggggcgatgatgcaggacattcaaagataaattcctttcaaaagtctttttaaagttttggtccccagaagtgatggcagaaataaatatacatttctgaaagaaaacgcagtcctgtgcctttcaggaattgattgcatctcctgcttctgcaagctaagaagtcataatcctctgcaatcacagattgtttgaagccaataaaccaaaggtgatgaccttgctaatacatcccagcaggagaaagaaataaagctgtgctgaggaataactcttcagcacaccatttccctttggaaggaggagaagagctgaaagcaccccagcctgatttatggaggagcagtactgtatttcggaaacttcacctgaaataagaaaaaggtttttctaaagttctccagtactattgctctcatcttcctcatcctacgatataatgcctgttgagccatggatactcgcttcagtgccacacatacctctggtggcctttgctcaaagttgagccaggtccgtagtggagacctgtgtcctgtttcctaaagtgaactgtcaggagacagcacaaggtgcagcccttgggactgggaattcaatgcgccagacattacatttgtatttgaacaaatgtacctctgctttagcattagataagcttccagcactcacgaaagcatcattacagacattcagcatagcagtgtcaagcaacctgctgaaattaaattaatatctgtcacctccctcaagtgcaatgacaatagattagagcaaaacatgacatttgagtaaactatattctgttaaccattgattacttgtgataactaatatgggacatgctttatatgaattaaacccacagatgacacagataacatatttttaaaaaatctcctttcctcattacatttaacttggcgcttcttgttactgaacatactactatgcaccaaggtctgtacttggtgttgggtatacaaaaatgaagaaggtagcatgtgtccttcgaaatgttcctggtaaaggtaagagatgaatagaaagtgcttacaattcaaaccaatacattcaaaaggaaaaatatgtaaaacagagcacatgagcagtaatttattctctgtgtggcttctttttaagaagccattcatatctatactattaaaagtaggcttggctggacatggtggctcacgcctgtaatcccagcactttgggaggccaaggtgggtggatcacctgaggtaaggagttccagaccaacctggccaacatggtgaaaccctatctcaactaaaaatacaaaaattaactgggtatggtggcacatggctgtaatcccagctactcgggagactgaagcaggagaactgcttgaacccgagaggtggaggtttcagtgagcctaagttgtgccattgcactccagcctgggcaacaagaacaaaactccatctcaaaaaataataataaaaaaaattattctctgtgtggatagagatggctagggaaggatcccacaaaagatggtccttgtggggttcaaagcctgggctctggagctcgactggttcagatctcttctttactgcttagtatctttatgaccctgttcgggttacctccctatgcctcagtttccacgtctacaaaaagggtataacgatagtaccaatctcataaaaatattttgggaatttgttaatacatataaagcacttgaagccatgcctggcatatagtaaattgtcagtataaatggctatcagtattattttgtaggcaaattgaatagaaggggaaaggcatccccagcaaagaccacagaagtacaagatccaagatttgtgtttgtctgttggtgttgtattattaatgtatgtttagtaggtgatccacactcaacatcagtgtcaccataagcctattagataaatatactttttctgatgaggaaatggagcacagagacttaaaaaaaaaatctccccacagtctcagagctagtaaatggacagagcctggattcctgcccagacagcccaaggccaaagcccacgtgctgacccatgacatggatggccttccaagggcacgtgttgccttggcagaacctataagtagttcaccgtggctagaacacacaatacccttcctttattgagaattttagtaagtgaaatgaacaataccaaggaatgtggctcccagtaggagagggattggagaagccaaagtaaggtcaacttagactccagaaaaccaaactctaaaaaatatatttttaactataaaaggaaaagaaattttggaatgggcttcagagtaaggagcagggtaaaaaatggtgactagcaagaaaaccagtattacttcagcctaatatctgagcgactcactctgtgttgacaatggtatcacagggactgccggttgtggttaatctgtaagtcttagttctgggaatagacagttgcctggagaaaatctcccataaccaggatggagaaggctgcttagtgttccccaaaggtgtggaggtgggttgtcactcacaaataactcagggatgtggggggaattgacaagtagatctagttgttccatataaatgcagaaaaatagcagtgccttctcctagagagctgagtgaatttcttaaaagtagcttttataaaaggcttttctgattaactccacctgctctgaccagttcccattcacagagttccccggggacaagacatgttccaagttttataatacaaaaattcacactcctctgggtattattttttaagtgttcttcaggctcttaaatatgaatggatcgaaggtcctactgtttcactgtttgtcctcctcccacctccggcttccctttcttctttctctatttggtcaagacctcttatctaccactcaagcccctcagttccccaacctcttgtccttcctcctggaatcataaccaaatgccttcttgtgtgttacacaaggctcactggaacaaaaaaagcacagtcatgctgaccccagggtgtggcttcatctggatctcagcattattcagcacagtgcatgccagctcctgagctgtccctctcctgtcttctcagtgactcttccaaaatgtcaagtcccatctcacgtccatctcccactcaacatacaaccaaatggcaggacaccccttaacccacatggctcaggaaagctgatttgtgggagtccctatcctggcatccttgcctcctctcttggtaaaaggaaagctcccctcggtccaccccttgccctccctgatctactacgactggataattcctccacctgaccttggattccataccttctctaccactcaattctctatcagttctctatcagttctattctccactaatttttctatattttcagtctcttttcactgatttctccctgggaaatgtaaacatggccaggtttgttctcacttaaagaaaggaaaatgttcctttagtctgtcacctcctttctacaaaatcacgtctcttccttttatttcccttcacagctccttcttgagagagctgtcttcatatcctgtccctattccctgactgctcatccactagtcagaggtgctcagtgggcatcactaggacagacagatgtaccttctcagccacctgttacccaaccttccctccggcacttcagctgagccaatgtcttctgcattgataaatttggtggctacttcacacatatttttcttacttaactatctgtggtgtttaatgttcttctcacttgttcctctgcctaatttttcttccaactttcaagcagcagcaactccaactcctcctcagacttctgtatgtctaggaactggggatctcctcagtttttctctcattttcttctgcacactctccctaggttcctatgaacacagcttctactgcttgagctcatgccttccaaatatgtcttcacatcagtccttctgcctggactccaaggccatgtatactttaattatctgaaaatttccatttgagttgtctaactctatctcaacctcaatctgttaaaaaataaattaataggccaggtgcagtggctcacacctgtaatcccagcgctttgggaggccgaggtggccggatcatgaggtcaggagatcaagaccatcccggctaacactgtgaaaccccatctctactaaaaatacaaaaaaaaaatagccgggcatggtggcaggtgcctgtagtcccagctactcgggaggctgaggcaggagaatggcgtgaacccgggaggcagagcttgcagtgagccgagatcgtgccactggactccagcctaggcaacagagtgagactccatctcaaaaaattaattaattaattaattgtctcttcacctcatccccatctcccattccaaaattgtcttcctccgtcttctcctagaaaataatctcaccatcctctggaatgtccaagacaaaagtgagaaagtcattgcagatatgtttctccctttcaccttctaactcacccaacaactggtcctgtgcttctttcccttacaaaatctattaaaatcacccccacactctatatgtcatactccatttttccactctctaaaaaggttggccccttctcatctcttacttcttgtttcactgactactttgttcatggtcaccagttttgttctttgccaggtgaatccataacatgacaccaaggtaattttttgtgtgtgaaattcatatctcatcaacccttttacttgccccagacctttcaaagatgcattagttcctctgggataaatgtcagaatacttagcacagaactgaccaattgcacacacagactgtattgtgatttagtgcaatttcctcaataagccatgctgccagcacctagaggcgcctgaaatatgggatgtactcactaaataatcagcctcccttactagtctaattcctactccttctttggattcagttcaggtctcttctcctccagaaagctcttccttccccacccagagaacctatggtacttctactatggcacttgacatactgacataatctctcatgtatttatctgtctccccaacaggctgcaaattacttaaggacaacaatatgatcttctttgtatctggatttataccagttagcatggatctatgtatgtacgtatttatacattcaattaatttgccaaatttcacctgaatacctttgtgccaggcaatttcctggacacagaaaataagacagacaaggtctctgccctcagcgagtttatattttaatggtggcatcagacaatagagaagtaatgaataaaatcattctagatcatgacacatgtagtgaatgaaagaaacaaagagagctatggtagaaagaagcaagaaagagccttcttttttttttttttttttttttttttttggagatggagtctcgctctgtcactcaggctgacatgcagtgatgtgatcttggctcactgcaacctctggctcccgggttcaagcaattctcctgcctcaaactcccgagaggctgggattacaggcatgagccaccacacccagctaatttttttgtatttttagtagagacaaggtttcaccatgttggccaggctggtcttgaactcctagcctcaagtgatctacctgcctcggcctcccaaagtgctgggattacaggtgtgagccaccatgtccagccaagcctacttttaatagtatagatacgaatggcttcttaaaaagaagttggtatttggattatgacctgaaaaatatggaggatctggtcatgctgaaagaataaagagactttgtgttcctagaaggtatgaaattgtgttctgaggatcttctgactttctttgtgcccaatacaggacactatactcaaatagcacttaattttcattgtttgattgcttattaagcttaaattttgacataaaaggacaatccaaaacagtaaatacataggaaagccttctgaggaactatgaggatgtggaaggtaactggatggtggtgatctgtatctcaagggacttcacagatgtagaattttaccacgtggtgttcataccaatgtactaaaatgggaattaatattctaaatgcttcctgaatctataaccaggtttgatatcagaatgtcagttgctttgctttctctagtaaaattttttgcctttgctttctcagcttatattggcaaagttattaggacctcaggacagtgtttgctttctgtgtatttcatctattacttgctaaaaggaaaagtggggaactcagcagggtgtcaatcactgaggcaaacaaggagagcaggggtgcaagctgaggccagactctcacagatggtctcacacatctcaggaaggtctatagcatcttttggatgaatacatgcagatccttatagaacgagctttcacatggtgagttctaagattttgttaaaatcaagggggctgaacaggaatgcctagagctctgtggaaataacagattcctgccttgaatctctgggcttttcccacttggcactggttatgctcttcttctttgacagcaatgtcatggaatttctcgaggtcacgtagcacattattcagaactgtatcacctacacataaggcagtaggttaaaaatttaggatagaaacaagtgtatgacataggcctggctttcagtgacactaaatcatttcataacatactcttcaaagcaaaaagcatttaatgatacttaataagaccagttctattttgggtatgaaccaaatgaaaataagacatggtcatagtctttggatttccaggttagtatgtgatatggtttggctgtgtccctacccaaatcttgtcttgaattgtagcccccataattcccacatatcaagggaaggatttggtgggaggtaattgaatcatgggagcgggtcttcccccatactattttcatgttagtgtgtaagtctcacgagatctgatggttttataaatgggagttccctgcacaaactctctcgcctgttgccatgtaagacgtggctttgctcttccatcattttacaccatgactgtggggcctccccagcactgtggaactgtgagtcaattaaacctctttcctttataaattacccagtatcaggtatgtctttattagcagcacgggaacagactaataatacagtatggaaacagacaaacatcacaataacttatgcatacattttaccctgcatttagcacacttctgtaactatccactgaaagtctgctcttaactagatttggggtttctgtaggacaggaacaattatttacttatatgcttattcccactgactatctagtacactgcttggcatggcatacaggtaggtctaagagatgtttgttgaacaaaataaatatacatctgataaccattataagtcaaagatacataattcactacaagattaatgagaaagaagcaattatttttgcctgaggagtgagggagaaagagagaggtccacagtgccacagtccaatacacatatgaaaagatgatcaccatcacttgtggtcaggaaaatacccattaaaatacactgagatcaagacatcactttcatccaaaatactgatttaaaagttacgtattgaaaattccagtcctgatgaaagcctggggaaatctgcaaactattattgcttgcacgtgtatgatttgttgcaaccttcttggaatgtaatctcgagtatcatttacaatacaaatgcattcatttttgatacaacaatatcatcttaagaattctattgtactttataaaggtaaaattaccaaagtaaaaggatatgtttacagatatgtttatcggagcactgtgtgtagtaacaactcttgacgaaatgaactaaagatctatcggaaaggtaatggagaagcagtgtagcacaggcattcagagaatagtcaggagccagctctgtctgactagctggctgtcagaccattaagcatgctactaaatctttctaagtcttacttctctcatctagaaactggagctacaggctgggcgcggtggctcacgcctgtaatcccagcactttgggaggccaaggtgggcagatcacctgaggtcaggagttcaagactagcctggccaacatggtgaaaccctgtctctactaaaaatacaaaaaaattagccgggcctggtggcaggcacctgcaatcccagctactcaagagattgaggcaggagaattgcttgaaccagagagaggcagaggttgcagtgagccgagaacatgccatcactcttcacaagagtgaaactccatctcaaaaaaaaaaaagagaaaaagaaactagagctacaaacagtacctattttatggggttgttaaaaggataaaagaactgaaaacacttcttggtatgtaggaagcaatacataagttaattaagcatgcagttgtttaattcgatatactgtacaatatgcatactctgggatgcttacaagcctggcccatttttttcaatgcattcatctggatagacacccaagagtcattggtaagtgaaataaatcaggttgtcataatccagtgaatagtatacttctattttcttaaacaaatgaaaaagtagacctatggtatgtatatatctgttgacactttttagttgagtcacaaagatatgaagagaaaaaaaacaataactcaccactacagatatcaggaaagctgaatctaggtggtatgtaagaaactatttacagttttttgaaaaaaaaaaaatgtatctgtgttttttctggctcattgtaatgagcatacattacttttgtgattttttttaaaaaaacatagtttagtaaaataaatgtaggcagggtagagtggctcacgtctgtaatcccagtgctttaggaggctgagttaaggggactgcttgaagccaggggtccaagaccagtctgggcaacaaggtgaggccccatctctacaaaaaaatttaaaaattaatctggcacagtggtgtgtacctgtagtaccagttacttgggaggctgaggctggaggactgcttgtggctgcagtgagctatgattattccactgcctcagtgacagagcaagaccctgtttcttaaaaaaaaaaaaaaattaactgtaggccgggcgcagtgcctcacgcctgtaatcccagcactttgggaggctgagacaggcagatcacaaggtcaggagattgagaccatcctggctaacatggtgaaaccgcgtctctactaaaaatacaaaaaaaattagctgggcgtggtggcaggcgcctgtagtcccagctactctggaggctgaggcaggagaatggcatgaacctgggaggcggagcttgcagtaagctgagatcacgccactgcacttcaacctaggagacagagaaagactctgtatccaaaaaaaaaaagaattttaattgtgtaagttcaggaaccacaaccagctccaagtgacacaaatatggaatgggagttacaaaacacaaaagaatctagaatccaaaaagccacaatccagaacacctccggatcctgcctgaacgcttgactagctcccttagactctggagaggtactaaacatttgtacgcacaggtgtgaacagcatcattaaatctgtgtgacatgaaggattctcttgcctggaagttatcacactctggttttattattattattttttctttttaggatgtgcatatagccttgtgtttgtagcagagtgaaaactggatttggtagcaaaacatctttcaaagcagggactaacaatctgacccaagccacccactgctcttcccctggacgtggcgtggaggagaagggaggcgttgggactcactcacagggcttgcagagggctaacaaacacacaggtgagttccctccagcctgaacctagggagttctccagagagcacaggctgccctcatccctacacagcctctgactcaaggccattattcacaaacactactggggaacttctcttgataatcatgatgcgtaatggccacgaaattgtgtctcctgagaaaatgggacagggctggctaccaatacagaatcacatcaaaagcctaacacattctctctccttaaattgcacttgctttgtgcccctccaaaagcaggttttgctgtttgagaagtacatacttctggagacctacttagaagcctgcttgtgtcccatgtggatctgagaacaggacactgaatttgagaagtcagccatgtcaggcaacctctaagatagacagacactgcaggttgtgtgctgctttaagagagtagacttccagctccttccagaattgcctagggctttctcaccagctaagcctctctcaacagagtactgattgccctagtataacagggaaaaaaaagatgaatatatttcttctcagaagtaccatattctagattttgacaatttatctatctcaacctttaagcttatcttgtaccaatatgataaaaccaccacgctctccaattctcaaagcttaatccactataaagtgaagacaattttaaggtgcagtgaattgttctgcatcaaatcatccccctttcctctcattttgactccctgagtgaagaacaacacaaaacgaaacaaaaatcaccaacttgctccaagattaatgtgtaatcaatgacaagaccaaccgggagcaaaagctcattaatttggtacagtgacatctcgttctgtcttgcctggtttgttgatatccagcaaggcttacagccctaggacatcactataaggtcaacagcctcttggcctcttgactaccctaccacctcaagggcatttgccagttgcccctttctgactcttcagctgctaaaacttgtaaagaataagggctcaattgaaaagtgcacgtatctacttgttggacaagaagccatttctctgtcacccagtatttttcaggagtaaggcaattgctgctcagaatgttacagcacgtagaaaaccctattcactctgtatatggtgtttgtacgtgtgtgtgtctgtgtgtgtatatatatacacacaatacatatatagatattatataataatatacacatatatttctataaaatatcctgttgcttgtttgggtatagaaagatccaccagaaggcagagctctggaagacagataagcaatgaacgtatggagttcagtaacatgtctgtaagtctataggctactacttgctaattgtgcgaccttgggcacaccataaaaatgaattaagaggatgtaataacacatgtctaacactcagcatcatgccagacacacagtgaatacccaataaaggtttccagtattgtcattattaccattatcattattatcactaaacgagcaaggtgttgggttcaaggactcaaagatgagttacgaagagaaaatatccacatgaggaaagtaaagaagcaacacttatctcatatttttattacaacacttatggttgtgtgaaagtctatttacattatatctgtcttattctgggatctggcatttccgggcggctgcttcaataacttattcaatacaattacataaggagggatacatgcaagtgtatttccctctcaccttgactgtccacagatctttgtccccctctaaaaaggaacatctggccgggcacggtggttaacgcctgtaatcccagcactttgggaggccgaggtgggtggatcacgaggtcaggagatcgagaccatcctggctaacatggtgaaaccccgtctctactaaaaatacaaaaattagccaggcatggtggcgggcatctgtagtctcagctactagggaggctgaagcaagagaatggcgggtgaacccaggaggcagagcttgcagtgagccgagatcacgccactgcactccagcctgggtgacagagcaagactccgtctctgaaaaaaaaaaaaaaaaacggaacacctggaggacagagcctatctgctgttgatctaggtacacacacaccttcccctcactggaccagatcattccaaggcataaaggagttaatcaatacaacactgttgaataaataaaagaaataaaatacaatataataaaattatctttggatgaccatgaagtctgttgtgctcactgctctgtttaaaaacacagttactgagcactagctatatgctaagtcttgtacttggggccatgggtaccttgcagatgtctaagacttgcctgaggtcatagtccccaatttttggcataggcaggttttctgagcataaagtactgaaacctccccaatagtcccatagacacttcttttggataaaaataggaattggcccttcctgtcttaaagcttgaaacttaacatttgtttcatctgagttccctcctcaggaaaggccctggaagcctctcaaaaagtatcaaagaagtaaaactcactagctcattgcattcagacaatgagatgccaggcctctcattttatctccttacccttccctagttcctgttttccaacacagttacatttcttccctgctatgttaaacccctaactttagtgagtcagggagatggatttgagactcatctcccatctcctcagctctagcacccggttaaagccttcttccttggcaataatagttgtctcagtgattggctttctgtgcagtgaccagaagggctgagattggatccctggtgttttggtaacagtatgagctggtgcaggagaaagtcagtttgtgctaggccacctagtttccctcaagcaaggctgtgctagacaactcagaaccataaggctttctcttcctgagccctgtcctctacccacccaggcctgtcccactcctcctctgtattaacatacctatggaggtttcctaaactcttgagtacgggcactgtgagctgttcaaaagtcctaccgaggtttcatatatgacacattatatattatattatattatattatattatattatactatgttatattatatattataatatgaagtattatacatatttttccaccttattctctgttttctaaattacattttcagtaaggtatgtgtcattcctattaaagtactaaaatgaccaggcgtggtggctcatgcttgtaatcctgagagtttgggaggctgaggtgggagggttacttgaacccaggagctcaaaaccagtttgagtaacaaagtgggaccctgtctctatcaaaataataataataaaaaattagcctagggtagtcgcaaatatttgtagtcccagctacttgggaggctaaggtgggaagatcacttttatctgggtgtttgaggctgtagtaagctgtgatcatgccactgcactccagcctgggtgacagggtgagattctgtctcaaatactactactactactaataataataataatttaaaataaataaaattaccagtttctaatatatcacatacctgaagtagtcacaccagtatatgacatatggcaaatgactattaggcgtatattttagaaatatattatgtatctgtgggtatagtgtgtgtgtgtgtgtgtgtgtgtgtgtgtgtgcatgcgtgtgtgtatacgcatggtcatctctcagtacctggaggggattttttccagaatcccccatgaatactaaaatccgcagatgctcaaattcctgatagaagatggtgtagtagttgcatatgacttactgaccttctccttggtatatttaaaatcattcccagattacttgtaacaccaaataaaatataaatattatgtaaataattgctatactgtatttttttacttgtattggtgatagtgttgtgttgtttttaaatttttttcccccaacagttttgatccaagatgggttgaattaacagatctaaaacccacagatagggaaggctgactatatgtatatatatatagtcatgtatcacttaatgaggtggatgaattcggagaaacatgaccttaggtgagtttctcattgtgtgaacataatacagtatacttacacaaacctcgaaggtatagcatactacttatgtaggcataaggtacaccctattgttccaagactgcaaatccatacagcatgttactgtgttgaacactgtgggcaattgtaacatcatggtatttgtgtatctaaatatgtctaaacaaaagagatacaggaaaaatacagtataattttatgggaccactattgtatatggtgtcattgactgaaatggcattacgcagtgcatgacagtatgcatccttcagtgaaattcatcttaagattgagaagccagcaggtcattcgcgccacactttcccagatttcacccaagtagactgctccttcagaagggaagcctgatactaatgggatgtgatgccattttttaaattaaccctttccactaagtttgaaaaggacattcttcttagactgggccatcagtaacaatgccccttcatggagagaaaagcatactgaacctgagcttccacagtctagggcaacctgctcctcaggccctgcaggcatgttctttccactgtgcaggtggagagttatgactgcgtaagcctctgtcccagtgagacaaaactgcattatctattaaatttctaatatgcagactatactttatatggaaaatgcactgcagaaaaaaatgctggcttttactcttatacatggagatccattagagaaatctatcagggaagtatgaagttgctcagagtcacagagattctgatgaagggttacagaattgaagcaatatagtaggtgcgggctccttaatgcacaaaaaattatacttttattaagtcccctaccaaacttcccacactttcagttacatccctgtaaccagggactatatccagaactggaagcttagttttcaggcttcaggctgtcttgtggcttgaaggttgggtttcattgggggcttgtccctatctgcctaggaatttgttggccttctactactatcacaataatttttcaaatgaataggtacaaatcccttagcgtagaggagctccttgaataccagcatgactgggcagttgggctaccatgggtctaaaatcatggatgggaagctcctccgagacccaatatgtttttctctttctacctacggcctgcacctcccccattttgagcctataaaaaccctgccctcagccacacgttgggactacccgccttctggtagggactacccactttgggtctcctctccactgagagctgttccgtcactcaataaaactcttcttggatgcaggacaagaacctgggacccacccaacagcgagtgagaaaggagctgtaatactgtagccttcctgtcctctgttggcgccaggcagctgccccacacaacgggaagtagcagtggcgctgggccagcctaggaggcatgggctagagcagagcagtgggactgaacgagctgtaacacgaatgaggtgaaacccacccccaccctgtttgctgcactgtggctggtgggaaggagagaagagctatgacccttctgggggcctagacctcggctccccaagccagggctgtgttatgctgtaacaccccctttgcagttccatgattgctggtgtccccgagtttttaaggcgccaccgcattcccctcgtccagacaccagcgcccaaggcggaggccccttgtcatacacctggtccagccacagccttgcacagagccaatgctggagctgcccaccccatcacagcagctggcgcacctggcttgcccttggcaggcatgagatatcaaccagtagtatgagctgagtgcagcctgatgggctaagtgggcagagcaagccctgtgggcacaagcaaaactcaagcagaggcactgccggctgtggaggtctctggctggcgaagaggcactgaaaaaatcctgtatcatttccatactctatatgtgtgaagcaatacagtgtgaatcccaaagataagggtgtgcatgagtgtgggtatgcatgcctgtgctgctggtgagctgcaggaccaccatggaagggaagttagtaaaggaatgttgccctgggccaggcgcggtggctcatgcctgtaatcccagcattttgggatgctgaggccagccggcagatcacctgaggtcggaagttcaagatcagcctcaccaacatggagaaaccacgtctctaccaaatatacaaaaaaattagccaggcgtggtggcgcatgcctgtaatcccaccgttttggatggctgaggcctgcagatcacctgaggttggaagttcaagatcagcctgaccaagatggagaaaccccatctctatcaaaaatacaaaaaaattagccatgcgtggtggcgcatgcctgtaatcccagctactcgggaggctgaggcaggagaatggcttgaacccgggaggcagaggttgcgctgagccgagatgcgccattgcactccagcctgggcaacaagaccaaaactccgtctcaaaaaaaaaaaaaaagtttccctggtagagagcctcgttctgcagacctagaggctgtgctgattcttctgcaaagagacttccagtctcacttctgctccaataaactcacaggtcagtgagacagtgcataaacacaacctatcatacaggttagcaaaagaatctggctgactaaaagaattggtctataaagaaagtaaagctctggcctgcctggagataaagcccagcgcatcactaaaggaaacagagaagaaagagagaaagcaagcagtgcatatcaccaggaaccttcctgccaggaaaaagtgggtgggacagcagtagcaggcatcatgcttaaataacacggtaattattagctccatttatctacatacctccaaagcgagctctctgtgatgctccccaggttatagtcatagagctttgtcaaaatgagaatcacctgaaggcaaaagaagaaatcatggttagtctcaaacaattacaatctcttagaactgaaatggcccaagggagggcttaggattcctttaatagtcacttaacataattgaatgaattgttacagcatttgccacactgactggggaaaggttggcttgtctttctgccttccactgaattgcttaggcctatcctctccccagctttctccctgtcaccctgcagcaagggttacctgctcctgcaggcatttctttccctagtgggtttagcgcttttagggaaggctggcagagctgccaaatatgcacacaactcaggtactcactgagcagatgcctgggagaaaggaaggtcaatgattagtttccagccctagtagctgggtgcattgagcagattacccaatgtgcctagctaccatctttttgggagacagcaaagaattatttgaaagaatgtcagtatgctcatttattaagggggatgaacagtaatgctatctcccaaaagaattgctgtttgaagttaaattaggaaataaatacaaattacatatctattagcatgtggtttttttttgttttttttgtttttttttttggagatagagtttcgctcgctcgtgttgcccatactggagtgcagtggcacgatctcggctcactgcaacctctgcctcccaggttcaagcaattctcctgcctcagcctcccgagtagctgggattacagttgcccaccaccacgcccggctaattttttgcatttttagagatggggtttcgccatgttgggtaggctggtctcgaactcctgacctcaggtgatccacctgcctcagcctctcaaagtgctgggattacaggtgtgagccaccgcacctggcctagcataggattcttaaatgttaattccttccctttgctctatgtgagcttggttttaactttcttctgacttccaatttctaggaaagccattaaatagaagccacattggcagggctaaacgacagcattttaacgagcaaatctatttcatggggtccagataattaccgtgtaatatatttcttatggaaccctccataagaaacagagaaaatcaaaaattaggaacaggtctcaggaaagaagccgtagaattgtggaatgctaaatttaagctatattcgctccacagcaaatcctcctccgaaatagaaagcagcactatttccaactttacccagaggaacctaaactatttcattctttcagaattcaacgaacatttattaaacatttattaggagcccaggattttgtctgacgccagaagagaacacaaagaaaaacagattccgtctatgagtccgtgatccagttaggacagaagcgctcatgaaagaaaagggaagttgataaagagctatataccccttctcagtcacaccaaaacccttcccgttacagctgctccggaagacagcttcttttggtgtctgcagcaatgaacagagtccacctggttatttgaaatacatgagcccaagcacacttgcgaagattccacagagcagtgtgtgttcctaaccactgatttctccaccttttacttgctcttcttacataagggaaaaacattatgggtttgctcagttttctgtcgaagttcgtattttcctcctggtactcataacctagaacatttggcccagcccagctgtttccaactcagcagaaaaatgttgacattgatttcctgaattcttctctgaaggccaagggatcagttctagccacagtaagcatagaacattctaaccttaaattccggggctgtaagctgctgaggaatgctgagtccaagttccactctactagcacagcgtttgatttactgaaggcacaagcatcagtgaacacattcttaactttttaatttcacagcaagcaaactggaactccctgaccttaggtttgttctgagttcaaggaaaaaaaaattacagtaacttaaaaacaggcagagatccctgagtacctgtcatctaaggccgcccctctcctaaactacagcacagcttccttccttccaggtcctgttcaaaacttgcttctttagcaaaacgtgagcatgtgtgaggtgcggggcaccccatggacacatcagatggcatgcctgtggtgggggcatatgcttaacagatccatgtgccaattaagtcgctctcagtgctaaatttcaatcaccgccatcccaggaacgctgatcagtggcagcagggtggctgtttgtttgaagacacagaatgatgttcctactccacctcagtacaattttgccgaataagcctataaatcccccaccaagaaaataggggtgtgggcataaagcatttctaggtagttgctctcctgatacaagaccgcagtaaactaaataatgaagttcagctggtcacaggctgtgtctcccattcttgtgatgagggaattcaaaggtgccccggagaaggaaccctttaacccagcatgtgatggtgtggagccacttgcacaagcacacagaaattgtttaagcaatcccagggcaggcgggcagggaggtagaaaccgctccctgcctcttcttgcagggctagtaaaactgaaatgccagtgatacactcaggcagtttatcaacacagcaccagaagtagagtcctttatgacatttgaaagcatatctgcttgaatcaatctatttaatctttctgttttcagaacaagagcaagaaagaaggcacaactgctaacctttagttttcaatcgattatttgagatttctttttcttttttcccttcactgcctctgtgcattatttaccatcttattactgaacaacgatgcatccttatgttagatatgttttgctgtttgtttgcttttctgtgacagcaatactatttcacaaatcagtttctgttaagggatccagagccaaaatcactacatttaaatgagaaaatgtgaaaaaatgaaattgcctccctattctggttttattctctgttgtttttgttgtatttttcaaactcaaaatggggcaaaatgaagctgttttgtttgctttcgtttttgttttgagatgggagtctcgctctattgctcagtctggtctcaacttctgggctcaagggatcctcccactttaacctccttagtagctgggagtgaggtgcaggacactgcgtccagctttcagtggaacttttcaattaagtgaaatgttgtatgtgcttaaataatatacacataatttatttttattcattcagcacacaattttcatgtatagaaaaactgagttcaagtgtagagtattcaagttcaatcaaaaagcaaagctgttttgatgaacacatatacatctcaaaatgcatatgaacatatatacccccacacaaagtggcatatccatcagcaccccatttatttctgtatcttgttttcattatacagtgttaaaacatccctgattcaaaacaagtggtcacaatatggtactagctttttaaggttcctctctaaatcttaggatattatctttaaatagctatgacccaaattatctaagacttgataacctccacctatgccataccaggacctctgcatccagttatttctgggatttccacagtgacatgcttcaagtatccccctcgccagtctaggacttgctgtcagcacatgacatttgtacttctttcactgtgactccttcttgccacatctatcgcttacacaacttttgggaggaacttcacttggtccatacgttttctctttttctttttcttttttttttttgagatggaatctcgctctgtcgccaggctggagtgcagtggcgtgatctcggctcactgcaacctccgcctcacaggttcaagcaattctcctgcctcagcctcccgagtagctgagactacaggtgcgccaccacacccagctaatttttgtacttttagtagagatgggatttcaccatgttgaggagaatggtctcgatctcttgacctcgtgatccacctgactcagcctcccaaagtgctgggattacaggcgtgagccactgcgcccagccagtccatacttagagagaggatgccagtgcccactcaccaagctgctgttctcaaatcacccattccttggagggtagaagggtgccagaaacagtgccaggtcaggttctgtgcaggaatgggagagggtccaagggagtgggcaagggcttcttctcccacagcactgagccacattttcataacccgggctcccaaactattagtgaccctttgctcaggcccttacaaagctcctactgaataattccatcaactctagccctcactccttctggatagggagttgagaaaccatcacaaaggactctgtgagaggagaatgtcaattacattcctcccttctagccccaacctctttctgcactgggttacagaacaaaagcattcacaaacagatgctggtatatggatgactaataagactgttccactgtaaattaccaaaagtcagtgaaaaatattcttttgtatcaaaacagtagggcaaaaagccttatttacaggtatgcgttgaaatgaactaacctgccagcagcataagacaggcagtctctcctatgccaattatcagtcatgtaacacctttgactatgacagcatggttttattattaacataaaatataatttagaagtgaaactccaaacatttaaggaacctgagaacaccttcctggtaatctggttctacatacagcaacttttgaaaacttgtgtattaactaagtagtagatggtagagaaccaaaatttttctatgcttttctaaacagaagcacaggaattttccatttcttttcttaaaaacaaaaacatagcgtcttcctctcttcatttactaaagaattcaccccacagaaagtgcgatggaagtgaggcaggagactggaggaacttatttcctggtcctggcagggtgaaatgaagaaacctgcagaactagcagatgacagcaaaggcaatctctagttgccctcactgctctccttagcgtaagacactcccaccagtgccatgacagttgagaagttccatagcaacacctgcaagttaccactccttttctagagatttgtgaatagcccaccccataatttgcaagttattaaaagtgggtataaatattgctagcaaacagcccatacactgctactctgggctctgggttagccctgctctggaaggagttgccactctgctatacattgccacttaacaaacctgctttcttctaccatcagctcactcttgaattctttcctgagtgaagtcaagaaccctcccaagctaagccccaattgtggggttcacctgctttgcatcaggaggttgggggggtgtcagtggatttgtaaggatacttagcctgcctactgctcatccaaggatgtcttagaaaatggggacatatcagggctgggcgtggtggctcatgcctgtaatcccagcaatttgggaggccgaggcaggaggatcacctgaggtcgggagttcaagaccagcctgaccaacatggagaaaccccatctccattaaaaatagaaaattagcctggcatggtggtgcatgccttcatcccagctacttgggaggctgaggcagaattgcttgaacctgggaggtagaggttgtggtgagccaaatcgcaaaattgcactccagcctgggcaacaagagcaaaactccatctcaaaaaaaaaaaaaaaaaaaaagaaagaaaagaaaagaaaaagaaaatggggacatatctcttcactcttcaattaataataatttgcattcttgttttcctctatgtccaactgtggaagcagtatcaaatctcaaaagaaacaaaagtatgggcttaggattagagtacacaatcccaaaatgtcttccattccttatggtctatatttccaaatcctgaataatgtagatgatgactaggtcctagtctataaaacagcactatttcttttgtatttctctcaaccactagtgattcagggatggcatgggctggtgcttcgtgtaacacatgggaagactccacagcacttagccatactaatggtcataattgctcttgcctggggtgggccatagtctggcttgggtgagcaagggaacaaccatattgaagatgccagcatgttgggcggtgctgatgctggccacctttgtcctgctcccaccatcttacagcaggccttagtgttttttcattgtccaagctccgatagctacctctctgcttatttcagcagcttgctggagaccaattgtttagacgtatttacagatcctgaggaaagcaaatatgggggaagagaataataaggagcctgaagagatttggaataatctttcatgagaatcaaagagttggataaaataagagagcagtgttcaatggccagaatttttttttttttttttttttttttgagacagtcttgctctgtcgcccaggctggagtgcagtggcacgatctcggctcactgcaagctccgcctcccgggttcacgccattctcctgcctcagcctcccaagtagctgggactacaggcgcccaccaccacgcccggctaactttccgtatttttagtagagacagggtttcaccgtgttagccaggatggtctcgatctcctgaccttgtgatccgcccacctcggcctcccaaagtgctgggattacaggtgtgaggcaccgcacccggccagaaatttgtttttgattgttttcttggcactccaattttagggaaaagcagcaaactcacagcactagttttcttcaaaatatgcatgttccagattgtgtgtctttggctaagtatttatttgactttccaacttaaacagaggttctcattcttttggggacccaagaatcctttaagaatataatctgatacaacttatgggcataaaacaataaatataactttaataatattactcatctcttgaatcctgggggggggccatacatccaagaataagaacttccataattttcagaaaacaagagctttctttagaagaactttcagctccaaaattctgcagatttaatttaataaacatttattaagctttgttaaaaggcaataatttaaaaatacatgctgtgaggatacaaaacaaggaatgatatttgatatgagtctctgaaagctcagtcttaggagaggcagacccatacacaggtactcacgaaatatgaggaaaaaagatgtgaagcaggagggaagtgtttctatctttcaaggagcaagtaagagagatgtaatcaagagatatttcttagaaaaggatgcatttaagacaaatcccagaagatgagtgtgattctgataaagacgagaggtatacaaagggtactgcaaggaaaggaactgagggagaaagctcagagagcattaagaaaaggtcaagtcttctggtttacctaaaggttagagtatgagcagggacccaacacaatatcagaatacagagataggctttggcactattgtggaggaccttaaatattaggctggtagtgtgctctgctcaaaacagaaaaggctttggaaccagaagacgaccagattttgatttttaattaattattttttttataggcaaggccttactctgtcacccaggctagagtgcagtgatgcactcatagctcactgcagccttgaactcctgagctcaagtgatcctcctgcctcagtgtcctgggtggatgggactacaggcacacaccactatgcctggctaatattttattttattttattttattttaactttttgagatggagtctcaccttgtcacccaggctggagtgcagtggtgcgatcttggctcactgcaacctctgcctcccgggttcaagcgattctccttcttcagcctcccaagtagctgggactacaggtgcgtgccaccacacctggcaaattttttatatttttagtagagacggtgtttcactgtgttagtcaggatagtttcgatctcctgacctccttatctgcctgccttgccctcccaaagtgctgggattacaggcatgagccactgcaccaggcctaattttttttagatatagggtcttgctatgttgcctaggctggactctaactcctggcctgaaatgatcctcatgcctcagccccacaaagtgctgagattacaggtgtgagccaccatgcctggccaagaccagattttgagtcctggtttagccaccagatctagtagaatgccgtttgcagcaagaaacagaatgctaatagtgactcaagcaataagtggttcattatgtcatatagcaggaagtccagagtttacgcagttccaggactaatttagcccaacaatgtcatcaaggacctaagcaatgtccacgtgtcccctctgacagtgtcagcactcagtgctacttaccctcatgtttgcaaagtggtcataacacttcttttcatcacctgaagatgtggctatactcagcagagtaaagaaaggcctctggtgtatacatgggtttttgtggtttttgttgtatttttttctacctagggaagaaactctttcccaaaagccctgccggcaaaactccctttaccctcaccaaccaggatcctgccacatgcccacatgcagttcaataaagatggagaaaacaaggaactggtatttccacttgacattttctatgatcagaggtgggttctgccagcaaagaaagagtggggaatggctgctgagtagcaaatactagggtgtaccactgtgtgattttcagtaagtcgcctgagtcctgaactaacttgtagcgtctatttgatgtctactctgtgtgccagatatcataattaagaaatttcaattatctgattgttttatgatgatgaaattgagccacagagaagctaagtaagttaaattactaagccagtaatttgaagtctaagtcacatcacatatggaatcctaatccctgtgctaaactttcctctctggtatcctgtctaatatgggcatgatgattactagaggcaaggcagaaccactgaaatgccctcgctttctgttcatttcaaaaacatttattggagccctgttacctgtcagacatggtactagtcacaaacccttctctcactctgccttcttctagacattgctggaatatattttcctgatcatagacatgcttgagtttttactctttactgacctcaagtcaatggcattttgtggtcattttaaaatttaattattacgttttttaaagttttgaaccctggtaaaatcctcttcaggaactgatccttccatttaaattactggagaacttggctgctgccggatcaggggttcctgacagcgaatgcacatgcagctaactgcagatttccacagatggttttacagtatcatcatttagatttaagtgaatgcataattacactctttttgagttatcaaaggggaaagaaatcaataatggctaagctggatcaaggtgctccagaggagagttgaaagggtgatagaaatacatatgcacgcacacaccacacacactcacacactaacatgtgaagtcaacagacaaaagtaatctggtctagacaaacatacttgacgaaatgaaaaaatggtagaaacagtggactaatttggggtacaagaaagcatccagaaagcagttagtggatttttgcctctgaaaagtatttaatccctaaatgccctttatattttgtagcagcccacacataatttaatgtcatgtttatttatgtaaaatcctctgcatggcactgaaattgagtgaaacagccactgcataccccttgaggaaattaaaaggcaagccaaccaacagtgttgcagacagagctagggacatacagataaccgaatcaacattagacacagcaaattgtagcacatggagagccctcgtgaagagcaaaaaactttttgtaaatttgctataccctcctgactctgtttctccacagagccagaggtcatttgtagctaagacataaaatctgcacctgagttgcaggactcttcctgtgccaggagctgccatgtgagaaatactgcagctctcactcaagggaactcatgggttttctccctttgctgaaagctaagttccttcctgctagtaacaaacccaaaaaataaaaataaaaataaaaaataagcttataataaggttaaaccaaactatcagactctagtcatagagtcaggtctttatattcagtaaataaaactaaacttgtcaaatccactagacttaagttgctttttgatgcaaatcttgaaaataggggacacatttaacctttgacaggttcttctatttcccaagttcagagatgctatccactcaaaaaaaaaaaaaatgcactccctccaaaatctattaatttcacattgccaaaccagagagtctgaggacacttgtcttgtttcctcccctgccacctccttctcccgttctttattttgaataataaaaagagcataattctcaaaatatatatccatatataatacatagctgaccactgcatattcttcttcctcttggtaaattattctgccttaaatgattttgactttttttttacattaaaccaggaaaataagggagatgctaaattaaatattttttctagaaaaaaaccaaatagctgcaccaatgtaatcccaaaagagtagcaagatgagataattatacaaaatgtgaggaaaatgcatattcaagacaagatctttctacatatggatagtaaaatagaaaaatgaaacaggcctacagacccaaagccaaggcttcaagacctgaaattaactggggccagggaatagggggagaagctggcaacttagcatggttgtctccagagctgcagttggaggaaaccacgtagcatatcttgcgcaagcccattgttttatagttaaagaaacaagcgataaatcctgttctcattcccctccagtgcttagaaggggagagagattatattcaaccttctttaagctagtacctactcaaattagctcacctgatacacagctgctcaaacacagaaaatgcacagaattctcagtttagagctgtaaaacaataaggaaatatttattgtattatcttctctctgaaagtctattaaaaaaaaaaagacaaaaaatgccgggtgtggtggctcacgcctgtaatcccagcgctttgggaggccgaggcaggcggatcatgaggtcaggaaatcgagaccatcctggctaacacggtgaaaccccgtctctactaaagaaaaaaaaaaaaaaagttagctgggcgtggtggcgggtgcctgtagtcccagttactcgggaggctgaggcaggagaatggcgtgaacccaggaggcggagcttgcagtgagccgagatcgcgccactgcactccagcctgggcgacagcgagacttcgtctcaaaaaaaaaaagagaaaagatgtaccaatacttaagagggatacaacccaggttttgtaggagcgagatggaagggaagtaagagctggagaaattctcttccaacttccctgatgtgatgatctgagaaagacagatttccatgctctcaaatcagtatctgtctgaattatagacactatctaaatattaatattctttctatgtgagaacccacacacaaagtgaacacactattaagcagcaaactgtgtgttaacgatgaggggcccttctgttcctatgcctttatatatttagcttcaacaggaagaaatgaagcaagtctttccatttccacttcgccatcttgtttttttatgctgtttattcacaggtctgaagaagtcaactcaattctaaaaagtattatttttcaaggttaacacaagacacttgcaggaagccaataaataatgctatgcatattactgtgttccaagtgtcagaacataaacctcaataagaaactggaataaaaactgaaaagaatgcaagcttttaactttttttttcattatctcctctcatttaccataaagtacaactaacaaaagcaacaagaataaaacaccagagagagtcaataagcaagtatcagatcttatcttttactatgggaaagtcttaatgtaggcaagggaggaagaaaaacattttactctcttaagaaattatagtcaatcaacaataacaactgacttctctattagcagatcttttgtttgccttgtctgagtgctaaggtgtggtgagacacaatttgcctaaaaggaaattcaaaacttaaaaaaaatctggcttgaaactaaaatttaggtaacatcttaaaattccaagtaaaatgtattaataaagaacaagactttctgttagggaaaaatcccacggaggttaagtgatttttatatattccttgtcttttagtcacagaaccaaaatgtttccatgtgattctagttctaattctttacaatggcatggctagtgggtgggtataaaaatttagcattttgttactcttttaaaagaaacttaaaattggaagggactggaaagattatctaactccatctaactccaaccacctcatttcacaaatagtgtaggttatacttttagaagaaccagttcctgaataaggaatatctgagagcaaaaaataatcttaatatatcatttgctgattttgtccctgaagcaggcctaggtacagaaggaaggactggattgggccagttctgagatggaagagttgaaagaagtagatctaggaccaggactagacccaggttttgtggggatgaaagttattcaatgttgagcttctctttaagaaaaataatacaaagtcataaagaaaacgagatctaaaacttcatatttactagcccaagaaattagatcacaagaaattaatagtgccttagagatagacatacgtttgttctgagatatgttcaggtggtttagcggaaatgagtatacagaaatgctttccgattccaccctggcttcctctctccacctggaacaatcgacacctcctcaaactcccagcattcaaaggagccagtgcccatgaaggctctgaatcttaagcttcattagcttcactgtaaattcaccttcagataggactccccattagatgctcattaagccttttcaatgaaactatccattttagcagtcctaggctatgaatcaggagatatggacctgagcccaggctccgctgccaatactctgtgacactaagaaagtcaatatactctatggccataccaccctgaacgcgtccgttctcgtctgatctcggaagctaagcacggtcgggcctggttagtacttggatgggagaaagtcaatttacttctttgggcttcagtttcctctatggctgcactacacgtttgcaagggtctcttccgattacaataccattcaatgcggaataccttggcctactctatcttcagtgttgccagtcttagtaggtactattgtcattgttcaaactaagaattctgagtagtcttccttgactctattatccccttcttccctccaaatgtaaccaacatctctttttttttttttttttttgagatggagtttcactcttgtctcccaggctggagtgcagtggcgtgatccctgcccactgcaaccaccaccttctgggttcaagcgattctcctgcctcagcctccagagtagctgggattacagatacgcaccaccacgcccggctaattttttaaattttagtagagatgacagggtttcgccatgttggccaggctggtcttggactcctgatctcaggtgatttgcccgccttggcctcccaaggtgctgggattacaggcatgagccaccacacccaaccagtctctaaggtttatatacctctcccatctaacctcacctcaacctgatctgggctacatcaaccaaaagaccgcaatgcttctgacaactctttttattttttttattttttgagactgagttttgctcttgttgcccaggctggagtgcaatggcgtgaccccagctcactgcagcctccaactcccaggttcaagcaattctcctgactcagcctcccaagtagctgggattacaggcacccgccaccatgcacagctaatttttttttttttttttttttttcagtagagatggggtttcaccatgttggccagggtcatctcaaactcctgacctcaggtggtctacctgcctcagccttccaaagtgctgggattacaggtgtgagccaccatgaccggcctgcttccaacaacttttacagcatcttatcttgctttcctcaggtcaccctttacactgttgccaccacgatattttaaaaaatagcagtctaaacatctttccacactccttaaaacatgtctgtagcctctcactgatcttaaagtttaaatttcaaaatatgacctctaagtaagaatggcctggctcctgtgctcatgttcaaatcagcatcacgccagtgccccatatcctctcagaattccatgtgaactaatatgtaatatcctcttgctgacctaaggaattccagtatttgtggatcgtctgactgaatgactgtggttatattgatgatggacttttccaggcattaacaacatgtttcagttacatgagcaattattgtaactagcctcttgagttgagtcacatcagaataccctgagaaattgcaatctaccagcattgccattttatcaaattccaattttaggaatgacattccaaatactttgaatttcctcttgaaagcttaggctgattaaaggattaaatgttacacataattcaatgctgtgtaactcttttgtgagggctgagtagttgtaaaacatgtctatgatctaatccaaaggtttattgattttcctgttctttcgttcaagagtgttagctttcatgcacagctctgtgggatttttgaaggttggccaggacactgcagagatccactttccattctgtcagtttcttctatctaggaaaagacagccctgggtcagtgcaaatataacagggtgcagattttgaatcaaagtctgaattccagatttttcagctatttcctctgagactctcaaaatctcttcttctgtgtaataggagcaaggccaaatagagtatgtatggtggcagggtgagggctaatgcaagaggttgaaagggctggattctggttacagagccaattttaacactttgtatgactttagttaattcatttaacctgtttttattattaaaggggactgataaaattagaaatccccaggccaggcacggtggttcatgcctgtaatcaatcacgcctgtaatcccagcactttgagaagctgaggcaggtggatcaccagaggtcaggagtttgagaccagtctgaccaatatggtgaaaccctgtctctactaaaaatacaaaaattagccgggcatggtggcatgcacctgcaatcccagctactcaggaggctgaggaggagaatcacttgaacctaggaggcagaggttgcagtgagctgtgatcgcaccactacactccagcctgggtgacagagcgagactctgtctcaaaaaaaaaaaaaaaaaaaattagaattccccttctaactggattatcactaattgactttatttttgatttgtgtcattctcctaagcattctgaataacataatctatccttctcaactatcctttacagcaatatgtcttacctttcttctttttttttttggccgtaaagtttgagtgacttgcccaagatcagctaggtgggggggctgagatttgaatctgaacagtctgagtccaaagctcagtgccgtagacaagagtaaacagacacctgctctcattacccatcatagctgtgtagagactcaccaagctgaaaggtttgagttgaatgctttagagatgaattactatgggaataaagagaaggggacaatctctagctagatgcaggtagggaccttttcaatctcttacaaccagctaggtgcttcacacacagtatgtcatttaatccattctatagcaatggggagatgttttttgttgctctcttacagaagatgaaaactggctggggcttgggtagtatgtatttaatcctggatcttcttggcttctgatctggaagtacggccttgaaggatggcttgtgctagctcttctaccattgaggctgaggggtcatctttgtatcacattcactgagatctccgtggattccacgggcagagagcacaaacccttgctcgaccctcagcaggtataaaacatgaaggggtcatgttcagaaaagaggagtgaagcttctcaagaatttacaacaagaccatctgtcttctcctctgctcagggaagactttcctaaactgaaaatcactccaatgtccccagttcaaagaaaggagatttccagtaaagaaggttaaggaaggctagaaacaaatgatacctctattccaagtgggaactctgttgcaggaatgggtaagtatgtccctgctgcttctctcactttataatcccttaatccaaaatcaagacaccagtgaaatttagaaacccaacaccctgtctgctccagaaaatgcaaatctcccaggaaagaatccacttgtttcctggccttgtgacaaggcttggggccattgtgaatcactctctgccaagaaaaagagccactgttcacaacatggaataagactgcaagggggtcttgtaggtgactcacagagcccctgggggcaggagagacaagcatgtctgctagaactgctgctgctggcggctctagaaaaaaaaaatctattttcttgaaaattgaacctctcctttaggtttccttccatttttttcccccttaaatcgtccaagattaatgtggcaaaaataaaatgccccacaggctgctcattttgacacttactacagcacataaaagtgaagaattagcatggaatgaataatttatttagtgttttacgttgttttaaacaaatcacttccatgaaagcaatgtgtattcaagcaataaatcactgtttagcattctgtcaggaggaaagataccacttggcagaattattgaatggcagtgcctggcagggaggcaggcacaataaagataaaggtgatgtccttgcaaaacaggaatttgtttggatctggagtaggatagggtggagtgagagtcagtcatgaggctttttcttccatttacaagggttaaatgagcacctacttgtgctactacatttgatgttatgactagcacagggtaacttgctatgacatcatagctactgttatttattttatgattgcaattactgtggccaaacatggggcctaagtgatggggatattccattgcaacaaaacaatgagttctatgctcttaaattgatccttggggtcttcagacaactttatataatgtgataagtattatgatagaagtgtatgcaaaatgcctagtagggagacgggaatctggaaaggttttataaagatggtttcactgtatccaggcctatttagccaaaaggctggaaaatgtgaagcatgttcaatacagaaggctttgtgagaccagaggaatgcaaatgtgaagcccagtgatgtttgggtggagagtgaatatggtgatgtggtacaactcagtgatggggaggatggcactgagagaagggtggcaggagaagcttaacaagagatccacaaggatgcagggtgaccttcacacgctctagaggctgtggcccctggataaattggccctagacaccagaaaccaaaaccagattcagtctccaaagcaagggtttgaagctattacttatcagccctgctaattaccaaccctgtctgcagcagaactacagtaggagaaactggctcaggtcaaaagaaagaaggaccctggtactcttcttaaaatcaagtcaaaggtagagctgctctattatcccagctttacgcagttttgagaatgaaaatgcaatccaaggttttgttaagggcggaaacaaaacagttccttgggagctaaactacctcacatgacaaatctcaaaatgtctctactttttaaattgtcaatgccacaaacaaaacctgaggtctaacattcacatcagcaatgcctgcagccctccatcactcctggcaactcctgacagttagtgcaggctgataattcctaccgcttacaacacagaaggccaaaggcttgggttttacacatctggaggaaaagcaaaaccctcccattctgtcaactacttcagggagtttctcaattatctaatttccatctgatttaaataataatagtaacagcatgcttccctcagagtttagagatccaaaatttcccaaccttaccttaaatggtttaaatgagaacaaacttccagtttcttttaggtagtttcaactttgccaacattttgctgaaagctgaaaacaacacttctggctactagaatgaaggtgacaggcactgagaaatgtcatgaatctgacgcttctcatcaccttaaccatatttgctgctttttaaaaaactgtgttggtgtcagcattttatcgggctcagagaaaactcaaaatgctgttggctacaagccagccagaaatgcttcacccttgggaagaaatgaatcaaggaacaactaactattgaaggtttactatgttcaaggaagagctggtagaccctgagggagaaaaagaaatgcacaaaatgtaatttctgccatgcagtaatttacagtctaggtagaatctgattgtcactctcctcttcagaaacactgaaggttcccttgcctacaggattaactcctgattcttcaataagacatccaaagtcctttctatatagcacatatttcctttctggttgtgtctgctgccacttcttgcaattctgcaatcctgtaatactgaccttcttgctcttctttgaaccacaatgaatgttcaggcccccagagctttctcaatttccaatacacagttaaaaggccatctcctggctgggcatggtggctcacacctgtaatcccagcactttgggaggccgaggtgggtggatcacctgaggtcaggagttcaagaccagcctggccaacgtggtgaaactccgtctctactaacaatacaaaaattggcgggcagtggtggcgcacctgtaatcccagctactcaggaggctgaggcagaagaattgcttgaacccgggaggcagaggtttcagtgagccgagatcatgcgatagtactccagcctggactctgtctcaaaaaaaaaaaaaaaaaagccatctcctccatgaagccttcccaacctcttttgacagggaaatctgttgcttcatctgttttttttttttttaattttcagttctggaatacatgtgcagaacatgcaggtttgctacataggtatatatgtgccatggtggtttgctgcacctatcaactcatcatctaggtttttttgttttttttttttttttgagacggagtctcgctctgtcacccagactggagtgcagctgcgcgatttcggctcactgcaagctccgcctcccgggttcacgccattctcctgccttagcctcccgagtagctgggactacagaagcccgccaccacacccggctaattttttgtatttttagtagagatggggtttcaccgtgttagctaggatggtctcgatctcctgacctcatgatccgcccaccttggcctcccaaagtgctgggattacaggcgtgagccaccgcgcccggctgccatcatctaggttttaagccgcacatgcattaggtatttgtcctaatgctctccttccccttgcctctcacccccaattggctccggtgtgtgttgttcccctccctgtgtctatgtgttctctttgtttaactcccacttatgagtgagaacatgtggtgtttggttttctgttcctgtgtttgctgaggatgatggcttccagctttatctgtgtccctgtaaaggacatgatctcattctcttttatggctgcatagtattccatggtgtatatgtaccacattttgtttatccagtcaatcattgatgggcatttgggttggttccatgtctttgctattgcaaacagtgctgcaataaacatacatgtgcatgtgtctttatagtagaatgatttatattcctttgcgtatatacccagtaacaagattgctgggccaaattatttctggtttctagatccctgaggaatcaccacactgttttccacaatgggtgagcgaatttacactcccaccaacagtataaaagcgttcctatttctccacagccttgctagcatctattgtctcctgactttttaataatcgccattctaactggcatgagatggtatcccattgtggtttggatttgcatttctctaatgatccatgatgatgagctttttttcatatttggccgcataaatgtcttcttttgagaagtgtctgctcatatcctttgcccactttttgatggggttgttttattcttgtaaatttgtttaagttccttgtagattctggatattagaattttgtcagatgggtcgattgcaaaaattttctcccattcttaggttgtctgttcatcagtgaacagacaatcatctgtgcttctttagtatcatgcttctattatgactgaagcaaattacttctattatttgtttaacctgtgtcattcattggatttttttttttttttttaatttgttcccgctgaattttgttttgtttttataatttcttgtgctaggacagcacctgacataaagaaagcaccagtatattttcagtgtattactgacaattacacaatatacaaatatgcatcttttaaatatgagccaatatgggacaaatgagattatttgtgctggaataccagcaaccttgacacatagtacggcttcgataaataatttgtttagtccaaatcataaatgtctactaaatatcataaagaatgttgaactgcaaattgctttgcaaaatggtagcacattcccaaaatgtcagagttcgagtgcgcatgatatgtttgtggttcatcattttttttgagatggagttttgctcttgttgcccaagctggagtgcaaggcacgatctcggctcactacaacctctgcctcctgggttcaagcgattctcctgcctcagcctcctgagtagctgggattataggcacccaccatcacatccggctgttgttttgtatttttagtagagacagggtttcaccatgttggccaggctagtcgcgaacccctgacctcaggttatccacccacctcggcctcccacagtgctgcaattacaggtgtaagccaccatgcctggcctgtggttaatcattttaaccagcctggtgggagatcagaatgatgttagaaaatatgactgaaaagatagaggatggcctttgtgagtggtctctaattccagactaagaaatccctaggagtctttatgtgtataataaagtatggaaaacgattatagatttttgagcacagaggtgacacatacagtactagaaatacaaagtttaatctgacagccatgtaaggagcggattagcaagtattaaagtttttcttaaaagactaaatagtggccgggcatggtagctcacgcctgtaatcccagcactttgggaggccgaggcaggcagatcatgaggtcaggagtttgagaccagcctgaccaacatggtgaaaccccgtctctgctaaaaatacaaaaattagccaggtgtggtggcgtgcacccgtaatcccagctactcaggaggctgaggcaggagaatcccttgaacccaggaggcggaggtagcagtgagctgagatagtgccactgcactccagcctgggcgacagaatgagactccatctcaaaaaaaaaaaaaaagactaaatagtaagtatttttggtttgtggaccacaagatgtttgtcattacttctcaatgctgcagttgtatcacaaaagcagctatagacaatatgtcaacaaatcggcatggctatgttccaagaaaactttatttacaaaacaggcaatgagccagatttgtctctcaggctgtagtttgccaactcctggtctagagacataagtggtagagaagacatttaagagtctatttaaatgtactggtataaaattttggaggcttggcccagggtggtgggagttgaaatggagccaaaaaagaaaagttgttccaggaaaaaagagggtgaataattgcatactttataggaaaaggtaagagaatgaacaatatctttttatggttttaaacaaagagaactgggagcataaaggcacctttgacaggcaaggtcttcttagttacccactccagaaaaacttccttaggaagtttgtaagacagtaattaaaaaagatatgcatgtggaacccagagtcaagataatcacagaattctagagaattctggtgctacagggggatttagagattatttagttcattttatattgtatcagatgaactgaccagcaaacaacagtggcctcaaatcatgtttggtttgtcctacaaattattagccctcagtatgtttctaaaataaagtggctcagttctcagcattgaaaaatatcagactggagtttttgcttctctaaaaaaacaaaaacaaacaaacaaacaaaaaacaaaaaaaaaactggaagatctggaggtactgcgcttatcttcccacataacaaaattagctggaagagtgtggcagctacctgctgcttgaaggatatgggctctccattcagtcacaggagccctctgccatcactcgtgtggccctctcaggcatttaagtttgtttaggctgatttcaatgaatacgctatggagtcagactgccaggctggtgccctcactctgccactgtgggaggtaacttaacctctagatgctccagtttcctcatcatgaaggtatagaacattgtcagctcctacctcattggattacgatgataatcaagtgaaatactgtatgtgaagcccagccacatggtagtccttcaaatgttagatattgtgattatcatcattatggtgaatgaaagctttttaaaaagttaaataaattgcccaagtccacattggcagttggtggcagaaccaaagactctagagcaatttccaaaaccctgagcatattccaccacaaatacattgaggattatttgtaaaatctaacaaatgcatgccctgaaccaagaaggaaaacaaacaaaaaaagcaaatcagagatgatgttgggccaatgtgtctaaccatttccatgggttatgcccaaacgtagcacattggaacaaacatgtaataattgtatgcctgtgatctactttttttgccaaagctacataaaggaattataaacatttattctaccactggtaacagtaaaaaccaggccacatgttaaaccaagtttgatgacttttagttgccttctatcttggagaacaatagtaggtagaaatactggcaaaaataccctggagcaactctgtcctgtttataaattctcagtccctgcctgtttcaaaagtggaggagaaaaagtgctaagtcgaccaactttcactaattagttatttctattaggtgactgcaaatcaatgacaagcaaacttctcataccttcaccctggcttagaaatttttctgccactcaccatctatcactctgcctgtaagtggccttgctgagctctgtctaaatagcatccagtgctcctgttatacatatttcctcttttccgcagcctacaagaaaatatgctggtggtagctgtttgtaatatgctgaaagctttataagaccaactgtaatgcaaaggtcatattttctaagctttatagattgcaatttgtaaggttataatgtcacatgctgtcaataattcaaagtggagaattataactgttaacaggtcatcaattcttcattcttctccttcaacactcattccccagggggctttaatttatttcgtttaagcttgattccttgaactttgaactgaaggtttcatttgtttatgaggaaaaaaaaaaacaactgggtgacacaatgcaagcaattccttaagtttcaagggatctgaaccaataaaaagatcacaatttagataggaatgactcagaaagtctattttccaggagtgtagtgttatagaaaatgtgtttaggttgtcagtatgcaagaagcttaacacttacccctccctccagataaataaataaatacaacaggaaggaaatgttgctgaaaacactgaatactgaaagctaaaggagtttcaatctgtttgcaagaatgcatttgtggtaattgtctgccaccaggagtctgtccaaatgctttctttgggagagtaattaaatctgaattctagtgcaattgtgagtgctgagcttgttgcacctggctcttttttgaggttaaaaacttttttgagtgtctgatgagagctatggatgcgacatacaccacttctaataaacaccaactacaaacaaaatgctgggacaactttctaaagttcatttatttaactctaggtaaagaacttcaattataaagatgcagattatctttctcatacaaccaacattctttcaaaatagagcacagaggcagatgatgtaatcacttcccttgggtacttataatctcagaggactcaaaagaataactgcatttttcatctttgaggattttttttctcgtctccaacaatagcctgaggcatactaaaaaatggccgtgctcaggaaaataaccaatatccaaaagaagaaagcaggacaaggctcctcatcacattgccaaggagcatataacagactgttttgttgtttgttcttcctgtccctctttcctgtgaatgtcctcccaactactcgatgctcctggtgtctattagggtttgaagtcttcatggatctcctaagagaagcccacgaaatagtgcaagcacaaaacatccattgcgggttcctgagtttctgaccccaacacccattcaaacatattgactttcattgtttttgtggagttccaagttccaggtcaccaagaatcaggcatccatacattagccgaggcacagtaattatttctgttaaggatttaggtacctaggagttctcaggtataatttaaaaaattggaacgtagtcttcgattagattgtgtagaaaaggttgaattagatcctttaaccacaagataggccattactgaaatttagtcaaagaaaatataatctttagactcaaccaagacttgatgcctatgattttcactgtgctgacttgtaaggataatattaatttgtatgtgtgtgtatatacatatagctaagtaaatattgacatacagaaattgctaacaaaattgtacttctgccttccatggtaaggatcatactttttcaacatactgtatattcattagccaagacagcttagcttgagatttcacagtatgttagtccgtgaaatgcagaaatgtaaacagagaactgtgcccagtttcaaggatgacaagctggtttagattttaagggggagtagggggcacatgtctttcaccaaactattaccatttccagaaatctattcgaactcaacatttaagaacaatatcttttcaaggcattcaaccgttaagacaaactctgttgccttgtttttcttacggatttgactttgccctcagttccttaaaggaatcactattacaggtaaaagatacagccaggatgattaagtatactagaaataacaaagctttggcttgctggctgcagtttactaaaactgcattccaacattatcagaatattagcagtttaaaattcacccattaatatgttgctcccctagtgttaatttctaagaataggaaaataaccaaataaagaacacctgattagtcctgaaggcagcctattgagagctttttgataccagagatcttactatattcaccttatatcacaagtgcctagcttcctggcacagagatttaataactgttgatcaaatgaatgatataccaaaggtgcttaaaaaaaaagacatgcaaatgagtgatttttaaatatttattttggcatcaatatacagtttatttcctcattatctcagaggaggttatatatatatatatttctataaatatatatacatctctatatatacacatatttctatatataaatatacatatttctctatatatacatatttctatatataaatatatatacatatttctatatataaatatacatatacatatttctatatataaatatacatatacatatttctattcttagaaattaacactagggaagcaacatattaatgggtaaatttaaaactgataatattctgatatatatatagttgcttgtattatttacagttacactctagtattattttcttatatactttacctcataggtagtagacaacctaatgtgtagaattctaaaatcagaggaaatcattcttctctttccacaggacaatgaggaccctatcagccttgcttttattctgtgatacaataattgaagagtcagctatctaagtaagaagtgcttcctatttcccaaggagctatttgtcttttcttcactattagaggtcccgtaagcaacactgcccatggtctctgaaaccagattttgcccctattttgtagccaggaatagtagccaggaacactaaggaatagtgttccctggtaaagatttaagttcaaacatacgctgccatctctgtgtctgattttactacaaaacactaaattgaagaacttaacacggaagagcagcaccagcaaaactggagcctaaatcacctaaaccgtagcaattgtgggaaattttctagcaggaggaccaaacagcataattcttgttacctttaagttgtctagggccttaatggcaacttgtaaaggtcatatctaacttggtattcagaagtagggtgataattaataagaaagctggtgaaatattttaaagaaaagccagttattaaaaaattgtaaatgcaggaactaatggcttttaccaattcctgggttaatggaagttaacaatacacgttatgtatcacaggacttgaaccacatattttaaaaggctgacatattttagtcaattataaaagggaaccataaagacaaggacgtcctactgaagtattatctcaataatcagaaagtcggattttaggaagatagcatggcatcttatgggtaagagtgattagtttatattttttacatatttcccacggacacaagcttatttactcacaaggaaattgcccaacagatgtctaaagcatttctgattcctttgcaagactttagacagagctaaacttaatttctcagaaattaaatagtgatttccatttttttttttttttttgagacagagttttgctctgtcatccaggctagagtgcagtggtgcgatctcggctcactgcaagctccacctcccgggttcacaccattctcctgcctcagcctcctgagtagctgggactacaggtgccctccaccacgcccagctaattttttgcatttttagtagagatggggtttcaccgtgttagccaggatggtctttatctcctgacctcgtgatccgcccacctgggtctcccaaagggctgggattacaggcatgagccactgcacctggcctaccattcttaattgtaaaagttactattatcaccaccattcatgtggtagtaaagagcatgaaattaaattttatctttatagacacacacttttatacttatttcacagctgatttcaatcctgaaacctcatggacacaggaatatgatgaaaacattagtaaacatgaaccaccttctcattaagttgttgaaaaatatagggcaagcaggccgggtgccgtggctcatgcctgtaatcccagcactttgggaggctgaggtggccggatcacctgaggtcagaagttccacatcagcctgaccaacacggtgaaaccccgtctctactgaaattacaaaatcagctgggcatggtggtgcacacctgtaatcccagctactcaggaggctgaggaaggagaatcgcttgaacctgggaggtggaagttgcagtgagccaagatcacatcactgcactccagccagggcaacaagagcgaaactccatctcaaaatgaatacataaataaataaaaaataaataaaatagggtgagcaaatcatgtagtcatagttctgtgattgccatgcatatcctccaatgacttttgagtggaaacattacatgaaatacgttataaaccaagttgaagttgatttgaaattacgaagtgtattttttctcttataaaatatatccttatgtcttatgctacatagaaaacccagaattacgcttaaaggcactctaaatgccttgaagaaaagaatggaaataggaaaggaaatgaatgtctacagagtgtcagctatgttcaagacaacacgtgaagtctattcatgtactattatttcacttaagctttttttttttttttttgagatagtctcaccctgtcaccaggttggagtgcagtggcacgatcttggctcactgcagcctctaacttcccgggttcaagcgattctcctgcctcagcttcccgagtagctgggattacaggcgcccaccaccacacccagccaatttttgtatttttagtagagacggggtttcaccatgttggccaggatggtctccatctcctgacctcatgatcctcctgccttggtctcccaaagtgctgggattacaggtatcagccaccgagcctggactcatttaagctttcacaacagccctatggttattggcaatcttatagatgatgaatatgtgacacagagtacccctttccccaagggttcagtcattaagtgtaagatacaggacccaatccttgtctatctcttcatagatctagtaagctccttccacatgcttgtgttctagtggtgatcatgatgtaacaattaaaagttaagaatcaacctcatattaggtgatagtcatgtcagaaatgaattgtggaacaatgaatactatgttttagcagtttacgatatggctaaatgtgggttcctgtatatctatcttaaatgagttaagttttttgaaaacaaatttggaaacttttaacatatacatgatatatatgtacatacagcatgtatattcatatatgtataacctatatatacacatacatatgtacagcaaatatatatacaaacacacgtgtaaaaaaatgataaaaatccccaaatttggtttaaaaaacttacatatttaagaagctcaacagctcaacaaacccaaagtaggctagatataaaggaaaccatacttagccataccatagtcaaactgctaaaatattcattatttccataatttattttagacaagactgttacctaatatgaagttgattcttaagaatatatatacaaccgtgtgtgtgtgtgtgtgtgtgtgtgtgtgtgtgtgtgtctgtgagtgtgtaacttttttataccccatctctctctttcctcactggtactctatgtacacagattgtaaattgcttgatatttttctcacaggtactaaagctctgcttattttttgagacttattctttctttttcctcagattggataatttctattcgtctacaagtttaatgacctttccttacacagtctccactctgtccattcaataaatattttcattttagatcgtatgttttcacttctggaatttttattttgcttttttcatgagagttgccacttctcttctgtgacccccatctattctctcatctttttctttaagcccttaaacatatttgcaatagttgctttaagtctttgctgttagctctaacaactgggctatcttcaggttggtttctcttggctacttttttccttgacaatgggtaacattttccactttctctgtatgactagtaatttttgattgttcatcgaaccttacggatgatgttgcagggaactggatcttttcttcttctgaataattttttcactcctaataggcttttaaaaaattactggctgataacctggaacatgcagaggcttagctttacattttctttggatgagactctttggattttcacttaggcttctggaaaattcctttattctggtacatagtctttatttgtaaagtgtgttttcatggaaggctcagctacttactaagctcctctaagatggcagaattcaaactccaaagtctgtttcccctgcagtgatcagaaactgaaatcctctctcagctctttcagtcttgacagtagtttctacctgctccttagaattcaggaatcagcaagtatttcactcagattttgaggctctaacttccatggcttcttcattcttgggacttctccacaatctctagctactctggaagccccacgttctacccatggacacctgtgtgcagcagctctcttcttggcgcatagccacccaatgccttacggaccgggcagtgccctcaggggagaaactgtataaacatagttcccgcctactgaggttctcctctttcatggattaaaacccattcagtttctgtctgttgctgatccctctccagtgccctcaaagatttttttcttcttcctcagaatttataattattacctgcagaaaacctggtaataagctgttccactatcactctggggctccttcttaaaataacaaccctgtctttttcaagttctgtctactttcttaaccctattttaaataagataataatttttattatattacaaaatcacttgttcacttatgtcctaggaagatttttcttttcttttctgaatttatccaaggtgaattccctcagggccaactttaacaaaaattgataaaaacagaaatatactgaccctgttatagtaaaggccatttcaccagactcatcttcctctctctcactatattacagaagaatataggaagctatcaatctgccatttctttccatgccctgtgacttttctgtattgtgaccaattaagccatcaacagaagtagtgggaaaggcagacgttgatcgctagctcacctgccaactttggacagcatctttattctatagagtcatgccatactcacttccacctggggagcaaaggaatctagccacttacttccaagttctaaaacgttggtggctttaaaattgttattttttcagatgtgtaacagaggaaggacagcattcatatatcagctgataagaaggctggtggatgaaaaatatattatctctcactaccactggctaaggtaagactgcttaacattagttggaattagagggttgagaattacagcagtctctcagttggacgtcttagcgtctgaaaaaatctgcctccttctggaaagaatcccttatccaggaagctactgggtcaaaaagtgagtaaatattcttactttttttttttagaattctgcaagaaggtcaccttttaaggctaatgtgggacagctcctagaaatcttttgactgcctttccagaattatacactcgcaggatgcctgggaattggcagagtaggaaaaatgcattaatatttaacactcatatagcactataaatggttgcaatgctctacaataaataaaaaatcaggtctcaaaatgtgactttttaacacaattgtaacactgaaatattttcagaatttgtaataaactcccaggggaaaaagccagaagtcccatcacttaaaactatagtatactaagcaaagtggtagagaatattctataaaatagaatcttgtactgatgagacaaggatcaaacgtccctaggaggggcttttttcctctaatgtaaatggtgttagaatactgcaagtgcctcccaggcacggtggctcacacccgtaatcccagcactttgagaggctgaggcaggcagatcacaaggtcaggagtttgagaccagcttgaccaacatagtgcaaccctgcctctactaaaaatacaaaaaaaaaaaaaaaattagctggtcgtggtggtgggtacctgtaatctcagctactcaggaggctgaggcaggaaaatcgcttgaacccaggaggcagagaatgaggtgagctgagactgcatcaccacactccagcctgggtgtcagtgaaaggctccacctcagaaaaaaaaaaaaaaaaaaaaaaaaaagaatactccaatgcctttcctaaaatttccttcgaggctgtctatctcccttggtagtaccttgattctgccaggtccactaacagcagtaaacttgatgtatgggaacttaactctcactccttttctctactagccatcttcaagcatgatctgttccttgtttccattcagcagggcacttttgacactttaaggtccactcacaatgtagttttcccagcagtctttctactttctaatcctcatcctctcccccttcttgcatagggctttctggttgcagcaacaggcactgtgtcccttcatttatatacatttatataaaccattccaaagcagaacttctctttatatactcatattttttctgtttttttttgttttttttttttttttttttttctgagatggagtctcactctgtcgcccaggctggagtgcagtggcgcgatctcggttcactgcaagctccacctcccagcttcatgccattctcccacctcagcctcccgagtggctgggactacaggcgcccgccaccacgcctggctaattttttgtatttttagtacagacggggtttaaccatgttagccaggatggtctcaatctcatgacctcgagatccacctgcctcggcctcccacagtactggaattacaggcatgagccaccacacccggcctacccatgttttcttaattcagcctgattcatgttgctgttaatgttaaaggtcatttattgaacaggtgcaaagaagggccaccttggaaacatttcttttgcaatgaaaatacctctggagtagtatagggctttcctttttagattacctgctcagaaacaagtagcaagaggagactgttactctcctaacatatctcatccagtcaagctctgactaaagcaaacatttgccctattctaaaaacaaggccttctaacagatttggaagtctactgctatttcaaatttttctttttttgagatggagttgctctgttgcccaggttggagtgcagtgacgtgatcttggctcactgcaaccttcacctcctgggttcaagtgattctcctgcctcagcctcctgagtacctgggattacaggtgtgaggcaccacacctggctattttttgtatttttagtagagatgggttttcaccatgttggccaggctggtctcgaactcctgacctcaagtgatctgcctgcctcagcctcccaaagtgctgggattacaggcatgagccaccacacccagccaactttttctttcttcagaacgaatgctggtccttttgtcatgacgtgtgatagtacaaatcacaagggcaaatggggaccaaacgtttgtaattaagaatgacaggacttaaggagatcggagaaaatgtagaccttcacatctcccattttccatttctacctgcatcgcatttacttagttaatgcataaggtctacttctgaaaaattgtgagtacactgttaaaattaaacagacaaaaaccaccaattaaaataaaatctcattaaaagaggttgtaacttaagaaaatgtataaatacttcttttatttgaggcacactactcttttgcaaaatgaatgattttaaatttgtgatttcacagttataatgcagctaaaataatcttgcttaaaggaaccttcatgcctagccattggttactggaggtcagttcttccacatcatgttgaaaagaaagctgccactttttcacctgttcagtattccatgatactaactaatctgacttatgcttatgttcacccatttgtcaaataccaggtacagcatagaactttatgttccattgccttcgacttacattttatatttgacacggaaggccctcgggatacaggagagctttccatccacaccagtgcctattcagcacgtgttctagcagccagagtgttatttcagctttcatgttttctggttgcagaagtcaaatggctcagtaattctccccacagtgacatgtttgacaagctggataggaagatgacacccacatcctggcctttctattcctcaaataaatgaaactaaaacataaaacaatgagagcacttctagttggatttaactggtgagctggcctgagatgtttgaaagcccacagatctcaattatagtgggcaattcttacttgaaaactgattttctctgaacagatcttctccatgtgagtcctctacttatgcctgtcagcttcactgacaaaagtagttatgccttttgaaacagagtcaacagaaccaagaatgggtaaatccatgatttttggctttgaatatcactaataattatctgtttttgattaaaaaattattactcctggagcagagctggattttaactccccggtacattacaaaaatcactagaagggggaaagggaaaagaatagggagaaagacagtaaagagaaaaagacagacaaggaaagaggagagacaagaagagggaggatgaagttgaggttgtataaagtcatttttgcattttccttttgcagcttccttttacaactatgtaaacgtctcattaatttctacatttagaatctgattctgagcgtaaaagtaaattactcttttggatcttttttatctccacttccaccagtgacagatctgaaaaagacgaaatattttatgcaattaaactttgcatgttataatgtgactcgttgtgaatattgcctcaaaaacttaagagtgaagagagatatagaaaataaaaaggtgaagactgagcaatcaacacaggatcacaatggacaggctgttggatgcttgtttgtatttacttctcggtacacacctctctcaagcactgttcgtcatgagcttaaaagcacaggcatggtggacaaaggagcccctgacttccgtatattcgtcccaatattcacagtgctcagacttcctctcctagtcatgagaatgaggaagtggagtggtcttctggataagctcaagccaggaaaagagaggctggttttggacttaaaagcaatagatcatgacagagtaaaaaaataccatacatttactaacattttttccaagatggaaaacctataggtagttcctaatgatctatattgcagaccccctttttctagtccactctaaaatccaactaattctttttcttttcttttaggagatggagtcttgctctgttgcccaaggtactggagtgcagtggcacaatcacagctcactgcagcctcgaatttctgggctccagtgctcctcccacctcagcttccctagtagctgagactataggtgtacaccatcacacctggctaattaaaaaaaaaaagttgtagagatgggatcttgctatgatgcccaggttggtctggaactcttgacctcaagcaatcctccatcttagcttctcagagtgctggcattacaggcatgcaccactacaccaggccgagctaatttctttcttcctttctttctttcttttttttttttttttttttttttgagacagagtcttgctgtgtcaccaggctggagcacagtggcgcgatctaggctcactgcaacctctgcctccctggttcaagcaactctcccgcctcagcctccctagtagctgggattacaggcatgcaccaccacgtccagctaatttttgtatttttagtagagacggggtttcaccatgttggccaggatggtctctatctcctgacctcgtgatctgccggcctcggcctcccaaagtgctgggattacaggcatgagccaccacgcccagccgggcctggctaatttcttacagggctttcatgtcaggtttagatactgtatctcgagtcaacattctaagcaactctttagatgcccaagtagggctggaaaccctacccatacatgtcttttcaggaaatctttgtgcatgggctctgacagtagactcctcacttgtttgtgacatcagctttacacaaagctgcactggtggtttttattacatctcagtgcaaactatattcacacttgaatatcactctcaaagcatccctgctactttttatcagtcccattttacaggtgagaaaattgagtagcaaagagatacatgacttaactatcaaggacacaaaggacatgatagaggctgaactctgaattagaatttttgacttccagaagagtatgcaggaatttcttttaaaaacttattttcttaaagctaaaaactagatagtattttattcattctgtaacaagtattagctcaaatcaggtacagtatcatgccccagtgttcacagttgaaactgtcaacactttgtttgaatgtatacatgagggaaaaaaaatattcttttaaaagttgaaaagcaacaaagtaaattttatttttccaaggatgtaacataaagaagggaaattttcatatatagaagggaaaatgaggccaggtgccgtagttcatgcctgtaatccctacactttgggaggctgaggtgggcagattgattgactcaggagtttgagaccggcctgggcaacatggtgaaaccccatctctaccaaaagtaccaaaaattagccaggcaatgcggcccatgcctgtagcctcagttactcgggaggatcgcttgagcctggaaggtggagactgcagtgagccaaggttgtgccactgcagcactccagcctgggtgacagagcaagaccccatctcaaaaaaaaaaaaaaaaaaaaaaaagaaaatgagaagcaaacaaattcataattcatggtcttagtaaaaacaataaacccactttgctattaatacaagcccattaaaactaattaaatctagtcccaaggactttcaggaaacctgcatgatactgaaattctcttacctacaaaattgatttttggggggtcagctctttatgtaaaatgactacagcacgacaaaaatctgtctggaatatgctgaatgtcttaaaaattaggagtcaaagaaagtaatataatcaggtatctgtttgtctaccagtatatgttactattcagtatgtaattcagtgctaagtaatccgggaattaaaaaaataggattataccatagaagtatcaaataaggatggcatagacacaaatatagcaattgacccatatttaagccaacagacagtttggaaaaggactctgaaaccattttgttcttgaaaatgctatcaatttaaatggcaattttgattttagcagttgattaaaactatttcagacagaagtatatgccactgagctgtttctgccctgaagtaaaagtaatggttcagattcaatttaaattttgctggcaaacgtgctatttagcattacttgaatgtgaaaatactggtgaaggtttaacaactcaggatataacattctgaaatggtgctgaatatttttgaagagaaggagaagatgaagaggcaataactcattgagagcaaactggcttaagagttgacatttcctagaggcaggcaccaaaatgtattttgcccttccaccgtttctgcatagaaagcaaagtgaatctatccgtttcctcataaaagttaaatggaaaccttgtcaacagaatgactattagtaataactgaacgtcggaaaataaaacatacaggagagtggatattagcagttaaaaagtaagaacagccggccaggcatggtggctcacgcctgtaatcccagcactttgggaggccgaggcaggtggatcacgaggtcaggagatcgagaccatcctggctaacatggtgaaaccccgcctctactaaaaaaatacaaaaaattagctgggcgtggtggcgggcgcctgtagtcccagctactcgggaggctgaggcaggagaatggcgtgaacctgggaggcagagctagcagtgagccgagatcgcaccaccgcactccagcctgggagacagagcgagactccatctcaaaaaaaaaaaaaaagtaagaacagggtaacagagaatagaagaacagccttagaaatgagtttgaataaaaaggtactacatctgtctggatgggcaggaaaagtaacgggatttgttcagcaggttgtattgttttgtttttttctgctatgctctggcatggattatcaaagtgaagctacccacaggttatcctacaagttgggaaggtatggggaaaaaaacgtcctgcgtggctgtggaattttgccttcacttcactgggtgagatacatgttcataaaagttatccgaagtgttgcttttctaatgcatcaaattgctcttttcttcctaagttagggctacatgggaagttgagcactgacattgctcaaaaaatattcgtcatggtagaaacagtaagcaattgcagcagcagtggtagtgacagtagcagcaacaataataatacaatgctaagtgataatttaaaaaaaaacaaaatcatgattttcatacaggcataaaaaggatttgggtcaaagattttattttacttataacaagggaacctggcaaatgttgtgaccagtcaaaggagaagttcaaaaagcaccactttttacagattaaaagaatgtagaaatgaggccaggtgcggtggctcacacctgtaatcgcagcactttgggaggccgaagcgggtagatcaggaccaccctgtgatcatgttcaagttcaagaccagcctggccaagacggtgaaatcctgtctctactaaaaatacaaaaattagccaggcatggtggcctgtaatcctagctactggaaaggctgaggcagagaactgcttgaactggggaggctgcagtaagccaagactgcgccactgtactccagcctgggcgacagagcgagactccatctaaaaaaaaaaaaaaaaaaaaaaaatagaatgtagaaatgaaatgtacaaatgcaggcaaaactacctggggtcaggggagtcaactgagcctctatacaagggaacagaatttacttgtctatagctaaaaattattttgcactgctatcattcatctacaatttaaataattataaaatagctttcatagaatcagataactaccagaagggtatgctacagacaaaatgcatatttttctgctgaggcacatttttctccctataccagtgaattatttgagctcaaccttggcccctaggatccttagaaatcagttataaccacacatgaaagtcaaatgcacaagttctctcagacattatcctgaccaccacttgcctttcgtcgtaccaaaaaaatcagaagcatattgttttcagccctacaattttcccatttgcaaatgaggcatcccaatgatatcacagcaggcaagaaaagtgctgatcattctggatgatatgaccagagtgtgtcgcctgcataatgtgattagtgctggtactctttgggaagatgagacagcccaatttgtaagagacttaaactcaatgtttccaatactcaggaaaccttgcttagtgcctatcttgcagttataaagtaatatccatgtttttttttctaaaaatgaaaggaaatatgtctaaaatcacaagagaaacatatgggactcaatttccattgctatttttttcttggattttctcttcatttagggaaaaggaaagaggtaggaggactgcataacattctctttaacatcctttttttttttctttataaagctgcaccagattagcctggtcctttaagcccttacatatagcgctgccattccaaggcaggtaccacattaaattattctctgatattctttctcctggtaattttaactcccctgaaggcaagaaccatccattacttacctttagactcagcaccttgtctggcccacagtgggtgtcttataaatagttggtgaactccgcctgtcccctgagccacactctgtgtgcctgccctcacctctgtgtccctgactgtcactgcctctgaacttacaactcattttcccatgcttgcagctttgatatgctcctgacacttcactgctgccacagattctcttattttgaccaaatgcttttctctttgacaacatctggactatactaaattacttatgctgctacagaacaattctccccaactcagcccccagtaaaacactgccccaattcatctcatctctaagcatgttacactcatccacatagaagccatgttgcaagtcatctgaaggaaaactataaacaagaccagacagagtttcctttacttaggaaacctttcaaagtagcatcagaaatgagagaaatatatactcctctactaatggctttcctaaaatgtttatatagacactgtggtttcaagggtaagagtataacctggccattttgcagaaaaacaacaacaacaaaagacagtaaataaattcaaaaccatgcttctccttggtgaaccacttctctccaacacactaagtagcattctttctccactgtctcccaagctccttctccaccacctcccagtaaccgccctctcaaatggccacttcccctagtgggaggtgcatgggtagggagaggaaagaggaaggactttgcattcgtgaccatatattctggttacttcccagattcagcagatttgttcactgtctgcttctaattaaggagaagacctcacttaaatgcaacagacgagcagccttgcaaatagaagaagagaagcttaatgtgcaaagcctccttgtgcgaatgtcaggccccataatttcataaacatattctaatacatacattcacatgtttatatccgctgcttttacataattcgttggcctcttatttaaaagtgcctgagctaagggtagtgtgtaactattcatgcaaaataatagctacaagaataagctcggcttctgaaagctcatgcctttgcagtgtcaaaataacagcactcatacagctggcttgattacctgaactactagggtcattcacgatggcctttcttgtcatgaggactcccaacctctggcttctttcatttttttgatgttcaattaagaaacacattttgtttttgcaaggagacctaggtaggggtgggataatggagcaaatggcacaatttcatctcacactccttttattcttaaaggtgcactttaacatgacaaccagtcttaaactattttaaaggctgacaacttgacctggaacaaaaataagctgtattagatactttcagatatacagttaatgcgaaaccactattatcttttttacattaagagaagggcagaatgccatcccctttcatttctccagtaaatcaaactgaattattcattagcacgaaatgtttccaatccaccccctaccacatacacacaccaatacctcattttaaaaaactggtggttatatctcctctaaaaataacctctctgatacactgagctccaaaagtttaggactttgcaaagattaatttctgtggttagtaaagctaacagtctctagagtagaatcagactgcaaagacaagaaatgagcaattaagaagtatgtccttgtattatttttcagttctcccatttgttgctgactacagaagtttggcgctgaataattcttggaatctgaggttggtcagaggtgactctaagtaaattcttcaggaataagtagtaagaaaacttctaaagtaccacattttgccaaatgaagacaggtcctaaaatgccttccaagagcctgcattaaaatatagatttacgtaattcaggtttaatggaaaaaaacaggtaatgcccagcacttctaacaactaaaaacatacacacacgaacatacacacacataaactggcaaatatggacacacacaccactgccaccaccaaacatacatacacacacacagatgcacacacacaaataggcaaacatcatttgtcttctctaagatcagatctctgggcactgaagtctgtatttcacatggaatctcattttccatcttctactctgacagttttgcatctgctgtgtcctgtttcattaacaggagctcatcagagccacatcaaaaagtgaagatgcatggttgctattaccatttatagcaccatttgtttcatttaagaaaacgtgcttagtccctggccttaaattacacagaagaaacaggattctggagttcagggtacacattttttctctcatctcttcactttgtcagaggagaaatcactttgagttgacttacaagacaaactgtttccatttgcaccagcagaagcttggctctggcaaacaataatttagcttcagggacttctgagccattctagtttccaaatcaggcactagcctccagattatacctccttaattcaggttttacaaattcagccaggggctgggctcaaatttacttcctcatgatgaaaacgggatttctgaagtgtaacaggataaggggaaattttattatcttaataactgataccagaattcttcttaagagtaacattggatttggttgaaaatatacctggatcatggtttgttgtttggaaaaaaaaatctcagcagatgtcagctgggccaggcatcacaggagggaaagtttggggtttctaggggcaagccagaaagaatcaggtgaggagggaagcagagaagtgggagaaggggagaactcacctatgatagggcagaaaactgtactcccagtgacaccacatcaccctctccccatcagcaattaagtccgcagaattaacaatgatttgaaataaataattttttaaaatgttgttactgtaaaaaacagagagaagtttgtaccttctgtgtgcaatgcacacccagcagttgatgtcaaagtggtcctgagaacatgctcccatctttccccccaaaaccggctgaaatgttgggaagatttttaggtatgagtccatttggctgggcacaatggctcatgcctgtaatcccagcactttgggacgccgaggcgtgtgcatcatgaggtcaggagatcgagatcatcctggccagcatggtgaaaccccgtctctactaaaatacaaaaaaaaaaaaaaattatctgggcgtggtggcacgcgcctgtagtcccagctactcaggaggctgaggcaggggaatcgcttgaacctgggaggtggaggttgcagtgagctgagatcgtgccaatgcactccagcctggcgacagagcaggactccatctcaaaaaaaaaaaaaaaaagtcaattttacctcaaacctgaatttctgtatgcttcaagctaatacctggcttacacaaaatggaggtttcaattagtttttacaggcaagaagattgaacaaataaatacaagataataagtgatattcatatatctaagatactcttcaacatatgggctcaaataaatataatatgaggccaagtatgaagtgtgagactaggggtgaggggaaggggcaatgccagtttagggaagggtaggaaaggaagatatcagtgactattttgagagaacactagaagatggatgttatttgtagaagcaaaaatagtgggagatttaatagagatcatgtaaagaatttttttgtataaatttcttgacatcttgccactttgggttgaaggataataaaaatgttttcctaatgactaccaggctagtctctggagtgactagcccaagtcttgaacagaggagctccttaatgttaaattgaatcccaaaatgaagctcagcataaaaataggcagagaggcaggaaggggcagagtgtagacaaggcatttttaaacgtgtagtttgcctggaatttaagatgtgtgacagggattgttgtaaagggaatatggttatgttgggctggtgccagatgtaaaggtctctaaaatgaaatgtcattacctctttaggcagtggggagtgcaatgggaggactcttggccagggaaatgtaggatgaggcacgtttcagaccaattactccaacatcgtatacagaacagaggggggtcaagtttgctggtgaagaagcctggtagaaggctttttagtaatctacttataagcaaagacatgggggttcaatctgggataggagtaataggaaggaaggaagtaggacattgtaagagatagaaataaacgatttagcaacctccgtctcccgggttcaagcgattctcctgcctcagcctcccatgtagttgggattacaggcacgtgccaccacacccagctaatttttatatttttagcagagacagggtttcatcatgttggccaggctggtctggaaatcgtgccctcaggtgatctgcctgcctcaacctcctaaagtgctggtattacaggggtaagccactgcacccagctgaaataaactgtttataagcaggtatttgcttcaagtcagcttaacagctatttattaagcatcttctatgttctccggcaaaggcagttaaacctggctctaaaaggattcacaccaatctgttattattggttatatgtgagatttgaattgaaagagaaggaatttattaacttttctttcttcatatattttcctttcctttgggttcttacagtagtaatgtgtcacaattatgattctgaaggaaaaaatatccaagaatacataaatcttaaaaaatgtgttacacagcaaatgaacacagcgaagaccactgaatttgtatgccaaggacaagaacggccctgagcaaattaaaaatcatcctatctcattattaaagcaggcccaggagcatcaccacaaaaggtgttaagctattactttgtggttttgaatatagccctaagtaataaagccatgattcaatttaaaatgttacatttttcatgcttctcattaagccaaactaatatctctctcaataattctgaattagtaaggtcagaccgtattggaactaaaaataattatggaatgagtgaatcttcccagtctcctttaattactgtgtcagaccaggagcctgggaaagctcctacctgagactaatttaggaagctttgagaaacagccactcttttgggccattagatgccttgtctctctcactgtgagcaactgtctccagcccacatagcacataatgaagcaaaaactatagctaatgagttctcatttctatagctcccaaaacctgggagaatgtaagaacacatagcatagctttcctgaatatgctatattacatgaattgtatgtttgctggaattgcatacctgcaaactaagataattgtgcctagaaaatccaggctgcattccacacagagaatgtcgtatgtgtccaccaagaggcaaccggtaggttccatgattgtctcttcataatggaacaagtctgattttaaaacctagaggaaataacaagggttatttttaaacacagatgtaaaagtgccagatgccttttgtcctactaattgctgacatgcatcattcaaggtgggagttgttactgagattccattaggggactgacagtcttacagaaatcagctttggtttgtatcactgggcccactcattactataaaaagttgttctaggccgagtgtggtggctcacacctgtaatcctagcactttgggaggccaaggcaggtggatcacctgcggtcaggaggtcgagaccagcctggccaacatggtgaaacctgtctctactaaaagtacaaaaattagccaggcatggtggtgggtgcctgtaatccccgctacttgggaggctgtggcaggagaatcgcctgaacctgggaggtagaggttacagtgagctgagatcacaccactgcactccagcctgggccacagagtgagactccatctcaaaaaggaaaaaaaaaagttgttctacaataggtacttagcagcataagtaatatatttgcagctcatatcagcatccttccaatggggtagcaatataagaatattttgtatatttatgtatagccaaagtatgcatgtgttgtgtgtatagagagaataataaattcccataagtgtgtgtgtgtgtgtgtgtgtgtgtgtgtgtgtgtgtgtgtgtagtaatccacagactcacttcctcttagctatctcatacaacaagaatattaatcttttaaataagggcctaaggcagaatattggatctaatgcattcttagtgtctatttcagatctaaaaatctagccataaaaatgcaccatcatgtcatcatgttgtactgtaatccttagggtaatgacattatctgcagtgtcggtctaattctggatggagtctctggccttgtgaaggaggctgcctgagatgaaggcatctcacagagaagatcctacctctggctcaggactagtgtgcctcttgttacataattaacatggccctgaatagttgggaagaaggaagggggcagggaataacagaaactcatgattcaaaagcaatccacaacaaatccctttttaaagcagagaatacggctgggtgcggtggctcatgcctgtaatcccagcactttgggaggccgaggagggtggatcacaaggtcaggagatcgagatcatcctggctaacacggtgaaaccccgtctctactaaaaatacaaaaaattagccaggcgtggtggctggtgcctgtagtcccagctagtttggaaggctgaggcaggagaatggcgtgaacccgggaggcggagctggcactgagccgagattgcgccactgcactccagcctgggcgacagagtgtgatcccatctcaaaaaaaaaaaaaaaaaaaaaaaagcagagaatactactggcattgtatgtaataactcctgatatccaagtttgtattcctaaacaggtctctacaatcatttttcagttcccttctttggtaattcctgtattagtctgttatcacactgctaatgaagacatacccaagactgggtaacttataaagaaaaagtggtcagtggactcacagttccacatggtggaggaggcctagcaatcatggtggagagaaaaagaagagcaaaaggatgtcttccatgggagcaggcaagagaggttgtgcaggggaactcccatttataaaaccacaagatctcgagacttattcatactgttctcatcagaacagtatggaggaaatgacccccatgagtcaatcatctccacttgaccccacctttgacttgtggggattattacaattcaaggtgagatttgggtggggacacagccaaaccatatcatttcctgattaaacctcgtgatttaccagaagtggctactcttctgggaagccctccttacaatactcttctataggtccatactttgggctgcaggctggcatcattaaaaatataaaacttttcatctgcactctagtcgaggcatttttaaaggacaaaattataaattcccataaatatgctggtatgtgtgtgtgggtgggtgggcctgtgcgtgtatgtgacagtgaatttctaaagaaagccaaagcagtgaccctacaaaacaaaagcagcaagtcatccagccctgattaaactttctccagttgcctgccaatatggaaagatattttaatgtaaaccactgaaaaacaatatgcctatatagagtaagagccccggggtggtcacagctaagaaaattccagctacagcaatcaactctaaggaaataattgagatatggtcaaagatctccgcataagggaatcccatcacggcattatttataatagaaaatgaaaagccaagagaggcttggttgctcgcacctataatcccagcactttgggaggctggggtgagagatcacttgagcccaagagtttgaagctgcagtgagctatgattgtgccactgtattccaggctgggtgagacagaacgagactttgtctctttcgggggcggggggtagggatgggggtggagaaaaagctgaacactatgtaaactttaaaaactagagattgttctaaatacagaaattttaaatgtggaatcatatagatatgagaaattatggttttttttgaaaactttcacaaataaaggctgaagataaaattttaactgaaagacaggaattttttaaaaactgcacaagcattatgttctaaaagttgtattcccttttttccatatgaatacctacatattatgtacactttataataaatgttaacataattatctcttggtaaaattctgcacaatttattttccttttttgtacttttctgtaccctatgtattttccacaataagattattttactgttgtaatcatggggaaattttatttaatgaggtgggaccatacaatattttaaaatgacaaaaataggcatatgattctcacatattttgtgatattaaaattatatgaagatttcagtcccatttttattcgtttgttgacacctaactataactatccaaatgagaacctataattatttggaatcaataaatatttcaatttctataccaccatgatagaaaattatatcaattgcccattcttgattttgtggtaatttgttgaggactgaggtgtgtcatctttaggctgtattttgacccacctccccttcatatttccctacattgtccaatttaatacatatcacagcacagcagctttatttctttatgcctctcctattagattttgagttatttgaagactgaactctcatttatgtactcaatacatacttattgacaccttaatataccataaaccctattctaggtcctcctggtagaacaatgcagcaggagagagggaggcatggatgacaaaaagctcttaacctatatccttgtgtctgtatcccagctagccctgtgcttagcacctgacaggtactagaaaagcagctgttcaatgaaagaaacaaggaagacagggaggaaaaacaggtgtattaaatcagagcaacaagagaataaatagatggcacagggaaacactatttaatataagtaatgaacaggtgaaagaaccccagaagggtaataagtagtaagtcagaactgtttctttctggaaggcaaaagaaattggactttcaaagaagagaacatgaaaatagtaactttccaccgggcatggtggctcacgcctgtaatcccagcactttgggaggccgaggcgggcagatcacgaggtcaggagatcgagaccatcctggctaacacggtgaaaccccatctctactaaaaatacaaaaaattagccggatgtggtggcgggcgcctgtagtcccagctactcaggaggctgaggcaggagaacggcgtgaacctgggaggcggagcttgcagtgagccgagattgtgccactgcattccagcctgggtgacagagcgagactccgtctcaaaaaaaagaaaatagttactttcatagtacctcccacagaactgcagattcttctattattctcattccttttaaatttatattttcatttttcaatgattataaacaaatttacatactcaaatgcgcttatagcaaatcttaacattccagagacgaagtgttaattttttctaggttaagtcatttcccttgtatctccatgtcccgactagacctacgcttagcatctagtttgttctcaattttgtagtaattagtttttgtgttaaccttggtctaaaacttcccctgcaatccctgtgtaatcatttgaaatgtcttcaaaaggttcattgactatgaaagtggtaactgtgtgtggtgattaaagacagtcacacattctttggcctcctcccaaggcagagagggggtctttgtcttgtcccttttaactggtgcaggatcttgttttgacaatagaccacagtaggagtgacactgtgccattttccagatgaggcattaacaaactgttagcttccacttctgtcttttggaacactctgccttaaaaccgagctgccatgctgtgaggaagcccaaggaaccctttggagagaccctaatggagtggaaagatgtcccctggctgagtttccaggcaacagccagtaccatcttaccagtcatgtgggtaagccatcttgaaaacagatcctccagcccccgctgagcctctctagttcacgcctcatacaactgccactggcaagtcctgcccaaagtgaagattcatgaccaaaataaagatatgttggagttttagccataaagttttagggtagttggtaacacagaaataggtaagtagaacattctggatgaatctttagaaaacattataaaaactcagacctgtgtttgtccttcacacatgagccttctagtagagaatacactaactacacttcagcacctctaggccacatcccattgaataccatgcgaggctcaggcccaattacgcttacttgatagctgtgcaataacaaacgaacatacaacatattcttcacttgttcttggccaaaaggccaggaggtgatgaatatacaacatactcttgtagaatttcagtgctgatctaaatttcagctcctcccatgataatattataaagtgctttgtatgttgtctaaagatttatttatttgtctattgtaggttaattattcacattagaaatggagtattagtttaataaattcttttttaaaaaagactgtgatagcatcaattagattcaaaatgagagggcagttttttctatactaacatcatacgattcttcatctagtgccagtgacaacttcaatagtacataaaatagtagagttgccagtatttttcataaagccactcaaaaagacagtacaatttcattggtttccatttttaaggtgatagaagtccaaaccctcaatgtaatttatgcagtacaattatgcaaagcagtgttcaagccaagtcacaaggtcatttttatataaaacacaaatatacattctaaattttctctgggacaactaaacatgtaaatgttatttaaaagagcgtgcaaagataattcaaataccttgattaaaatgcagttgtagcatttaagataaatggcttcatcacatgaaagatgttcccacaacagacaaaaagttaatgcctctaatattgtcattgaaataagtagattgatgaataggttgtgttaaacggtacaattagaaacaatatttgataatgtatttcagagatggagctaagaaagtacattctgcatactggataaatttgcttaagtctgggttatatgagaccatcagaattcaacagcactcaaaaatggttattatatgggccgggtgcggtggctcatgcctgtaatcctagcactttgggaggccgaggcgggtggatcacgaggtcaagagatcgagatcatcctggccaacatggtgaaaccccgtctctactaaaaatacaaaaaattagctgggcatggtggcgggtgcctgtcgtcccagttgctcgggctgctcaggcaggggaatcacttgaatccgagaggtggaggctgcagtgagccaagattgcgccactgcactccagcctggtgacagagcgagactccgtctcaaaacaaaactaaacaaaacaaatggttattataactctctattttgtttgctttggtaagttctggtcatacagagataccaggaagatttgttatttggttaaattattccacgtcgatgcaaaaaaaattctgaagggtctgaattagtttttcaaatacatgatcaagtatggcaaaaatgcagtgacatctgcatatagacgttgaaaaagcaacaacaggaaaaactgtaaaatgttgtgacccttataaaagctattccccagatattatcaggctgtttttgtgtgttgcatggagtagcaccattttcaattacagttgcttagacaatacaatatatactgttcacaaatcacagacattttagaattatttgggcagagagttccagatttttattttttaactgaagtgttcagctcttctgatcaacacgaagggcaagtatgaatgtttaaattgagaagagaaatcactacttttctgtttctccttaaaatagaatatagtttttagtagcaaaataagcataacacaggacacaatgttattgagtttaggactatggataaaatatctggaatgacattcaaagttaagtttgtactcaacatataaagcaaataaattcttctgtttcatgtagttgctgggacaggcaccaaaatacgcaagatttaaaaacatatatataattgaaaatatcacaatctcataatatgcacaaaagtattttctgacgaaaatgttagacttactaagaaacctgttttttgacttcctttaaattgctctttcacctattgagagatgcaaataattattatcagagcgacaaagaataggtgcatagggagacaatacgtaatataagtaatgaagtaaaagaaacccaggagggtcacaagtcagaactcagaagtgtatctggtaccgattcagtatggaaagaagactagtagaaaaactgaagtatatcttaagattgaaatttgaactgttgaaaaacttatgatgtggaactatgtatggaagccagtatagtctcagttctgaaaaaagaatctaatcactgcatcaaacgtatttctaaaattagtaacagtcatccacaacacctgttttcaaatgtttgttcatcaatataacttcaatatttgaagccatggagtttgtaagcacatgaacttatacatttgttaaatgaaatgctgttttaatactttctaaaggatggagtaggggagatttcacaaaagatttcatttataaaattggttccctgctaaataagtttgaaaacccactgggccagaaaatttttcaaacagtcgctctgcaggacagaatatgaaagaaaatcccagccatgcttaatcatgctccactgagttgaggcctagttacttgctcacaaggcataactttattttttttgtttccgtagtttctctgaatgagttcttccattttatggaaaagaaaatgccattcagttaaacatcctgcatcggtgaacatccatcactcagttcatctcccctgcagatgtgtttctccaccgctttgtgacgtcaagctgcatcaggcgtttgccttatccacaaagcacaaaacttggaccatcagcccaactcaggaaagttaataggagctgattgaacaactgagctaaccgtggggcctgtgggtcattttgagaggcctcagatctctgaataagttggcggtccccttccttttgtaagaccgagttcataagcagcttccaatggagataacaggcaatcgcagtgtctattggcagaggtgtcctgcatggcttcttttccgctatagtgaatgtgtcttgcagataatttcagtttctctcacagagctttcaaaccagatatcaccccactgagacaggaacacagtgattttttcacatgctccaccagaaaatgcataagtcaactgaaccacatggagccaagccttgtgattcttcaacatgctgtaagatctgcctagacggatgaaggcaattcccacacactgggatgagcaggaggacaggaacctcagaaggaaagaaaataataataattctgccctaatcaccaagtaatgctgacaggtgactgataaatagcagcttcctttatggacctcttaactttttggctgtggacaaaataaagccctctttcttgggtctgttttagacccactctccctttcacagagcattatccacagcattgaaaacttgtcagttcgtattccttaaaccacttttcacttcttatgccaatgccgcctcctatgggggaataattgaaagtctgcaatggaatgtagtgattaaactcatcaagagcagatgataagaaacacgaccttccacataaaagggagaaaagcatgtttgtctccagacaaattcatgcaaacctcaaacaattgctctccttctcttgtaaatgctgtgtctttgcttctgccctgcaagctacccaatgatcactccattagatgctacatggactcttgttcaatcattaacagccacaaggtttacttcacagctatccacaactccttgcagaattccaatgctccaaagaactggacaagttacctcttgcaaaactggagaccaatgagatgcctagagatttgtcagataatacaagagaacagacagaatgtttcaccttctccttacaattctcctacttatttttaacctccccaaacaccaaaagccatttgctgtatatgggggttctctatccccaggctgttttactgtatgccatggagatcctaagtaaagaaccagctaatttgccatacctggaatattctgggttataaaacactagatcacaaggttgtctatttaaatattgatatatcacaattttatatttgtaaggactggtgaaataaggagatctttatttctaaaagaaaagaaaagcccacaagtatgtttactgttttatcatttttttagtaatttttaacatcagaagcagttcctcgaagataacatgttcaaatgtgcccagacaacaggtagaatcaactgttattgcagcagattttttttcgtgagttcctccaagaccttgtctaagactgaaacagggacatttttgcttagttgcaatttcacgctttccttccattttccaagttgtggtttagcctcaaggaatagccttgggtatcaatccagtctcatccctcacaccctcttcccatctttatggctagacatttgagatatgtcagcagaggtttgcagaactgcagtgtagtataacaattaaaagccaaagtgctggagttgaacaggcttgaggaaaaaaaattcacacagggatgctcacagctcataggatttttggtgggaataatggacatgatacataagtgtttgataataaataataatagctagtattcatttagcttttattatgctagcactttttatatattaacttttattttcaccatagctatgagaaagatatcatcatcctcattttacaggtgaagattgagacatgaagaggttaaggaacctgcacagagaggtgaagttacttgtccagtgtcatagaactagctcatggaacaatcagaattggaactaaggtaatctgcctctagtgtccacatgttccaccactactttgtaaacagaacctggtacagaaggactgttaactcactgtgacccttttcctccatcactttcttaatcctatagttccccacagataccatgggatttatcatctttatacttttatttataacattgtgcatgttttggctagctcctctctttccccatttccttaactcttaccaaatatgaaggatgcatcctaagctatgaactccactaagatgtctgcacctgtctcttccaggttgagttgcttgtttctcttctacacctccttaatgccacttcatgtcttggcctcctattatctgtcaatgtgtccaattttctcccttggtggagttccttaaggtcgaggaaacagcattcaattccatatccctaggggcttgtagagtacctggtacacagttggtagctaattaatgttgaataaataaacaaatagaaagtctgaacactgccccttggcttttggcaggctcccttcacaaaactaaaattcacctgccttaagtatgtttggaagaggtagggcaagggatcaagctactaggaaaagttgggtaatgtgggtcacatttaaccgagtccaggtttcactgaaattcagcaagaaaccttgcagaagttaaaataaatggcgtggaaaggtttcagatctagccaggaactccactgagcactgagatggaacctgacaccaagcagaaggtaatcagatctgggttaacctggagtcacacacagatagccagcaggagactcactttttctttgagtaggctaataagagaccattgtccattgtattttatttcattgctgttctctcccttcctgcagtatcagtaggattaacatcaataatggggctgtctttgtatttacacattgtaattaagcctagatgaaacctaaagagctctttagggatatttattagcatccagaaccacctcagcttgtaggctacctttggccagtggttggaagacagaattaaataaaacatccactgtgcaatgacaccataaattccctccaggactcctcctgccagcgtgtctgacctcctcatgctacaaggatacagaaccaggttgttgaagattttgtttctaacaagcttatcatggtttaaaaggtctgtaaaaatgagtcacccaagtgactcttgactctagttcctgctaatttagaatctctagattgccacagagaaggcccacccagttatttctggctacccttggagggggcttaaaaagagagaaaaggccgggcacagtggctcatgcctgtaatcccaggactcgaggctgaggcaggcagatcacaaggacaagagatcgagatcatcctggccaacatggtgaaaccccgtctctactaaaaatacaaaattagctgggtgtggtggcgcatgcctgtagtcccagctacttgggtggctgaggcaggagaattgcttgaacctgggaggcagaggttgcggtgagccaagatcatgccactgcattccagcctggaccagacagagggagaccctgcgtcaaaaaaaaaaaaaaaaaaagaaaagaaaaaaagagagagagagagagagagaaagaaacaaaataggggagaaggaagaaaacatcttccagctttttttctggcctttgcttagtgttgcagggcatcagccctcttgtgggggccactgtccatttttgtggatactttagagctgttaaaatgtttcaaggtgtcaaaagtttgcaaagttttctatggcaaaatgagaaactaggaattgccaaaatgcttctttcctcctttaggtcacagccaaaatggaaccgaattcccttgctttctgttatgttatagcagcagttctcaaagtgcggcccctggacctacagcatctgcataacctgggaatctgttagaaatgcaaattgtctggtccaataccaaaatttaaaaatgctggaggtggaacccagcagtctgtgttttaaaaagccctccaaataactctgatggacattcacgtttgaagatattttacagaatttctagagaaaaaaagttttacttttttaaatttaccttttcaccacataaacttattgcatacaatttgatgagtttgaatatgtacatattcttaaaccacattcttttctccctctaaggatgctgatatgaattcctaaaggaaggaatagccaattgtggttggaatatggtcaggatcacccttcccttgcaactactaagagaatatattactgaatcaatatcccatgcttagggtcaggatgaattctttgcaaggaggctcctcagacccttgtgaacactgacttctctagggcagctacaacctttcaccagagtataccctatatctaaatcaccggtagaaacagattacgcttaaccctatgattccatgaaggaaatcattcattcaacgcattctacaaatatgtgttgagcacctactgtatacatagtactgttcttcccttgggatatgttagccaacaaagccaagacctctgctgttgtggagagatagaaaatagatgggccttactcagtaagtacattgtatggtatgtcagaaggtgacttgtgttattgccatcacacacacacacaaatagagcagggcaaggaggtttaaagtgatgttcttaggtttcattcagaaggtggtatttgagcaaagagttgacagagatgagggagttaggcatgccagtaactgagggaaaagcatttaaggcagcgggacagtgagtacaaaggctcaaaagcagaaacatccctgtcttggagagtgacagttctggaatcaaaatactgagaattgatgctgtatatgaaaacaatatccatagtcacaaataatttcaaaatggaaactataataatacaatatcatgcaacacatggcctcctggctctctcaatgatctatagtcttcaacaatgaggacagatgttttgcaaggactctttccccattatctccttgagaacatttgatgaattagaagagttcatttgtataattttgaataaaggtgacagatttgtaaagatctcaaagaagcaactttggaatagaaaatacctaagtcaaaatagactattaatataagaactacatattgggtataatgtaaatgacttggatgatggggacactaaaatctctgactttatcactatacatttcacctgtgtaatcaaaaaccacttataccacaaacctattgaaataaaacaaatgtttaaaaatagactattagcaatcaattataaattaataggaaaagacaattggccgagcaggtttaagaatgtcataaataataaaaatttgagagagctacactaccagatatgaatatttttaataaatctataagacagtatggaagaatagacaaattgacaaacatggaagaacatagaactcagaaattggctcacaagacatacgtgcataatatatgacaaaggttgcactgtagaatagtcagaaaagatggctttttctataatggcactgagtcaactggatacgtccatatgggaaaacagaaaatgaatcctgactgttaagttacactacacacaaaaatcaattcaattagccaggtgcagtggtgcacacctgcaatcccaactattcggggatgctgaggcatgagaatcacttgaagctgggaggtggaggctgcagtgagatgagattgtgccactgcactccagcctgtgcaacagaacaagactctgtctcaaaaaagaaaaaaaaaatcaattataggtcgattgtacatttaaatgtgtaaggcaacacaatgagatttctagaagatcatataaaacaaaatctttgtgaccttggagtaaacaaggatttctttaataggacacttaagcactaaccataaaagcaaaaacatggtaaattgactattttaaaattggaaacctctacccaacacaagaaaccactatcagagtgaaaagggaaggtatccagtaggagaagatatctgcaatccatataagtaatagatgactcataccataaatatataaagaatccttcaatcaaaagaaaagatagcctaacagagaaaaaagagggcgaacacaagaaattcacaggagagctaaacagctaataatcatttttgaaatgtttaatttcattattctttaggaaaacacaaacgaaaatcacagtgatattctgtacatactaattagactagcaaagaatagaaagacatgaaaatattgacttggtgaaatgtggagccactggaactctcctacatggctgatggaactgtaaattgcattaactactttgcaaaagtgtttgagagttaacattaagccatgcttactctataacccagaaattccacttctagatgtaactgacaaaaatgcatatatttgagcctaaaagacatgcacaaatgtttgtatcagcactatttgtagcaactaaaaactggaaacaattcacacacccataaaccatgaaactgataaattaactctggaatatttatacaatagaaattataaagcaatgaaatgagcaaactaccgctacacgaaataaccaatataaataaatctcagaatcacaagtctgtgcaaacaaaacaaaaaacagacacaaaataatagtgtgtataattctatttacaaatggaacaaaaacaggcaacaacaatctacggagttgaagtcaggagtatagttagctttgacagaaaaggcaatgatggggttcaggattcactactccaaaatatagtaccatgacatttgaggaaacaacaaaagcaggaactcactctctgatcttctattgccttcttccccaaagcagaccacagaataattttttttaagttttaaattttttatttctatatattttttgagacagcgtctcactctgtcacccaggctggagtgcattagcacgatctcagctcactgcaacctccacttccctggttcaagcgattctcctgcctcagcctcctgagtagcacccaagtgcgtgccaccacgcccggctatttttttgtttgtttttttgtagttttttagtagagatggtgtttcaccatgttagtcaggctagtcttgaactcctgatctcaagtgatccaccagccttggcctcccaaagtgctgggattacatgcatgaaccaccatgccctgacacaaaaaaattttctgaccttcctctgaagcagctcataagactctcatgagacaggtgcccaccctatacccagaggaaatgaatgtccttatctctaaagacacagtggcacagagaagaatctgaataaactggtcttgctaagttccccctagttgattttcattagatcacatgccctttgtccaagcacacttctccacaactctccacttttttttttcggagacggagtcccgctccgtcgcccaggctggagtgcagtggcgcaatcttggctcactgcaagctctgcctcctgggttcatgtcattctcctgcctcagcctcccgggtagctgggactacaggcacccgccaccacgcctggctaatttttttattttttttttgtattttaagtagagacggggtttcaccgtgttagccaggatggtctcgatctccttacctcgtgatccacccgccttggcctcccaaagtgctaggattacaggtgtgagccaccatgcccagccaactctccactctttattaaacctaagcataaaaaatacaaagggttccctgtttctctgagttttcattgctgaaggctcctatgtcatataaaacttatattaagcttgtatgcttttcttttgttaatcaatttttttgttataagtgcctcagccatgaacctagcaataggtaaagaaggaaaaaaattaaaaaaaaaaacaactttcctctccaacagcaggcagcaggacaagattttctggagctctaggaatgttctgcctcttgataggggtgatggttttatagaaatgtttcttttataataactttttgaacagtgacttcatgatttgtgcacttttctgtatgtacgttacactttaataagaaagaacgtttttaaaactgaaagaaaaataatctaggcttttaacagtaccgtttggtggaagcaacactaaaccaaataacttgaagttccagcttctaggctcagctctgctattcaatagctatacaattttaggtaactcactttaacaatctgagccttgtttttttgcatctgtgaagaggatcccagctcatatctcagctgtaaatattaaatgagattacacttgtgaactgttttgtaaactcctaagcatcacataaatatatgatgcagactagtgggtaaactgtatttgtagattgtagatctagcctgtagccattatatatggcctgtattttttaaaaaataaacatttttgaaaaatcagatgtcataaacattgcttttcaagttactattaaatattagacgatcatgcagtccttggctcaaattcctgatgacaacagctgagtaaaggttgagtagtgtctgtttttcaatggaccatgtactctggctcagcatagtccctatcattcatttttattgacagaatgactaccacagaaatatgagttgggaatccacagaaaatgttattgctaggatttttaaaagctcgtctaaattagaaagctcaatcagattgcaaagttccagactgaacttttagttcaggatctgctgagaaagagagagctcattcactctgccatttctttcctgtgatgcatagttcagtctctgcaggctccttctagcaggcaacccatttaatgccctaaccgtccaagcaggggaaatgccattcaatcaaaaggtataactataatttcagaaatgccaaaggcatgctcagatgggctgtacatttatttccaacagcaggtatctgtcagacgtgcacttcgtgaggtgtgctgtactgagcccattggggcatgactatctctgtccttttgaaacttacaatctacttagggaggcagctactgcagagaagtctgttggatagacaaggaaagtaaatgccagagcaagagctgcaaacagagtgagtgctctggggccccaaggaaggaacaatcactgtgaactacagaaaatctgacaaggagttttagaagcaatgaaatcattaaacatatggacctaaaattcaatgagccaaggccatcccactccttcttcctaggcagtgaccatgaaaggcaatgacctctgagatgaagtcaatttgggataagtgcttttacctcaaattatccaagtcactgtgcccagacaagaatgataaaaacaagatatgaataggactaatgtctttaccttttatgctaaccaaatgcacagcctctaatcttaggacttcactaatggccttaaaataaaaatgttcctttctttagaattgcatgtagtaaatagactgcagtacagaatcagaacaaactcaaaatgagtaggcctgtagaattctgttcaaatctgatacccaaaagtgttatctggaatatctgtcctcttcagcccttggggaaggaggaagagggaatgctggcatccataagtttgaagaatttaacttttgttcgtatagatgttagcaaactaaagacacagaacaaagctttagggagaaaatctgcttgatttagcatttatagctgtttttgtggttaaacataatctattaacagtgatcaatatgcctcaaaaggtgctttcagggaattctgtttggtgatttattgtttgaacccaagccctcatgcagtgtgggaaaataaatgggctgaatttgtgtgtcctgtttttcttcctgttatagctttccctactcatcaagaaacagacctttctaaagaattttggaggctatgaaaaatttcagacttgattgggtggtttattcagaggatgttattttaaggaattttggacaacacagagcagcaatccctaaactttctaagcaaaatattttttttctacagcactaaattctcaacttaatcaacttcacttttcctgtctctatatacattgtacacgcttttatttatagatatagagcattcatttgggtaattaaactttctccactttttttttaataaagaaggaaacaattttaaaaagggagaaagtcttgctatttattgaatgtctattgtattcctgatattttgcatacaaagagacaggcatagggtttgggtgcacacatgaatacactgcatgaagcaacagacttgcatttgggatcatactataaatgcaaactgtgtgtgtgtccctacagtagttacacctgggaaggaagaccggctatgtggaaaaactgttcgtgaatttaagaatatgcatatttggccaggcgtggtggctcactcctgtaatcccagcattttgggaggccgaggcaggtggatcacgaggtcaggagatcgagaccatcctggttaacatggtgaaaccccgtctctactaaaaacgcaaaaaaaattagccgggcatggtggcgggtgcctgtagtcccagctactcgggagactgaggcaggagaatggcgtgaacccgggaggcagaacttgcagtgagccgagaactcgccactgcactccagtctaggcaacagagcgacactccgtctcaaaaaaaaaaaaaaaaaaaaaaaaaaaaaaagaatacgcatatttatcccaacccctcctcccaaatgcagggcagttttagagatttcatgtttctttgtgaccttcttgatctaaaaattcactaagagcaagtatgttagagtcaggtaggcttagtcttgatacctaattctatcatttcaaactgttataggcaattgataaagtatcttccctaagagttaaaatatctttcaatgaaatttcaaactttttcactagcctgatcaattatttacatggcttcctgaagttccatattaaccacattttgctttggtttaagcaaatatcatcttctactttacgtgattggtggaagctgtgttttataaatactttatattaagatttttaaataagatgtagtgatttaaaaaccagagaaatgatattgtcacaaacatggaagcagaatagctctgccaactcctacttgtggagatcgctctgatctccaatattgagcaattaacatttgagttatctttccatgagaagttttgatgaaattttaacggccctctccctcatttccaggatggaggaggattgcaggggctgaagggaaggaatacggaggtttcagaacccacaagcaagtggttcttggcataccctctgccatatgcaaaatttgggcatctcttctctcttctatttaggatgttcatttcttccaaagaactctggtgaaggccgggttaattaacttgcattctcattagaacaacacaaatgacgacacacactggtccggagtccagaccaatcttaaatcaagactttaagtggaaccatgactgaggtccagtggcagctgtaaaggacaagtgaaagattatttagcagaatttccgaatgttagctttagaaacaacccttaattaacaatcattgaggtcccttatgtgctaggtcccatatgcttggcataagagatccttaaggcaagctccttggactcaaggagttcacaaagtagtgagctcaagatctcctacagtcattagcatgtctaacacctccactgttatgtctaacaataaggcagcggacacaggtgatagagcagtaccaaacaagtgacttaactctgtagtcaaggttaaacactggtgattagatagttcaactccaccttcattttgcctgtgggttaactgtggtctacagaaatgcataataaattgaccagtcagaagaacaacacagcagtggttcagggtttagggtaaagaaagcacttgaattgcttgttaaaatgtggatttctgggtcttacctccaagattctgattcaaggtgtaagatgggaggagctgaaacacactgggtaatcctccctctgctacagcacaacacacttgaggcacttttcaatagagtaaaaccccagtaaatgaaaggcttcggctccatagtgggaggcctggatctgaatctggatgtgacacatgttcagagacgataagtggtcagtccaagttcacggtgcagtatgtgttcagtagagagggagtcataacaactacttgcagtgctattgtgagagttacatcagataatgcatgtaaattgctgagtccagagcctgtatgtatgtaattctagccatcattagctgctggccacatggtgtgctattgcagaatcaggacccaaccccagggctttttattcttagtacactgctttttcactgccacacaaggatttccaggaaacactgacattcctgcatcaaaccgaaacgatcaagggctctccctctcaggctaataacttttctttcatttttctgccactctgtccccaaaccacttctctggggattttaactggttgtattcattttagcactgcagaattttagtcaatatatacccttatttttcatgcaccaaatttaatcccataaacatgtgctagagggcacaggtatccaaaaaacacaaagcagagcttgtgacataagaatttttatagtcttagaaaaataacacaaattcaaactaataattcaagatagtacacgattacatattaatatatagtagagaccggaaggactaatgaagtttaaaacaaggagaggtcaatttgtcctaaaatgggaggaaaagatgtcaaaaaggtcatggaacctcagtcaagcaaggaaaaatagaggaatttgctgttattttgaaaaatttcaaatatttacaaattaagagaaactattataattcttacttcctaaagctttcaaatgtgtggtcagaggatcagccacatcaatgtcacctggaaggtcttagtttatttgtgttgctctaaaaaaaagagaaacaaaaagaaaagaaataaaaaagaaaacctaaggctgggtgacttataaagagaggttcaggtcatttgaggtcaggagttcgagaccagcctgaccaacatggtgaaaccacgtctctactaaagacagaaaaattagccgggcatggtggcgtatgcctgtagtcccagctactcaggaggctgagacaggagaatcgcttgaatcccggaggtggaggttgcagtgagctgagattgtgccatggcactctagcctgggtgacagagcaagattccatctcaaaaaaaaaaaaaaaaaaaagaagaagagaggtttatttggcccctggttctgaagggtgtgcaagaagcatggcaccagcaccttcttctggtaagagaatcaggctgctttcattcatggcagaagggtaagggctggtgtgtgcagatcccatggcaagagagggggtgagagagtgagaagagagttaccaggctctttttaacaaccagctctcatggaaactaatgagtgaggactcattattaccaagatggcatcaagacattcacaaggaatctgcccccatgatccagatatgtcccattaggtcccacttccaacactgggggtcaaatatccaaactgcggcactggaatttggtagaaatacagaattccatgccaactctagatttctgtaacaggaatctacatttttaataagatcacatgatttgtgtgtaggctttgagaggtagtagcataatgagcacaaaagtacctatcacccagtttcaacaagtagcaatacctggtcaatcttgttttatttgtacctctgcccattttctccccttatttttggattattttaaaggaaatcccatatactctatcactacattggtaattttttcacagagtacatctttaaaagacatggtcctttaaaaaaaatggctgcaaaacatttactgcacctaaaatatagtagtttatgactattattaaatattacagaaggatttagacagttaagggagaagacaatactctattttggaagaatcagcagagatttaactagctggcttggggctaagggttagtattatcagtactagagtgttgtgaagctgaataatcaaccacaaaatcacctgatgtgaaacacagtgtgttaccagtaatattaattatgtccaatgacttctgtcaggtgttatatcaagggtcacacatcaaaatctaaaaaatgaaaggcacagtcttataaatgggttgcttaggtagtaaaaagtactgaaaatgttaaaacctttaaccctgcaaatggttagtctataaagaaaaataaatttctaacactccagctgaaagttctagctaaaacagatttagaactatctgcctgtcaaagtctgaaagaaggaatcaaccccaataaatgctagcttgggtataaacagttcttgaaggctcaagcagactccagctaaaccttgtaacctctgtggcctttcatggatagtgcctctcttttgaatcaggtgactgaaattacaatggaagcctggacatgaaataaactatcctggaagctatttagagggttaaactagggccagctgtggtgctattgtttcatgatgtttagtgtatttgcatatagagaagatgaagcaaatcagatacactggatacaagccccaaaacaaaataactgatgacagggtaaaacaaaatggtcaatttctgtttcaagggtactccaaagagaatttaaaaactttgacacgttttaggaagataaattcagatggtcaggcaaaggttaacttctggaggacccttgatgtcaggctggggagctggaacttaattccacaggcagtaggaaccacgggagtcttttatgggataaaaacagcacttcaggaaggtgcatctgacaacggcagtcagcaagcgtgagagcccacaagtgggaggaccagcaaagggattgctgaaataatgctgacatgaagagataagccctggaatggttgaagaaggtcaactgaatgtcagccttgagagctacatcagcctcccttcacacaacacaaaagctcttgtctctgccatccaggaccccatgaattccaacctgaaaatccaccataggttgcaggattgagatccccccacacacatcaaaaggaaatcacaggcatggaggtaaggaatacatgacccaaatctgcagattttcaaatgaatttgggttaaatttcctttacacattggaatgtttcagaaagtttataacaagatggagaaaaaatgttgttcacctggatttctttaggtgagcagaataaagcatttattaagaggaataaatttatttgaaagagatgccctgattaaagcttgtagtagaggctactcctaaaagaaagtttttgggttttggccgggcatggtggctcacgcctgtaaccctagtactttgggaggctgaggcaggcggatcatgaggtcaggagatcgagaccatcctggctagcatggtgaaaccctgtgtctactaaaaatacaaaaaattagccaggcatggtggtgggcgcctgtagcccagctactcagcaggctgaggcaggagaatggcgtgaacccaggaggcgaagcttgcagtgagccgagattgcgccaccacactccagcctgggccacagagtgagatgccatcaaaaaaaaaaaaaaagttttttggttttgttaaagagaaagagacgcagagaaagagagaagaaaaaagataaaagaggagagcaagtgtcatgggggaagcggagctgtgctgagtgtgatgtgacaccctgccatgccatgacccttcacattgacagtaaagccaccaaattacaagataattgacatgagtcaacttgtacatctctgggtataaaccagttaaagagcggattgtcaacaaacctgaaacctagcctacatgtgcaattaaatttctgtaagtcaaatatgagagcattgcttaaagggactctctaatgcgtctttaaaaatatgaataaatcatgccccaatttatctagttggtaattaaggtgcttgactatcaggggtatatgtgtatatatatatataaaaatatatatataaatatataaaatataaatatatatcagatatacatatatatacatatatatatgtatatataaaatggaatggtcctgtaacttctctctgaaggcatgacgagaaagagaaagcctggttatgtgattcgtaaaatattcactgtttaaaatagaatcaggggatgggataggcaaggaagatttggaagccctccaggatctggctgagtgatgtgcctcctctcacctggataatgatgttgttaggggctgactgagggatgagtagggtgatggtggctctccattcctcactaatgtccccatccgagcatccattttctcatttatgatctccttgacaccgactctatttacatgacattgggattaatcagccaggagtttttagctgcaggaatcaggcaatccgtgtaactcagcgtggcagcgtgacattatcaccagctaagcaatattcgctctgtatgatcaccatctccagggaacttgctgtgtgataggacttcaggtgctgaagtcataaaccattacactcatccccgagcagtcgtatgacacctttcctcaaggacagccatggaaaaccacactctggatccagcctgatttatcagcaggatcagcaagggcaccgcagaagtttcagtcatcagctgctgcagggaaagataccctttctccacttctgtggcaggtccatatatacagaattacttgagactccaaacacaaaccattatctctgtggcaaattatctctgtggatttctgtcaagttacccctaccactgtatcacaattactcgttggcctgcctgtcagcccccaggagaatgtgaacaccttgatgggaagaacagtattcacagttctctacctggtgtctggcacaagagaagtcctcaaaatatgtatggtgaatgagtgaaagaatgaatgaatgagttttggtgaatgagataatggttattttatcaaagaaagaaaacagaagttggtgttaaatttgcttctcttcttgtcgtattttatcgctcatgaattgaattaatgagcagttcttaataggaaggaggtgctttctagcttaacttctgccaggtaaatcagtggccactgtatcttaagctggtaaagccactcagatggttgaaaaggaattccagcgtttacactaacatatattggaagaaagcattaaatagtttctcacatgactacccttaaatgctcaattccccatccttttcctcttgtgaaatgggcatcagggaacagaaagaggctcatattcaaacacacttgggttagactcccatctgcaccacttcctatttctgtaaccttgccagacttggtttcccaagagcctctgttttcttatctgtaaaaccagagtggtaatctagaccacatgcaattttagtcactacaatacagtgtaagtgaaacgctgagtgtaaagtttctaacatattgcctgggacttcataggtgctcattagtaagagcatcattttaatcaatcggttctctttagagagattagcaatatttggtttgtgggagtaatgggctatattggttaaatcctcaggaaccccttcataattcaatcaagcactgttgtagaaaccaaccaacaatccaaccatggaaacagtgttttaattatgtgctacatctgctggtgtaccccaaggttttcatctgtaagcaattcagtctctcattatctctctccttttcactgaagggcatcacagattgcatatgcttacttctaaatcaaggaagaaggaagtagatgtgtgacccctgcaagccacttaatctcgcttgacttctctttgttcatcattaaaatgaatcagttggactagacaatctctcgggtcttttggctcaatggtttgtgattataggaaaggagtactcatagttcctagataccaaatcattaagtcagtccagttaaaaactattaaaccaactgaagccaaataattttcttaactttgctttagtgggaagattactatatagtaagcccatagcatgtacagatactttgctagatgctctctcatggaatgtcaatcaatagttatacttccatttaagcaaattcctagacaaacctgactttatgtttgtttttataagaggatgttttggtcattcactggcacgctagcatcattctgtaacactgggaggataccataaaggcatttgcatgatggccaatattctctttcactagtcagaagaatgggtttacctgttttggagcacattcgtcaaaagaattcccactaaatctacttatgtgggagctcccatcctcctcaccatacacttctcattcacgcattcaactgcaaatatcagtcttggtattccttttcctgcaattctccataaccacagtgtgtagcaaacattcagtaaatgttagctccctcccttccagcaaaatcctaagagtgaaaggagagccacttcattttaatcctattgcctaaattctcaatgcatcattcaattaatccaacagacatatattgaaactttattttggtaagaattaggtactctagatacgggagaaggtaaataaattaggccattgatactttagacattacaattaagaatggggaagagacacaaaccaaatacacccacacacacctacatgtatatatgcatacaaactcattctattttctcactcctatccaagttttaggttggcagccaggccctttatctttcttgtattagggacttactagtgttgaaaacataagccacattctaggtagagggaacagtgtatgtgacatctctaagtcaggaaggaacatcacagcaatgaaagagttgatggcagatgcgtttggaaggcagagagtggaaagtagaggagcctaaagtgagccttggagggacagacacatgcagcaagcagtgccatgtcgcacaataacttagaggttctaaaagtattttaaccgtttttctacttgaaaaaaaattaaagacatcaggagtggtctactccatgttgctttttaagttttaagaacatctcttttgttgggtcgagtgccagtctccacattcaatacttaagtaccaggtgaccgcagagaagcataataatagcattattaaaagtaacagctgtcatttattgagaatgcctaaagttctaagctaagtactctatatccatcatctaatactcatcttctatctacaccctgaggtaggcattatttttgtccctaagtgacagataagaaaatgcagttaaatatcttgtctgaggtcaatttgtaaaccccaatttgtatgattctaacttctctacgcttttgcctgtgtcccacactttatgtctcagttctccacacccatagctctgctatctggacaaaggaaaatcacaaatacaacaggtgtaggcacatattcataagaggttttaaagctgaatttcacagaagtaaaaaaagcaatttaacttggtgttttctttgtttggaggcatattaaaaagttaatgaaaaaacacagtagtggcaaaactcacttgattttgaacaggaataaaacttttctcaattaatacaagtcatcattttaaaggcaggcctcatttttacattatgccgagtttaaaactgaaaagattttttaaaaaccaaagaaagggaaatggaaataaagaggaaagctatactagaaggaaaactgattggatgacaactaagaaaatgacaaaatcacaaggacaaaaaaggaacaggacaaacagcagaagaatgaatgaaaagggtcccactgtagagggcagaggagatgccaactcttctgcaattcacccaagtctcagaatttcatgcttcccattaccgttcttagagaaaccatcagattaaaaactactgttcacagttctcaagctgttcttttctcagaaactggtttgtttctgaagggacagctcagcctatgtggagggtattcatgcagacggaagcagaggtctacatataaaattagacaaaaaaagtcagaagtttctcatcttggtttgaaaatattgatagaacaatctccttttttctaacccctggaccatgagaattattacatgtgtcaatagtttcttctttcatttatagctaagctccttcatttggtttcatcaaaaagtaactttctagtgatccttttcaacccttgccagatttttttttccatttctaatgcatttttttctagccatggcccacaataatcaccaaattagcaatctgaaagcaactgatcatgcctatagccatttcaagaatcaatgcctagggcttggaggcacagagtaacatcacttggcaaaccgccttgaatgactatttccattcttattgaaaaagactgacttttctgcaaggtttctgttacgttagtagaaaagaaaaacattgcattaatagcctcaaaatgtgaatgacaaccaatttgtatctctcttttttttttttggtgggggggaatagggtctcactttgtcacccaggctggagtgtagtgacacaatcatagtgcactacaggctggaactcctgaacttaattaaacagtcctccctcctcgccctgtcaaagtgctgggattacaggaataagccaccatgcctggccaaaatgacatcctctctgagcttacctctctaacacttcaaaccatatttgtgttccacactaaaactcagcatcttttctgcttctctttagctcccattcccaacttttcttcactaggaccctgtgtttctgctttccaaagccagaaatctggactaacactgacatgttattcttctccatatgttattccatcatgtttagaatcccagacatatgcacagtccggcataccagtggagtgaaaagagtgcccataggactcagtggtagcatttgcaaccttttgatagagccaagaacagacagccttactgcttctctgtgggactaagactctgaaggattgcagtttgaattggatctgttgccctaagctgcattccatatatataaataaataaaagacacgtagacacacatgtccattagtaagaactcttgttgcaacaattaacaggcatcagctgggactaatttaagcaagaaagggcaaaaaaggggaagttattacatttataaagaggcatggcatggatcaaaagccttgagggctgaaattaggacataaaaaccatcaagatccccgcagtgttcattgtccatgtttttccttgatttctctttgcttacctgcatttttttcctttctttcgctcttcagttcacattctgggtagaccaggtccaccctggaactcctagagtttctgttttctgttagttacagaaacagctgctgcccctcaattctacctctagtttcctggagtgggaaatctgatatcaaccagcaatgagttagaagagctgagtcacttgctataaataagcctgctgagaacctccccttgttgccctatggatatgtggagatgtctccagaaaagaggggtcttgtgagttgggcgattctccacagcatctaatgccgcagggaaatgacaacagagctgttattgctgaaactgttcactgaaagaggcaatcattcagggctgaaacaacacaattaaggctccttcccaccctctcttcactctgcgcacttaaactacatgataccctcacacttactgctgcagtcatcaacctagcaacaagaattgactactgcaaggatttttgccacaatcaccactgaacctgtccaccctgaaatctgcctgtacaacgagctcaccatcttcttttttaaaggacggcatatgtatttagtctgttctcacactgctataaagaactacctgagactagataatttatgaagaaaagaggcttcattgactcacagttctgcaggttgtacaggagggctggttggggaggcctcaggaaacttacaatcatggtggaaggcaaaggagaaacaagcacatattctcacagccagcaggaaagagaatgtgcgcagaagggaagtgccacacacttttaaatcagcagatctcgtgagaactcactcaccatcacgagaacagcaaaggggaacctcacccccatgatccaatcacctcccatcaggcccctcctccaacactgaggatcgcaactcgaaatgagatttgagtggggacgtagagccaaatcatatcagcatgtttctaaaaaccagtataatgtgccatgctttcccgatcttatttttcataaagcctcagtctcacagctataaaaacacaataaatagtatgattcttggcaggggcatagcataggctgagcaaagtgtctgatctctatagcaaacaggtgatgatagagaactcaaacagaaacatattcatctaaaagtaaacaccaatttctctatgctaagctcttactccaattaaattagcaaattaccacataacagttcaataagatagagattcccttgttttacagactacagatcagagagattaaatactcccattaacagtataaagaaagcggctagagtttagctagctagttgttttcccctccttgaggcttatcgaagtttttgctgcttttcttaaatcctcacccccattctcttattttcagaattctgccatctctagtacaagtaagtgggtttctgcttccaggagaactttccagccatgtggggtgagggagcctagagctggtgagcctccacataaagaaatacagcgttaagcaaggcagctgcatgtggcacattaatcactcctgatgctctgggagaagtgagatacaattataagccagctaatcccctagttcgttggtagtggggtgggaaaactgttaatcagcatcacaaacacatttggaaagaggcttccaatagacagcttggagagaacagagataggctgatcaattcaacaggaaaatctcttatttgtcacatctggaagcaccctggttaagtcttaattagattgggtagtaaagaagatctcataaacacaaatggtggggaggggtagagagggagctgaaggctagtcagtcaatacagttggccatgctccaagtatcagaaaagagcccagagtcaggagcacagacactgcttcatcagggaagtgtgcgtgagaggcatttgtgcgctttccacctttctttccttcatatatcaattaaaaaacaacactaataggccgggcatggtggctcatacctgtaatcccaacactttgggagaccgaggcgggcagatcacctgaggccaggagtttgagaccagcctggccaacatggagaaaccccatttctattaaaaatagaaaaattagctgggtttagtggcaggagcctgtaattccagctatttgggaggctgaggcaggagaattgcttgaacctgggaggcacaggttgcagtgagccgagatcccaccattgcactccagcctgggaaacatgagcgaaactccatctcaaaaaaaaaaaaaaaaaaaaaaaaaaacaatgttcatagaagaaacaaagcctctctgcagctccatctaaaacctaaagaatgaaagaaccatctctcccagcaggatgaattagttggacattgactcccagcctttttcaccagaactccttttacaatttttccccataaacggtatgttttattttcgtaatcaaatataaaataatttaatctattcactcatttttaactaaattatacaagaatgctaacctgatctctggatcatggtgatataatcaatgtaatcattatccagttgaagaaatatctaaaagctggaatgacttggctattctgtataatcaagaacacaaatgcatgtacaattttaattgggcatctgtaatataaaaaagcttagtatattcattaccaccttttttttaatcccaagaaatttctagattagatggaatacactgacccagatccagatgatttccaggccccctacatctttttagatgtggagacttatattctgtgccagtgtttttctaaggcaacttagagcatttggtccagtgaagcttcaaaaaaaaaaaaacaacaaaaaaaaaaacacagaaaaacttcacatgtaacattacgcatggttctctttggaggaaagcatagtgaatcaggtgctgtgcttctcatcaagaatgtgacttcccattacatgattaaatgagagtaccttcacctgaaccccgcagcttagtgccctaccattcaagcaacgccataccagcagaaccatgcttttgcagaatggagtgaaaaaactctcatatttatcattagtaacaaattaaaagtgaatcagagaactatgtatagtgttaaatcatctggagctccacggtcaatcagattttctacagatgaggcatagggctcactaactgattgcaaacatcacctacaatttgggcttttcctcttctaacttgctttgcctgtcaatggaaaagctcgtatctcacttaaaagctatttcacatttgaggatcattaaatcactaatgtgttttagaacagactaataggtaaagggacagcacttctagaatacttacactcttaagtgctttacttgaatggtctcatttaatcctcacaaatatcctatgaaatcaaccttataagtatagttcccattttatatctcaatattatatattacaaacaatatataaaaatatatattatgtttataacatatatataatatatatagtttgtaaacaatatatatattgtttgtaagtgcagaatcaggatttgaacacagacagtgtgattcttgagcctacatatttctagtatcccataacgttgtatttgctaggagtagagagaaattaaaagcccatctgtatgtatagtttcatttgatccagcctgcttgaaggggaaaatgtgaaaatgttttaacactttggtcataagaaatgttgagttattagatcctttcattttgatacagcaataaaaaataatatgaataaaaatagtataacaactattttctcatagaatttacattgtaggtattctaagtaatctacagataatttaatgtaatgtgtataggttttatgcaaatagtacaccatttacataaggacttgagcatctgcagattttggtattcacggggtcctggaaccaatctctcatggatactgagggacaattgcattcgtgagatagaaatgaggagtcttgaaccagtgccagtattctctatgctcccagacacatataatacagacctatgataattgaggagagagttgatgacactggcataagtgaacttaagtcctctgcccaccaagcctagaggtgatctcatcaagctatttgggttgattggcccaaagagtcattgcatctccctgagctggttccatgggactgttcttaacagagatttcaacacgtaagagctatacctgatagaacaggctactgcctcagatccaaagcactgagacctttttaagcagcgcttccttctcatcctgcatctcacgaataccctctgtgaaaatatctgtacccagaccaccacccaactctcatttgagtgaaggaaatctcatggttaagaaaatgccaaattctaaaacatttaattggatgctataatcatcctccttatcgttcaggcttctatttataaagaaggctccattcttgcttgttttctatgtgatcatttatgttttaaattaggaaccaggctgggcgcggtggctcatgcctgtaatcccagcactttgggaggccgaggcaggtggatcatctgaggtcgggagtttgagaccagcctggctaacatggtgaaacccctgctctattaaaaatacaaaaattagctgggcgcggtggaacacacctgtaatcccagctactcaagaagctgaggagggagaattgcttgaacctgggaggcggaggttgtagtgagctgagattgcgccactgcactccagcctgggtgacagactgagactgtctcaagaaacaaaacaaaaaattaggaaccaaatatatgaagtcagtctaccaaaaagctcagtgatggtgagatgcttccatggtgacacaagttatgtaactggctgtgaagtgtgtgagggcaggctaccgcaagctcctggggaggagcagtaggccaatgtactcatttcagaactgcatacagccctgatagcttaataagaatcaaacaaccataatatgtttgcatttctatctggctcccggactcaaagaaacttgaataaatattggcacattttataaatgagctgtgggagtggggaaacccagcatctttctcatataaaatcagttccaggcaaaattgtggagaaacttggtgcaattttcagaatactgaacattatattgtttttcctgcaaataactcatccaattcttataatatccctttgaggtaaacaccagaaaaggatcattagtcccaattgcttcagctagagaggctaataggagaaacttgctcatcaagagccaaaccaaatttcaaagggagaaactttctatgtgctttgttttgaggtcactttattgatttttatttatttatttattttgaaactaggactcactctgttgccaaggctggagtgtagtggtgcgatcttggctcattgcagcctccgcctcccaggttcaagcgattcttgtgcctcagcctcctgagtagctgggattacaggcgtgcaccaccaggtcctgctagtttttgtatttttagtagagacagggtttcaccatgttaggctggtctcaaactcctggcctcaggtgatctgcccgcctcagcctcccagtgtgctgggattacaggcgtgagccactgcacccggccctttatttgtttttaattcctccatgtagttatttacagccaagtgtcaccaaacaaagctatagaggaaaaacggagattcatcaaagactgaattgaagcttcataagcttccctagatggggaaaacgaaaagaaaaacaaatttctcctacagctgtagaaaacatgtaggaaaaacgtagggagaagcagctgagaaggaaaagcaagcaagcacttagccatgtaatgtatacgggtcctaaaatcagacagaggactgtcgtggggtgggtggggggggagagacagcattaggagatatacctaatgctaaatgacgagttaatgggtgcagcacaccaacatggcacatgtatacatatgtaacaaacctgcacattgtgcgcacgtaccctaaaacttaaagtataataaaagaaaaaatcagaggtgacttccagctctgaatcggctgcctagtaactatgtggtctcaggcaaactgcttaaattctctttgttttaaactggtaaaatggggataaagaggaaagtagacactgcccacccccaaccctgggcagggggcggggggggaggtggtagtggtgaggactaaatgagataatgcacatttaatattcaatattatactctgtcttttaatccctgctcatagattagcaacaattagttcttttttggagactaacagaaaagttaccaaaaccgaacttcaaccaaagtttatggcatgataatctttcaatcctgaatgctaataaaaatgccaagggatcacctttagagttaatgcaaaataaagaggagtcatttacaaagcaaaacataaataaactactaagcacaattaagctaagtaatatgaaagtaatctaaacagtgtaaaattaaaaaaaggatgactttctttgtaaacaaaaaggaaaaagaaatcacgcctgtaatcccagcactttgggaggctgaggcgggtggatcacaaggtcaggagatcgagaccatcctggctaacaaggtgaaaccccgtctctaataaaatacaaaaaaatagccgggcgtagtggcgggcgcctgtaatcccagctacttgggaggccgaggcaggaaaatggcgtgaacccgggaggaggagtttgcagtgagcgtagatcgcgtcactgcactccagcctggcgacagagagactccatctcaaataaagaaaaaaaaaaaaaaaaaaggatgacaaacttctgaaagtatgccaaactaactgaaaattctggccctatataatgttgccctcttgtctgtcctgtagaaacttctaaaatgtaaatgtgccaagaatattttaatattctttagcatgagccaaagtcacttaaatgttctggtctgattctttcctgcttctcagaataactgagctcagcccaatctttctggaaaagcagcaggaagaagcatccttctttcctctctggctcccctgcgggatcagctggaagggatggggagcctctcagtctcagcagtcaccaattaaccacctcctaagagctcagcagctgatctgttttttaaagagactagacatcttccaccactgcaatctatgttaaatagaactagacatctgaccacaataaccgaaggttaaataaacatttcttcacagaatatagtaaaataaggctacttactaacaactaaggccccggaacagtggttcacgtctataacctcaacactttgggaggctgaagtgggaggatcacttgaggccaaaagttcaagaccaatctggacaacatagtgaggccccatttctacctaaaaagaaaaaaattagccaggctcctgcttaagtccaggagttgacgccgccatgaatcaggatcacaacactgcagtccagcctgggtgacagggtgagaccccaactctaataaaaataaataagtaaccactaaacctagtaagacagtggcaaagtgataacatttatatccttccaggattcccaagttactgttatcaccgcactaaccatgctacacaataggcaatgactccatagagtaacaccctactctatgatatgtgtgttgctttaactaatggcccagggttttggggtttttttagttttcttcttgccatgttaatttctctgggggcttatgctcagatcagtaggaacgtcagcggcaattttcctttattgactttgggttgcactccacatttaattatgccagataataactgcagaaatactatatggaatccaagtcacatatccagaacacagggacagaacatttgtgaattcaccccttatggtatttggcccaagactcaaggacaaatttcttcactgagcagctgagatgtcacaagtaaaataccctctaactttagtatgtaaagccaatctttagtttataaagacaagaaaagcacctttctgaatttaggccagtgacaagaactctctaagcctcaatgtccccttctgcaaaatgatcatgattaatatcagcatgcatctcataaagaaaccggattagggttgttgtaaggattacataagatgatgtatactgaacacttagcatagtacctggcagagtagccaaaaggatttggtagcagcagcagcatcattagcacttaaaaaactaatgagactggtgaaactctctgaaagttacatggtatttaccagcgttggaaatgtcaataccttttaacccagcagatgtatctcctggtatctatcctagagaaataatctcatacacagcccaaagagcatgtaaaacgctgttaatataatacttgtttgctataacaaaaaaatcctcaaataacttaaatgcctattattgacaaaatcattaaataatattttattgtacaatgtaatactatgcaatagtgttaaagaataaggtagatttacatgtactgacacacataaaaatctctaagatgtattattgctaagcaggaagaaaaatgcaagttcagaacaaatgtgtaataggaaataatttgaatttagggaaaaaacagtaaaatacgatatattttaccacataaattcccacatagtgatttacccaggagagcacattggaaacagggtctctcttgctgctgcagttaagcatttgatgatgttgtctatctctgctactttctgaaatgtcctggccaagaatgaaatatacttagataaatgttgagttgcaaagcaagaaaggacaacttctaaaggggattaaaaaaaaaaaaaaagaaagaaaagcgagaaaggagatttctgataacttcagcattaggatccaagggggcctgaagctaggtctatcagcttgacattttagttacaggagcaataattcctctagttacggagtcagttttagtcccacatgtgatttttaatttgcaattgaaatacactcaaactcccagttttttttccttcccctacacccatggtttttaaacatttttgttcctatattcaacagaattttatatagaggcccagtatgtaaatccagctatctagtgaaaggtgaggaagtgagaacacagacctcagaacccttagattggtccgacagaggggctaaggcactacatttgaaacaaggctttcagagcatgtgtctctgtttcctagacaaaccaattagtgttaaagtgcctcgatttctttatcccaaatgagaataataatatgttccctatctatcttttaggctttgataacatgaaaagcacagctcttaaggcattttggaaaaatgcaaatctttcttaaattaaaaattcttgttccagtttcaaaactgagtccataataaagatttcattaaccttaaaatgcactatttcaagcaaagagatggtagcctttaaaacttcacagtgctgtcaaccctaaaatacagcaaactcttaagcacatctcctgtaattatgcttgaaattatcacagtaaataaaaggtgatgacaaatcagacagccacggatctcctgttgtggtttagaacttgtatctataaatttcattctgtctttgagtctggtgtaatcatttctggcattgtagaattatccagcagcgcaacaaaaacaagaactatggaatgacaataataacaacgaatagctttacactggcaggaaagggcctggcatttaccaaattctaaaacagaattctcaaagagactcacatcatctagatttataaagagctttggggaacatctagaatcaggctggtaaataagttttctctcttatgctaacttggatctgttgggtagtgactactttttaaggccatcctacttccacatgaatgtgttgtgacagatgggcaatatcttccttgcacatggacaaataaaggggtggctctcatgctgtgtacagggaacccctgattttaccagcggggaagtgaactatttttttttttttttgagacagagtttcactcttcttgccaaggctggagtgcagtggtgcaatctcggctcactgcaacctccgcctcctgggttctagagattctcctgcctcagcctcccaagtagctaggattgcaagcacctgccaccacacctgactaatttttgtatttttagtagagatggggtttcaccatgttggccagactggtctggaacccctgaccttaaatgatccacctgcctcggcctcccaatgttctgggattacaggcatgagccttgccggaagtgaactattaaacactgacacagctcaagaaggccatgttggagcttctgtggttatcccaagaataaatttatttgttaagatatttaaactagatttctcaatttatcccaaagatcccaggcttctaattcattctttttcatgctctgtcacccattcaaatacactattaagctaaaaaaattttgtcagaaggaaaaaaataatgaaagagaattctgtaagacaaacctttttaatcataagaaaacacttccagggaaatgttaagacctctctctggatcctcagtcattaagatctaggctgggtaaaaaaactggaaagcatctaaggaaaaagtaaaccccgttttgccccatgtcttcagggaggaggacatagcaatgggaattttaacaagacttttctgtcacgggttctcattcaacctgcaggttttatgttggaaggtaagtcttacaatgttgattccgccgtctgaatgattaatgttctcccttgccagataaaacgatgctctttttgtggagatataagggaaacaggcaataactgcattgagttttaggaagaacagctctccagcaaacaaagcaatacagtttttctgattttctttaacattatttaacaagttaacgagtcttggtactcattctggtgcgctccttcccttcctgtcaagcttgctaagtatctaatttccctattgtcttcagctgttcaaggtcatcatggcccccaagccaccctcctccctgccacaatctggccctgtcctatcccttcagcctcaagtttcaccaccaccagccccttctgccagccctatgatgcctactaaattcggcaatggagtgtttcattgtgggatttcatgattaatgcctgtctaccccactaagataaaaagctccataaaggaagatctgtgtctatgttcaacacatagtcattgaatggaaccaaatcatctttccgaaagtcctgctcacttcacgtctaggtttttggtaatgttccataaaagtaggacttccacagcttgtccatactgatattctcctggcgggatgtgactttccttgctggtgttcccattcttgttcacacgaacaacaggttgcctacaaccatcaatgtcaattcttttctaatttttctcttctctatcctgctggaaacaacaaaaaaagcctgtgatggagaaccatgtataatgaaatcaggagatctttctttttaaccatttgttttcaatatttttctggtgatcttcaccttgattctcaatatcaatcttatctaaccaaataaatgcctagtcatcacctcattaaacaagaaaacaaggaaaaggaaaagaaagaagtcaagatatcctgcatgactaacatggccaaattctgtgtttagccttaaggattcaaaatataaataaatacataaacacacacacatgctttcccccacaaaagaaaactcacaaataaataagaaatgtgccctgattttaaaaaaacaagcaatgtaatttatgaaataaacaaataaataagaaataggtcctgcatttaaaaaatgtttcattctaatttgtaaaaaaaaaaaaaaaaaaaaaaaaaagttggcagggcaccgtggctcacacctgtaatcctagcactttgggaggccaaggtaggtggatcacaagatcaggagtttgaaaccagcctggccaatatggtgaaaccctgtctctactgaaaatacaaaaaattagccgggtgttgtggcgggcgtctgtagtcccagctactctggaggctgaggcaggagaatcgcttgagtaggttgcagtgagccaagatggcgccattgcattccagcctgggagacagagtgagattgtgtctcaataaaaaaaaaaaaaaaaaaaaaagtgacaactaaacaaatgcaatgatgtattataggtgctgcatcagatagatggaaaggggtgtcagttttatattgaagggttaacacatgctgcaggagatggatggcatttgacataaggctttaggaatgcatatgaaactgatagtgccctgaaagatagggagtttaggccaaaagagaaggatgcgcatttgagtaacttcagatccttcagtctggggtatcaggccttgagagaccaggaccgtattatgaaggaccatcaatgccaggttaaagagctggactttattctgcaatggggaactgctaaaggggagcgatccaatcagacttttgttttaggacagtggctataagcttaagtgtgcataagatttacatacatcaaacactgagattctgatccaaaatacctgatttcattataagggtcctaagaagctgaattttaattaatcctggtggttttcaggtaagtagtctgaggtccatacttttcctaaatttgctgcaaataggaaattgcagctgccactattgaccagaatgaaaaggtcaataaaatgaatctgacctttcccaatgttcctactgtacaactgggaggtattttcagggtatgcaatatctgacttgaacttcatatttgtagagtgttacagggcatggacaacttgggcccagccatgcattctggttttcaattcagctcatcaccaattctccacagaaagggaaaagggtcaacctatccattaggcagagtttgcagaatgcctaaggcacacacaacagttttaaggggccatgccaatattttaatttattttaaagtcaggaaaaaaaattttaagttgagaaaaatgtttaaattaataacatggatatatatttatgtgtgtgtatgtgtgtgtgtgttatgtgaatatatatcttcttttttttttttttttttctcagttgtgttcttattctgtcacccaggctggaatacagtggcataacaacagtgtactacaactttgaacgcctgagctcaagcaatccttcacacctcagtctcccaaggaggtgggactacaggtggatgccaccatgcctaatttttttttttcttttttgaaacggagtcttgctctgtcgtcaggctggagtgcagtggtgcgatctcggctcactgcaacttctgcctcccgggttcaagcgatcctcctgcctcagcctcctgagtagctgggactacaggcacgtgccaccacgcccagataatttttgaatttttagtacagacagggtttcaccacgttggccagatggtctcaatctcttgaattcgtgatccgcccaccttggcctcccaaagtgctggagttgcaatcgggagccactgtgctcggccacctggctaatttttaaattttttgtctattttgttcaggttggtcttgaactcctggcctcaagcaatccttctgccttggcctctaaaagtactgagattacaggcatgagcgactgtatgtggccacattaatatgtttattgataaatatatttaacatatttatgtttatcaataaatacatgtaatatatatttctgtactactaataatatatctatataaatacaatcaaaatatatttttatggataaagagaccccaaatgcaaaagtgcctaaggtctacacaaatcaacatacaacccagaaaggatgggtgagaaaatgcagaggtttaaaaactctttacacattgggcactgacatgagcctcatgtacgtcagagggtgggaaaagaagtgtatttttgatataaacaggaggcaaagaatctgaaaagaggaagggctttgattccaaagaagggattatttggctttctaaatttctgtgttagttgctgaaatctaaaaacctcccagaaaaatgcaatcttgaattaggataagcctctcatgaggacccaaaacactgggtctaccagttagcatagaaggtatgaaagagcataaagcaaagaaggcttggtatttcataagcagtccctctatcatgatggtggctacatatttggatttcataaagtttccaggaaaggatcatctggcattctgttttgttttgctgtattttattttattttatttatttattttttgagatggaatctcgctctattgtccatgccagagtgcagtggcacaatctcatctcaccgcaacctctgcctcccgggttcaagccattttcctgcctcggcctcccaggtagctgggattacaggtgtgcaccaccacacctggctacttttcgtatttttagtagagacagggtttcaccatgttggccagcctggtcttgaactcctgacctcaagtgatctgcccacctcggcctcccaaagtgctgggattacaggcatgagccaccatgcccagccagcattctgttttattttagataaagtccagatgtcagtagaacaagtcattaaaaacaaaactaccatagtggatgtcgataagcccacatgacattatgcaaccctttccactttaagattgtctgtacagccctgataggttattattttgttactgtcgctttaactcacttttctaccagaaattttattattaggcatggtatctattttacgtaaggaaaatgggttattctgattatcagaaaaagtactttacatatttttgttaaagttgctcttatattcaaacttctcactttagcattcaaagcccttcaacacttggctacaggctaactccacactctgttctcacttttactgcactctagccaaaacggaccatttgtcaccgcagtgcgttgccaatattttcccaatgttatgtccctgctccagttgttccctgaaaatggagacccatctttacccaagcccatctctcatacccctgtttaggaagcttgccgggtgcgttggctcacacctataatcccagcactttgggaggcagaggcaggcagattgcctaagctcaggagttcgagaccagtctgggcaatgtggtgaaaccctgtctctaaaaaaaaaatacaaagagtagccaggtgtagtggcacatgtctgtagtcccagctattcaggaggcggaggtgggaggatcacctgagcccgcgaagtcaaggctgcagtgagccgagctgcaatcatgtcactgcactcctaggcgacagaatgagaccaagtctccaacaacaacaaaaagactttactctctggctacctggatggggcctttccttctttctaagtcttttgatactgttttgtacctttcttattgcctcaatcattttaacaccatattttagttatgattaggtattttctgtcttgattatcagactgaaagtaagtgcattacagagagtgagctttagtatacagcaatacatataagtggtgctcagtaatgcctgacaaggtctttgtaacaacataaattaccttagcatgtcatctcactgtctttccacttactttgcctcatttttcttcatggtccttaacactactttaaatcctatactctacgtttatttgttaatttgtctttcaattagggtataaattccaccaaagtaggagggcattgtttcattcactgcggtagccccaatgactaggacttttccagggatgtgatatttgcaaagtaaatatttttcaatgaattatttaataatatctaataagtacttataaatgaatattttatggcgtacgtgaagatggaaaacgtctcatgaccttcagagttgagctatctcccctatggaagcttacttaagtgtacctcttcacacccattcacatcgtaggtgacaccattttttggatggagtagaaaagcaatctgtattcagcccaaaggaaaaaccatagaagggacagaaccaaaaaacagaagggtggcttttatgaaggagctattttgacacagccacatgacactaaggccatgtttaatgacagtagcggtaaatttgtgtttcagaaacctgtactaaggactctttaaaaggagaatagcaacacattgagggcaaaagagagtgtctgagagagaagcagacaattattgcggcactactcacaatagcaaagacttggaaccaatccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtggtgggaattgaacaatgagaacacatggacacaggaaggggaacatcacactctgggtactgttgtggggtggggggaggggggagggatagcattaggagatatacctaatgctaaatgacgagttaatgggtgcagcacaccagcatggcacatgtatacatatgtaactaacctgcacatcgtgcacatgtaccctaaaacttaaggtataataaaaaaaatacaccccagggcaggtggtgagctctgctgcctgaacccaaaatttcagccatctaagaaaatattttgtctgctacatgcctgggttgggacctgtcgtaagtttaagtgctaaaacttcttcattgttacatttctattactgggaaactccagcttctttaaataagaaaactttcccttttgtttttcacttagcattgaagtttgtctttaatgtattattcaggtttgggcaacgattaattaatcagaacccttttgtactgggagactagaactaagtcttggctaaatcacaccagatgctccaaattagattctgtcaagtggatgacggtatcaaacattcttgttaattatgcagtaaaaattacaagaggctaaagatgaatttggatttttaggagtaaaaattttcctggtgtcttggatatatgtacgatgctaccaaaattccacctttggctaatattttgtgtgaagagagaataattattaaacgaaacgtaatatatctcagcttagaagtttcgcttcaagcccatttaatgagggatatcagtgcataaaattagtttttccacaagtgtacatgcatattccaagtgtttcaaggaatctggcccactaaaacatgatcctgtgagaaaaggtctaatcagccaaaaaccttaacccttaactttaaaaattagcctaagggggagattcagtcaaaacagatatatttgttagttgtattcctgaatctcaggtattagcggattcagtttaatagctgatgcttacacataatggttagatttctttctcttttttttctggcaacttactttctagggctgacaggtttttacagaaaatggtcacttttaaacacctgacagagaaaaatcacatgtgagaaatgaatcaatcaaagaacaggagtgtatgcttcagacataaggaaaattccttttccacaatcagaagcagctgattcctgtgaggagaagactctaagacattgctttctgattctgaaggatgtattttgattgtagaacagttcaatagaaaccccagtgagaataatggcactctatttaggctttatttccagaaccttctagtcctgctaaaagtaggcacaaaatggctttagtggcacctctcctcaaaactgaattctgtatagaatttaatatgccacaagttcatcttgtcagcagttgaaccaaagctcctgtgtacttccaagaaatggatcaatggacacttcagtccattcttacagcacagaggaaatgggactgggtattttctttttagaaccaaaagtatcaaccaggccttcttaagtatatatatggttttgcaggctagagagtgaagctctctactatgtcaaagaagagtgggctgaattttcccattgctcaggcatcatccctccctccacatctttacaacaatctagatgagtcttccttattcattcacatatcctttcagtcttttattcattaaatcgtttaatatatagtatgagccaggttctgtgtgacataaagttttcttccttctttccttcctttttctctccctccttccttccctcccttccttccacaaataacaattgaacacctacaatggatcaggcactcttttaagtattaggcatacagcagtaagcaagaaagtctagaatattgttctcaaggagcttatagtttagtggatggcagcacacaagtaaatagaaacaataaatgagaacatttcaaatttcagacagccacgtgttatgaggataagaaaacaaggcagtgggatagagagtgcctaaagttgatgtaatacttcagatctttccaaggagctgaaatcttaccagccataaaaatatctagtagatgagcaattgtccaggctctgagctgagagccattttgtcaagtccatagtacagaaagctcagtatgtgtctagaatattgaattggaacctgaaagatgtttacaatccagtgtggaggttcttaacatgtttctagttgtcaacgccaatgggtgtatgaagaaagtttagacagtttctccagaaaaacacccatccatgcttctaggcacacactaagtatttactatattaactcagggggttcatggatcttttgaagcccatttgtataagccctggagattcatggactcttgtcagagtggtagaatgatttttagtgttatgatgctgctcttaaaataagattgaactaatttgtactggcttgcatgtctgtgccaagcattttcagatacattaataatttaacatttataaaatgaaaccaagaattccagagatgcagtgagttgtttaagacacgctaattcatgaaagggctggtacttgaacccaactttttagatgctaatcctaccttgccaatatcctcttcctgacttaaggactaagaaaattgttggcacagacttttcagtgacataaatcatctctgtgtcctaccctgccttggtcttatggactactggtgttgcacagaactgttttgcaaagtcaccctaaatggacttttacagtctagcctcagcctaggcttggatcttttgttattcatgcttcaattgttgctacccacacctaagaatttagaatttagtgtcatctgcaggtttcattagcaagctgcttattacagctcttccaggtcattaatgaagctgttaaatatgtctggttctggacttccctgtggaggcctgctggctacttacgagagactcatttatcatttctcagcactgggaatctatggacagcctcagactcagggatgacactccagtccaaatcaaggatcattttcagatttcaagatatgtctaatcaagttgcatctcaggtaactgaaccttgagaggtatcactcactgcttctaagaaaagtggccatataaattatcaacctattgggattctttttttaagttaaaggaggtataattacccaggacaacaaatgtgatgaaaccctacaggctaaatcaggctgaatgtcaccttagttctccacatcttcagattcaagtattatttactgagcacctactacttggtaagcacatttgttaagtatcagcactttaaaggataatgcagacataagttaaattccaacctccatggtcacagaaacactttcagaacaacgacattacagaaatcttaaatctgcttctggactcccaaggatttattttcctcttcttctcatatatctccatgaattcttattctgctacctgtcaacttctgttctataatgggaattttttttcattgaaatttgtaaattatattctagtgaaataggcccttattagaacattagtgatagaaaaaggcctgaaatccatatttgtagaaaatgatcctttctttctcattgtgttccatagaagattcacagcaatcaaaggaactcttctctttctcctctagccatttttactgaaagccatgtagctcgctattactttaaggatgtaatccacacaaatcaaatatcagctactttctgaatatggcaaaaccatgagtcaatgatatatctaactttggaatacatttcctatgtgtaaatcaaaagcctacagtccaaaaccatgcttttccctcgcttatagccactcaattatttcactctactgtctaagaaaccctgtcccaagtcaaattctatttaaactctttaattgtgatttccgctagcagagtactgatgcattagtctctccaaatatgtaacccctacttaaactttaaaatgcatacctccggggaaatccactttacacacttatgatttattatattgaaataagaacagcttttagcaggctttttgccattactggaagcctttaaaatatttagttcaagaacaaaacaatccacgggtcacaatttgccagaagtaaatgatgataggcaaaggttaggtacgtagttgtatataaactgcagagtgagcaaacacatatttattctttaccagttgtatatttcttcttcaattagaatttttagtcaattgaaaaaaaaatgtctccaactggaaaaaagggttgacttgtatctttgaagagttacaatatttgaaactcacatatggatagcaatacaaatttttcccactgagttcactgaaaacgcttgcaaaaatctgcctggggtaaaagaagaggcaaatcaaatgattcagaagcaaaatacgtttcattataaatacaaataagcagatgccctggtgtcttgtgaagattttgctttctttccttcactgctaggggtttccaagagctccttcaatcatatagtttacctcctgctgcacacaccttgtctgcatttctgaaatgcacatgcctgtctggcaaacagcactcgtttctatacagagtccctatgggggtaaaatcaccattgaagtcagtagttttgaacctttattgcacactttagaatcctctatgggaataaaaaactgctgatacctggaacccatcccaaacagattcagattgaattgatcagtaggacccaactatgagaatttttaaaagctctccaggtgaatctaatatgtatcaagtgtcgaaggctaccgattcagataaaatttatttgtaaatgacttgacaacaagtggttgaaaacgaatatgcagtatgattcagagaggggaaactagaagtaaaaatattcgcaacagaggtgatgcaagtgaaaatgtgaacaacaatgcaaatattttaactactttaacatttttactgtgataggttggtgaggcagactctggaacaatgcagaattctaactataataacatttttttaaaaaaggtatatgtaataattgggaacttttgttggggggtttcctgaggaagcttcagctgagatctaaagaatgggaaaaaatggaccaggtaaagacagaaagagtccaagtagagagattcccatgtatgtatcacctatgtgacagaaaagagctggacacgtttggtggacagaaagaaggaaagtctggctggaactgagggcaaaagggctagaattttaacagggagtcaaggataaccatggaaatgtcacattcagagccttgctgaaagtctaacttgacagtctggggcaggcagtgaaaaatgggtcatctaaatgctgtgaactctactccctgggacattcattaattaatagccaaacagcaaaccacagggcatgagctatgctagccaacaaccagagttgtctaagttgttaaattcagccccaacatttattttgacctgacgtgaacaaattatttaccatctctttgctgcatctgtataatgcaattaatagtgaactttcctcctcaggcttactaggtaaagataaagtggtatcacatttgttgagccctcatcaatacgacatgcctaataagtgttggccactcttattagaacttagaagagcccatcagatagtcagagacacagacatgaacacagatacctctgatccaacagagaatgtgctgaggaccagggggagctgaaatataatgctggaagagcacagagtggaagggattaattttgaatcatgggaccagggaggtcttcatggagagagaaggaggtgtctgggagaagccttgaagagcacaccacatcaccttcctagtttcttctagtttattttgcctacatcaacagctcttttatccctgttactttccgtgttctaaacaacatcaaactcaacatcaaattactagtaatctctcatgttaagccagaatttagaagagaagcagagatctggcacaggggaaacaggcattgatgtaaaggaatagatagtgagtttaagttatacaggcaggacttaatacatgtccaaagttttcctaggttacttgcaatgacgatgactttggtacatttttattacttacagaaagataattttaaaaaacactttaaaaaagcaaagccagtcttgtatttttacctttcaccagtgggcagaaaatattgctctgggcacatgagtgctgttgtaagtgtgctctgcaggatttgagcaggtgatagaactcatccattaatacacaaagttctgcactttttttcctaccagacagcagcaacagccatttgattcaaagggaggggagacccaacagagggacaagagactagaaaaataatacggctgaacatttctaattaacacctggagttaccttgtggtttcttcagaaatagagacgagatcaggatataccaggcaccagtctgctaagagcacagactagctcagcatgagccatgtcaggacagaaacgaggagacatattctgttcaagggagtttctatcagagccagtccataactaccttttttcttctgaatactgaagtcacctaaggggattgctttgagagattgcccttctttacagactcccctttggcaatttgagctccagccacgaagaaacaaagctatttaatttcagaacccagtagtttctttatgacatttggcagaaacaaaaagtgagaagttgtagaatgagctgcttgtagacattggttgttacagggtaaaagtgtcgggggggcttcaatcacaataaacgtcctatcaaccattataaataatgtgctcaggaatgagaaaggacctcagaaaggagcctagatgaagcaatgtacttttatggtttagtaagctgagcaatagggcaggactctagagattctaaactatcactatgccctgaaagaacaagtcatttactgaactctgctcttttgcctcattgggaaagcatgaagcacgatcactgccccaccttgcagggtgacgcagaaggagagctaggagccatccatgtgcaagacatagatataatgtccttctcttgccactgagctttccttttaattttaattgttctctgccaatttctgagaaagagaatgaggtgtcatgtattctggaggcacagaaacttggctttgcagaaggcagcaacttatgaggacagaggaaaactatctcttatcatataattagcacataaccatcgatagctaattcaaacacttatggaaagcaaaataacatttctctttctcactcaaccacttataagtgataaaaagcaagaggacaagaaatggggagataagttaattcaatttgcaaatgcaatggtaaaacgtgttctctgctcacccaaacttcttccaagacagacagagaaagtcagagttctgtgtctaactttactataattttacagtaaataaccctaacccagtaatgtaggagaggttcatgtcaccaataggccaggtaatggatatatttcaaacaagacaatttaagctgagtttatgttcattccctatttatgcctgtccccctttcagcgtgccctggatggctttcttgtcaccgtgtgcacggagactttcctgattggctttaacatccagttcccgctttctaaatcctcaattgcttgaccactgacctttccctgtcctgaatgttatcactaaaacttcaaagagcatggctaggacacacaaagaagtaaaaaacacaccactagaggatgaaagactagaaaagaatgagatcagcactgttgattcttaaatcatcagtggataaccactttatgaaagagatccatccccagaaaaaaaattattcataaaatgagtttcttgaacacaaatcttacttacaaggggccatcattataaattcagcaaatgtattatttcttatacacacagaaacacacaactcagtatctaggtttagttcttagagaaaggaattgattaagataaagccctgttctttatatacctggcattataaaactctatcagtctctgtctcttgggagtcatatcctcaaacctggggctcgcttttcccaatttctacctctgcaaacaagggcccaattgcattcaactccaaacccaaaccaagtaattctttcttatgttaaactaagccagatagagtttccacacttgagctgtcactgggtctcctctctcttctgttgtcctctctccttttctctccctctttcctgccctctctaaatctggtttctaacaatgtctaatagaactgcattatttgatttgccgagcatttttgttgctgttgatggaaaaagaacacatatatccttttcacaatgcaactgtcaaaggacagaaataacaaccttcctatagtggaaatatgtccacggaccttgtgttttgtttccttgtttagagaggagtctcactattctccccaggccgcagtgcagtggctactcacaggcatggtcatcgcactctacagcctcaaattcctggcttcaagcaatcctgtggctgcagcctcccaagaaactgggactacaggcatgacccacagtgcctggccttactggccttgttttaaagatatgtaagagacctaaaatcaacttttaaaaaaaattttttttttattttttattgagacggagtcttgctctgtcgcccaggctggagtgcagtggtgcgatcttggctcactgcaaactccacctcccgggatcacgccattctcctgcctcagcctcctgagtagctgggactacaggtgcctgccaccatgcccagctaattttttgtatttttagtagagatggggtttcaccgtgttagccaggatggtctcgatctcccgacctcgtgatccgcctgcctcggcctcccaaagtgctgggattacagccatgagccaccatgcctggcctaaaatcaacttttattcaacatgacagagaactagggatttctggttaatacacattctggctaatatataatttttatttaaatagccaacatggattgtcattcaaaaaacctagaacgtgttagtatattattaacaaagaaattaccttgactataattttcttcgatgattcagaaggcacttcaggctgtcttactatctcaggaagtaggaattcccagtgcataatgcctgagtttgaatcccagccctgtcacccatctgtatggtcctgagcaagttactcaccacttttatgcttcagtttccttatcagtaaaatgggacaataatacttatctcatagggtggtgagttagaatatagaactgtgcctgtcacatggaatccaaaaaataaatgttagcaatcacaaatactggaattactaaataccattatatgaaagtactggctgacatgaaattttcatttatagttccagttacctaagattttattttcaggtaatacaatttaaagcatttcaaatcttactctgtttgaatatcaaatggcaataaggtaaacacaattttgcaactttttcgagaaaactagggacatcaccaactaaaaaagcacattgctaatagcgctgcaccgggtttttatcacgtgctaaaactcttccctataatgcatcttgtgatggaaaaccaataagtaatttttatattttcattgatctgaatttgtttctatgattagtgttcatataaaaattccttagcataatctaaatcatctctaacacaagacataaaaacctgtctttgttgttttctcactagaacctagggttacaagcaggccagccaacaagctcaaaacaagggacttcactccacagaactagaatgaggccaaaagcaaatcccacgcacacattataaagacactctttcagcaacagtgacaaatgcaagcattctagtttcgctgaaactgtgacatgatatggctatagtttcctacacaatcttatttttcaatgttctttatttcaagataaggaccttgaaacaaaagcaattactttgctttgttttccactgtttaaaggcattatctctggttgagacaaaggctctatgctgcctggtaactgcccagatgacagaagagatgcacacaatcccagtaaaacaagaagcccagatttcctgggaggtcataagtgacaacaaaagaaaaagtcactgaaacgctgtggatgtcaggttcaaggacctgcagctctgctcttgtaaagaatccaagggattctgtatacaggatgggcctgtttagggctttgactatgagctttattatgaaaggacctttggagcaacaggagatgagacagtaatgaattctgtaaaatgaaagggacctcagaagtccgtctggcacatccttctaccatcaagcaggcttatgatccacaagccagagagtagagaccctactttattttatgcttttggatgttaaaaacaaaagtagattaaaaaaaaaaaccctcagtaatctactcacagacttgagagtagacgttctactaaatgaaataaaattgaattacgaagtacattagaatgccagagatttgattattatgagggtcaaagaatgcttctgacagatgacacagtggtctttaatctaccatgtgtcctcatacacagaatccttatcattgatagcacatagctgtactctagctgacaaatcgcctgccagacctcatcacacacacacacacacagtatcccatatcagatatgtacacatgcacactggaatattaaaatgtagacagaaggatggaaatgacaatgaggatctgaagtttacatgctgtcttcagaatgttttatccatctgattttcaatcatttataacacatccaataatctgttttcccctcatctgtaaaagtggggtactagtactgaggagggttcttgcgagattaaagttaattaaaagatgagaaagccatttgaggatagcaaaatgtagagtgaggcaaatttctttgctgtaattttttattgtcatgtacttagtgaagcctcagacgtagcaaacctaaaaatggaagctgccagaccttctctgcactctgttcagacaggatggttcagtcctcatatttcccaacatcctctcaggcctcaaggaccttccttgggatcaaagtcatttttctgtgctcaggaaaaggagctgcccaatctatatctttgccaacaacccttttcccttactttgtgatatttgtgaccatgagtccccggctcacggttttctcctctcttgacacttgcagtcatgtttactcttagacaatatctttttacatgaaaaaatgtactaaatgtgactcatttagcacttcctttattatctcataccgtgtctttcttttcaatgagatttttaaggagctttaaaaaatcatattttagttaattttattgaatcacaagcctctaaactaatgtcttaaaaattctcaataaatgtgtactgaatgaagtcctcacattttcaaatatcttttccctttctctttccaagttaaataaaaaaatttatcttctgtttctactccagccagatatatctatgagtaaaaaataacagtaattttgcctgacaagtataagagctatgctagtgatgtattccatcaagaaaaaggaaagacaattttaaagaaaattagacataaaaatgaaccagttcactctctgcaaagtaatctgatggtgtttaacgagaatttttaccatttcttatcatctgtatcagggaagaacatatacaaacaaaagataaaggataaaagaaaaataacttgttcaaaaacatccataatgaatacttacaacatgaaaggtaaaaggaataaattcccaagcaaacattagtatggtatcataacaaaaaactacatatctaattaaaatgcttactttcagtgtatgaaagaagaaaaatgactattttctagtaatagtttaaaaatttagaacacactattttgtagtaaaagagataataaagatgccatccatcaggtttttcgacatctcttatgtaaaagccaatgcaatacatcccatttatactacagtacaagagaagaaaaccctataattaaaaagccaacattcttccctttttaagatgatagcaaaagctccataactcgttatgttttcctttttgccttttgtgaacaagtcagagcaaaatgtaaggctccaatacaacagatcttgagttctggtctaattattttcactcctttcattatttgcttgctttatttctcacataacttatggcttcattttatctctctcatataatgttaaaataacttaaaattattttggaaataagtagggcacactaaacacatgaatgactcattaaaaactgcaaatatgctgattacatggcaatagagaaatacgttaacagaataaggttaagtgaataatatatgtgaaataaatattagaagagaatctgagcggacatattggtagctaacctttattgagattttactctgcattagacactgttaaatgtatgtcacactttattatatcaattaatcttcatagccatcctctaaggcaggtattggcaccccacctccaagtccctcatctttagatgaggagacacataaagaaattcactgatctatccaaattcatgcagctaggaagctacctgtgtacaattttaatatgtagagtttattttcttaacttcaaagagcttaaatttataacaataatctttatttataaggagaattgacattgaatttaatctcttctaaatttcatggaaaaatacaagctatccctttgatcttcagcatattttgctaacattaacatttttaatttattaatatttcaatagtattgttttctagtatttcaaccacaacatggcagaggaatgaggtggatgaaattagtttgggtggtggcacatttaggttataattacagttactttaattataattataattataaacataattataattaaggcacctttttaattaaaatactcatgaaaacagaaggagatgtaatgttaaatcaccacaggaagctagaactcttgatcacccatctaccatagctaacgataattaatgcagcctagctgggacatgaggtcagaatttcagagccaagaaactggaagttagctgctcaaacaccccagggagactttgccacaaaagagaatgcaactgctctattgtgatccgatttgcaaagcacctgggtttatgacatgcctctattacctcctttcctcttacgtcagtatctcttttctctccaattcccataactcaacaagatcaaggatactgcatcttgaaatgtgaagtcagtggtaaggatgtgtgaagacacaggtgttttttacagtgtttcagtctgctgttttgtttttgttttttcaaataattctttgaaaagggggaaaaatcctattgcctatttcaaattacccaggaataaatatgcttctataaagccagacaatcagccagaggaagtagatgacctttccttgactcgtaagaaccttactaggctctgtgagaggttctgtgatgaatgactgtgagacaccacaaagttagctaagagaggaatatgtaccagtataattatattcctacatacatgcttatgcacatctgtaaaatatgcatcaataaatataaaagtaaatgggtatgggtatgggtaggtaaggaaaagcatcaacatgcaaggagttacttctgattagtggaatatgggagtctttgttttcttctctagttgattttccattttcatgttttctaaaataggtagtcattttaaaataaaactgttttagaaaaagcttcagaagaaatggggatacttgaatacttgtatgttactatttctatgagaggagagcactccaagcttgtggaaagctgacaaagttctgcaggacaaatcatttaaaatcatttaaaagctggtagcttttcccattctggttaataaaaagtaaccatgtgtaccatatccagaaaaaccaattctcaagcactaggatgtctgacactagaagatgtttaatgcaatttaatatccttttgataatttgaaaggcaattcacaatctcatggttcctcattgtcatcataaaaaacaaattctcactgactatgagtctaagataagcctggttatttgagttttcatttttgtgttcttcctgacagggacttagctttatatgtttaacaatttatatgagcacatgtggatgcagatggtaagattgtgacatcaatccttagctctcttataccaaagttacatagctgaatgaatttgcaacttcttcctcattcccccatattcccaatgagaaatggagagttcatgacagtaactctctggctgcattgaaatctgagtgcattttaaaatacttgaaatgaatgtagaatgggaagaacagtaaagatatcagacttaaaatattcagtagaattcaacactttctaggcctcattgagtcgaaagacattaaccaaccatcttcattatttatacccctattctatccccactcctttcactaatagtttttattcacaaatctttaaaatccttttagacagcaatctgtggttttcaattttccttttgaaaggagttgaagtcatttctattttaacatgtaaacattttttcttagctagggatagaaaagattgaatacggtaccagcagctgggccttaccttcttagaatcctaaaccccgatctggaagggacattagaaatgatttatccttatttgtcccgccctcatctcctctgacacccacaatcaattaatgcatttggcttgattaattctaagtcttcaacaacctgacactcaaagatatacttttcctacccgggggaaatggtgaggaaaagcaaatccactctagctcacagttcccgctattcccaagaaaacactgtttgggagccagaggtgataaccagtaaagtgactgctctgcgaagccttttctccagtctgcttcccatcatgctccagtttatgtaggcaatcttgtatactgacctgcatttatatgctggagttttattcatacttaatcctctgaaggtgtatttttgaacatctatccagaagtgagatctactaaattctttccttctcctctcttgcagacagcaacctgttttggtgttgataaactgtgttatatatttgtgtaattatgccatctctgtaagctctacaagactttattatacatgcctactagtcctggaacagattagaagaattaactatttttgcaaatagcttccatctctatgatctccatccatcttcaagacaaccacgaagggtagtcactgtgatttttatttaatagaggaagaaagtgaatttcagggtttgtgcctaaggacaccatctaaatagtggcaaagcagagtagagaacctgagggaaggcaactccggcccccaagcactgtttccctgggaacagctggaactatgagctcgagtggatttgcttctcctcactgtttccctcaggtaggaaaagtatataattgactgacaggttgttgaagactgggaattagtcaagccaaatgcattaattgattgagggtggggggaggcagggatgggatggataagggtaaatcatttctaatatctcttctggttcagaaatccaagaaatgtctgtaacatgaatgagcattcactttccctaccaacaccacagagcctaagcgagctttgcacacactcggtatccctaactaatgttttggctcagccatgagaatgcagcaaatcgtatttaataaaaagagccacggttaacactgagtgcttcaaaacttctaatattatgctgaacattttctttctctctttcttttctttctttctttctttctttctttctttcttttctctctttctctctccctctcctctcctctcctctcctctcctctcctctcctctcctctctttctttctttctttctttctctttcttagggtctggctcagtcacccaggctagagtgcagtggcgtgatctcaactcactgcaactttcgcctccagggctcaagcgatcctcccacctcagctccccaaatagttttgtttgtttgtttgtttgtttgctttgtttttgttttgtattttttggcagagatggggtttctctatgttgctcaggctggtctcgaactcctgagctcaagagattcactggcctccgcctcccaaagtgctgggattgcaggcatgagccaccactcccagccctaggctgaacatttcatccataatcccatttaatcctgccagaaatgctaaggatgagtactataatttctctcattttaaaaagttgaggctcaagctcccaagctcagtgagtagcagagacaggattcaaacccagactgtttgattctagcaccaatggcttaaccaataccttctcattctaataaaaacatatttctctaaaccttcataaagtaagcactcagtctctacagagactgaatctttgaagagaggtggaactcttaatggtcactaatatttttatgactttttttcaagtgttaagtttgcatcaaattaatctacctgactccttttctcatttggtctggaatggagagggcagttgtagctctgagcccatgcttggggttccaagcatcatgatcactttctattgccatttattcatgaaatatcttctacacttaaccctggagttgtcactgtactttgatccaagagcctctaatcccttcaggcagaaaactactctgtgagttgctaccatgttcattatccttcaattgttttacaaataaaaatgtttttgagtgaaatgggaatgtgttatgcaagccgaaaggaaatctagaaatattacttagtatctttagtcttccttttcaaatatggtatctatctgaaagtgaaaagccgccatctgctacaaggctctacaaacgagtctattgcactagacactggagactcaaggctagtgaggaatgaagtacaatgatcaagtcattgagttaattatcattaagctttgactctcatcttaagattcaaatgtatactttgttgtagtaatttaatcatttctattatttttttaacactgtccaaatccttttagtaaaaactcaaaatgggactgagttctctaaaaaaagattgagagctataaaaggagggagaataaatagtgtgttcccaaccatataaatggaaggaaaggagaattgacactgttgacttgtcatcttgggatatggaaaatcatctttctagccatagttgggccctctgtaatataatcttgcttactagttagccaaccctaatactagaggtgggattatcacagagaagttctagccctattgtgtcaatcacagctctttgctagttaaggaacaactcagagatataaaaaattgggaatgtgggaggggtacagtaaaaccacagacagtttatttgaaaggtagcattgttttatgggagctggctgaaactcaaactcatactggagatgaagcagctccagagatttcagctgtgggattttgatgtcatttttcctgagttctggcattcatggactcacctgctctctaaatgtgtactatcatttctccttactccttactgacatattaatagtttccctggattcaaatccaaaccttaggaaaaagagtggctacttagttcaacttaacttttttttttttttttccaacaggttgctgtgcagtttgcagacacttatctgggtaaccatctcctaatccttgcgtgtatctgggaaaagatcatattggcctcatagacttgttcctgctgcaaaactgcaggtagcaacagtccctttgaaatggaaaataaattagttgagaactccaaaacatcccggtgtaattggtgtaatttttgtatgcatataactatattgataagatatagggaatgctgtgtgctttttaggaagagtaggcatgaaattgagtccataaatacagctttttagaaactgctactttcatgattttatataaaatgatttaatttatcattaagagaggcatgcaacagcacataaaagcaactggaatcggactgagttcaaatacctgttctttcaattattaactgtgtgatcttgaataactcactttacctctctgattctcattcagtttcctcatcagtgaaatggagataataaatagtaccaacctcacgtgaattgttgtgaggattacatatttgttaaataaataaatatatgctagtactcagaaagtgcctggcacattaagagtgctatctcaagtgttaacattaaggatgatgatgactcaaagctcctatctcacaaaggtgtcaagaggaagaacaaagaaaaataaacagaaacgctgcttccatggcaagcttggtacagaatagttttgttagccctcttaagactccctctctcattctttctccgaggttttgcttgcccctaccaaaatgatgttactgagaggcatgcgaattgctttcagtaatcatcatcctccttcccctccctagtttggaggaattctttctaatctgctttcgggaagccttttactgcaaatctggaatccactcaagatctgggcttttggaaagaaagacttgaaagatctgtcaatgacaaccattgtttttcctatcaatttcctcactgaggcaactgaactcccagcacactacctgcttgtatttggtgaagcagtggacgataacaagggggaacaacagactaattcctcaggatattatgaagtcacacatgccttataccagttaaaccttatgacaaatcaccaggaaccaggtactaacatggttagtctttttctgaaggttaagtgaccaaccagtaagtatttgaactagcattacttcaggcataagtcggcctgactctaaacttcaagagctataatctatttcagaaagctcaccatgaactgccgagcatggtggctcacgcctgtaatcccaccactttgggaggccaaggcaggcggatcacaaggtcaggagatcaagaccatcctggctaacacggtgaagccccatctctactaaaaatacaaaaacaaaattagctgggcgtggtggtgggggcctgtagtcccagctacttgggaggctgaggcaggagaatggtgtgaacctgtgaggcagagcttgcagtgagaagagatcgtgccactgcactccagcctgggcaacagagcgagactccgtctcaaaaaaaaaaaaaaaaggaaacctcaccatgatcttttttttcttggggtggagggaggcatcgcccaagtacaataagcaattatatatatgaaacctaactggtgagagacagcacatcactgatagattcccaatggtgcctaaacacatacttgttattttgttgttgcagctggttatttcatccacctttctgactataaactgagttctcaatccaaaatgtgtgttgaatttattctgacattaagggtatactattgattgaataagcacgtccagaggagtgcagcatcctccagctaaggtggtcatcccggatatgcattgagagatatatgacccagagaagaggggatgtgattacaaaactgtgacatctacgtttaccatatcaccacctccagagctgaattcacctctattatttccatatttctgaaattctgctgcagactacattttaaaaatcacatgcctattttcttttcttttccttttttttcttttttcttttttttagacggagtttcactcttgttgcccaggctggagtgcagtagtgccatgtcggctcactgcaaccttcgcctcccaggttcaagcgattctcctgcctcagcctcccgagtagctgggattacaggcacccaccaccacgcctggctaatttttgtatttttggtagagatggggtttcaccatgttggccaggctggtctcgacctcctgacctcaggtgatccacccacctcggcctccaaaagtgctgggattacaggcgtgagccacctcgcctggcccatgtgcctatttttaaaaagcacctttgaattagataaattcgtttttgtttgaaagaagtagtacagaatccaaacaatgtcttatgcaatgattatcaccttcaatgcaaagaaggaatatttaccagctgcctctttaaaaaataagatataattcacatatcctaaatgttactatgtaaaagcatgcaattcagtgctttttagtatattcaaagatttgtgtgaccaccatcacaatctaactggaaaacattttcatcaccccaaaagaaaccccatagcagtaacttcccactgtcctaattccccagcccctgaaaaccatgaatctactttctgtctgtattctttgtggaagtgtctactcagaatatttcatataagtggaatcatacaatatgtgacttctcgtgcctgacttctttcacttagcataatatgttcaaggtttcttcatgctgtagtatgtatcaatacttcatttttatggctgagtaatatcccattatcagtgtatttgttcttgggttgttcccacatttttcctagtacgaataatgcttctatgaccattcgtaaacagtttgtgtgtgtgtgtgtgtgtggacttatgttttcagctctttggtgtacatagctaggagtaaaattattggatcacatgttaactccatgcttaactttttgagtgactatcaaagtggttttcacagtagctgcacacttttacactcccacttaatggtctctttctgcactatgagataaaaagagttaatgaaaaataacagaacaaaattgcagaatttaaaagctaagtgtcacgcacttatcctccatttaaagcatctttccctaggcctcctactatgatttggtggctacaaaatcagagttccaagaaagacaaataatttactttcatcgtttataaaatccatttcttttattctttaaatccattctattggctctcacagaacacgagtaatacagaaaaataatacctcgtttgtgattgaactgtagcaaaatttcacagtaaaatttcaaaaagcaaaaatttcaaaacaaaaattgtcattatcacttacttaatgactatgttactgaatactcttttggagaatctaattcatgtacacagacacacacatacatatatatataattctcctgtgaagagctatgctatataaagagatttgtaattattgtaatagaaggtaagatatcttaaaaaaaaaaatagtcccataaacgaggcttgctactgacctcagtcagtaaccaggaggctttcatgtggcatctactaggtgcttgacactaaataatgcaaaaatgcaaaacgtaaacatttgctttggctatatccagtctaaggctgggcacacgacagtgaccggcaggagtcagagtcacagtccatatgcctcagagtcaagttgccaaaagagggagcatggaccctggcagagaaaactggttgtcctccgcagcaccagcctttacggcagaaaaaaaaatgctggtatttttttaagtggttgtttttatttatgttcactctccaaataattctcaagcctcttcttctttttttatccatctatatctcctttactaccgtaacagtgttgaagcttttacgggccagggctccactgaaaacttaacaaaaagaaaacttctcctttgaaaagtgtctgtgtactcaacttttacacagagttgtgggagcttatgtgaatcccctgaagccaacctatgaacctcttcgaggacacctgcctgcattatggtgagtcatttcacccctggagcccttgcaatgtgaataaggatgtcctcctacagttgttctgatgaaaaatgtgatcttttctttgttgaattgtcactgggcgcaccacatccctggaaaatcatccctctagattaatctacttccttggatctaagaactgtacttatgaaagcacccttcaattagcattttgccaactggcactactaacaaagacaggtcctaacactcacactagtcagtccagtcagcggacagaaaccacatcacttacttaaacagagagaatttaaattgaagaattgttaactattatactattgttaactagataattgaagatgtaaaaagagaacttgaagatattacagaggaagcaactacagaaagcagctaccccagggctgaggggaaaatggaaacaggttggcaatatgaaaactcagaaatatagaggagagacccaatgaggtaaaactctgaagatgggatgcagcatggctcctctggcatctctggtggaacaccaggcaatttgttcctggagtgttggaaaaactgcaaactggatgcagctgcagctacaggaaagaactcctgctgcccaagtgaagatgcgttgctgggatgaagctcagggtaacaggaaggagacagggagcaaataaggaaccagccctgacctcctcctccaaccctgcagtcttcctgaagcaccctctgcttgcagagcttaacagggagcctgcaggcaaagcaggaaggctgcagaggcctctccagcttcccaaagcagagtgcagaagggtaggtttggagctaataataactggcacgcaaattatctcaatgaaaagtctctagattttgttaaattctgaaatcagcaattgaaaaagttttcatctgcataatagatgccttggaacggctaataaccccgccacctgcactgagcactccctatgctctagagtgtaacgatttagttaatataatctgtaatttcacttaatcttcataacacaaattccctgctctctgaatatacacacatacatgtatttatacatatatcttcatatacttacatatatttctatatacatacatacacatatatatatacacacatatatagacacatggcgagagggagagagagaacgagaacacttgcattatttgcgttaactctagagatctagaataaatattatatatttattcctaaacagaacaaaataaattaaaaaagaaaaaaaaaagaaccaccgagataacaagactgggaatgtttgaataattgcccagaaactaaacgcatatctgacctccaaccctgtgctcttaactactctatattactatccacagccagctcgggacaccagatctccttctaaaaaggccactttcctagtagggcactcagcgatattcaatgacactgatacaaaggccccttgtgccctaacgctgcagggttactagagttcactgggctaggaaagcaccaggacactgtctgggtgatgtctgctgtgttcctattaaaacccattcactgtctggtctcaattacttttaattacaatgagctacggcttcaattgcatacagcacagatattcttgtataattctttcctaatgatactactttaaacatagaaaaagatttggagagatgagatcagccaaggtggaaagaccatgaataaaagcataaagagatgcaactaattttctaaggagcatttccgctgacttttacaatactttaaaaacacatttttaaaatatagcaaaattctatgagatgaatctccataggcattcatttaatgcatttcttcaataaaaatatttatccagcacctataatttgccaaatagaggtgactcagatatggccactgccctcaaggattctgccctctaattgaggggattctaccatctaattgagtttaccctcaattagacttagagacatgaattcaataacaactactacatactgaatactaatgctggcagccactgttcaaaatgtctgatatgtattaaatcgctaaatgctcacaacaatctataaggcagataagtcttagtatccctattttacagataaagaaagcgaggctcagagaatttaagctattttatccaagtcatatagctagtaaatgctggaggcagaatttgattccaagtactctgacccccaatcctctgtatttacctaggccatgttgcctcccataaaaacaataaagaaatgctaaatgtcatgtggcactatggacaccagtactatatggttgggaaagcaaagaaggttactttcagaaaataacatttcacctgggcttggactttttttttttaacatagaatttattttttagagcagttttaggtggaatggaaggtacagagatttcccatatattccgtgctcccacacttttacagcttcctctattatcaatatctcacaccagaatggtacattcattacaactgatgaacccacattgacacatcgtcatcacccagagtacaaagtttacattgaggttcattctcggccttgtccattctatgcatttggacaaatttataatggcatgtatccaccattataacatacgaagtagtttcagtgctctaagaatcatctgtgctccacctattcatctcctgcactcccccaacaccgggcaaccactcatctttttactgtctccatagtttggtcttttccaggatgtcatacatatttggaatcacgcattatgcagccttttcagattggcttttttcatttagtaatatgtgtttaagtttactccatgtctcttcatgacttgatagctcatttctgattagggctgagtaatactccattttctggatggtgccacagtttctttgtccattcacctaccagaaagcatttttgttgcttctaagttttagcaattataaacaaagctgctataaacagtggtgtacaagttttcgtgtggacataagttttcaactcctgtggataaattgcaaggagtgcaattgctggatcatttggtaagagtatgattcgtttgtgagaaaccaccaaactgttttccaaagtggttgtactattttccattcctaatagcaatgaagaagagttcttgttgctccacatccttgtcaacttttggtgttttcagtgttctcaattttggccattctcatacatgtgtagtggtatcttattgttgttttaatttgcatttccctaatgaaatacgatgtgcagcattttttttcatatccttactcgtcatctgtataacttctttggtggcatatctgttaagttcttattgttgagttttaagagttctttgtaaatgttttttaaataaagtatattctctgactgttttcatcaataacagtaactcacctttattgataagtgtttattgtttgttagacagtagatattcaaggcacatctatccaaaagtgggatgatctacatctctataaatcagcctcaatgatttgacatttcaataagatacatttgcatggaaaaaaacttcaacatattctttgggagttttgtaaactgagcagtttggttttataactaattagaatatactgaatttgaattttatatgttaaaatcgagaacttgaggtaatgagagcacaagccagaaatggtggctccataattaatcccaatttaaaaagtcatttgcttattagaaaacagcatgatgcagtgaagagagtttggaattagtctggttttgctttccaacttttgtatgatgaaacggattgaaagcaaagcctaatgaaaacaaaggtcttctatgatgcagtttaagtgccttctgaatctcactttcctcttctgtgaagttgacatcaacactttcattggaataaatgttctaggcacagaagatggcagagggtatttgataaacattatcctatagaagcaggattgttgatactgttacagaaaaaatcatgaagactgtcaggaattcccaaattcacaaacacagaaatgtatctttgggctcctgaatttctccattcatatgcttctaaagttacacatttcctatgcacagattcacagagaaattgtctaaatttgtacctttcaataaatttttaaaaatatatatatgggtagcaacttttgcagtagctggggaacttactgaaacctattcttcaatcattctttcttgtttccatacaaattacatggtgggtgtgttcccatcaagaaaagctacagctgaattcaattttctgctctttaatctctctacactttccattttcaggcaacgattttcttagggagcttcacattcattttattattgtcaccagccatatcagctgactttcttctgatgtcctttttgagaaaagaaacaaaactttattatttcaaaagggtgacaccaaaaaaaaatcaagaatatagggaatagctactaattaagtgactttctgtacagtgcttgaaattcaaatactaactttgacaaaattgccaattatctcagatcatgggcttctgagagccagctgcccacaggttagtgatactgtgaatactaaagtctgttgctaggttttcggcaccgtatttgctagaacattagtactatgagactgtatctaaatacttatgctatagtgaaataaacttagtactatagccttcttggtgattcatagagcatattagcatgttaaagtctccaaagtcctacactcaaggaatctacttaatattgcataagccagcatagcccaaacatgtttgactttggaagcttttttaatattttggttaacacctattaatattttacagcactggtatttctcatagtaatctcttctaaactgtatgcacaatacaccagcgagcacaaaacagtaacacacaatatttgaacaaactacaacacacaatgtttaaacaaattttaattaattcatccaacaaacatttcctagtaattactcatatatgaaagcaagttgtttattcacatggttcattagcataattcactatcctgttgtgagtcaacatttaatgagcccagggatgggcttttgggagaacaacatgtagctctttgtgggtaaattaaggtacatattttattttagctcccattgaggtgaacatcatggtgaagtggacgctcctaggtgttccctggagtttacttttctgaggttctgatggtggctgttattctactatatccccgaagccacattttacaatgttgtaggaggagtctgggacattggaatgactaaaacattttcatcatgagaatagttagtgtgttgattcaatatatttaactcctttgcgaaaaatcttatattgcagtgctcacatctgatatgcacactttacctgttatgctatttcaagatgaaagcagcttgattatttgcatgtgttacttctaatgactctacctcggagggatctgctctattttttcacaaccaatcacttttatcttccttcatactttcagactgtttctattgacctaaagtttcacatgtttctgttttatttttcccctctaatgtgttactagcttttctcctgtggtgtctctgaggtccagtatatggtttagccatttttctagttttgaaaataattatttaagtaatcaaatcctcaacattgaataccatttaataactattttcggtccaattagatgacatatttaaggttacctgttgtatacattctaaactcagtcttaaaaatgcttaagaaatacatactataaactcttgctattcttataaaactgctactacttacctatcaccagttattttcaaattcataaatgtaaaggcataatttttctgtgttttttttttagatgtttacatagaacaagtgcaggatgaaacttaggaaaacgtacatattttataaagacagttaataattggtgatgtttatttaagatttgttatatagcaagcactgtattaagcatttcacatactagatctcatttaaccctcataagaatctcttacatccgtttcacagttaagagaactgaaatgcagaggtgagtccctggatcaaggccattactctatgaaacacagaagcagttctcaacactggatctctctgactccagagttttccctattaaccactatgctttgctgcctccagaaaatctactctaaatatactacatatggcaatggaaaagaagagatttagataagcatatggtaattagaaaagaagggggcatttaggaagaaagttaggcaaatgcttagaaagagaattagggtgagaatttaaaaaatcaggaaaatctttttcactgattttgcaattccaaaccatcatttaatgtctgggaaattcatggtcctcatctgttaagtggaattgttgtttcctaatcacttatgatgaatataaagtgttaggtgagtaaagagaaattagaaaattttaaggaacactaaatattagtttcaaagtgtccttccaatgtgatgtacaacattaaatactgtgtaaaatactttgggacagtgggtctattttcagtaattcaccaataaaaatattttactatagtaattttaaatgttctaagaccacggtgttaaataacttatactcagtaaaaggaggttccatgctggagtagtagaagtgtttgggacaaaaatataaaataaaataaaaaagattactcattcaatttagcctagttctagctcagatttcagacaattcaaaataagattagaaatgagaagctaatttatcactcaagggacagaagcctgtttgtggacactcaattataggatcgggactttgcatgtgaacgccttctacatagcttcttgcccagatctcaggctgaagtattctctggtgatgaaaacaattccaaaaacaatgaatgcctttgttctggacacacctcttccattcagttgtgttctctatcactccctcagtatcagatcttcttttcatttttctcccatctatgcccagggactcttcatattttgaactacctaaagctttgtacttgatcatttttcaggaccatcagtgaacttgacttaccaacacccctctcctcttccaagaaaactacaacccatatttcctaatttagcacttaacaatattaaggccacttactgtttcactgtggttgtatttgtgtaaagtactctctgcaactagcttgagatcctctgaggtcagctgtcacattttatcttactgtatttttcacaaattacacaaaaggtactcaaggagttaactgcttaaaaatggtgttgagatcggctgggcacggtggctcaggcctgtaatcccagcactttgggaggccaatgcaggtagatcacgaggtcaggagatcgagaccatcctggctaacgtggtgaaaccacgtctctactaaaaatacaaaaaaattagccgggcacagtggtgggtgcctgtagtcccagctacttgggaggctgagtcaggaaaatgacatgaacccgggaggtggagcttgcagtgagctgagattgcgccactgcactccagcctgggcaacagagcaagactctgtctcaaaaaaaaaaaaaaactggtgttgagatcataaagaaagactctgaaagacatggtacctttcactaaatataggatttttaccattctttggaagagttccatggatgtgccaatacagaccctttctggaattaggccattattgttaagtgactacaaactacacatatttaaaatggccacattctacattgtttgtcataatggagggttggtattagtgcttcccctgatctcagtactgattcctgaagaagacaggaaagaagtgaacagtcaccacttgctctaggaaccatcactgctaacaattttttgctacatcttgccagtgtaaggcaaagagccagaacacagaaaggctgctagaggctgggatgtcagctaattaaccctcagaagaaatttgtgccccaattccgaaaaatgggtgataaaaatttgaggccacagatacttcagaagcaaaccaggaaggcccagagtgagtcaatcaatctgactagaaccctagaaaattgacagctctgtggaagtcagtacacacgccacagaaacatcaccaaaaggagaactccaagctaacacagaagccaggatttactggccaataattaaggtatcttggatggaccccagctcttgcctttggctagcttacaaccttcctcatgagcagctcccacctaaaagattaacaaaataaaatgtatgataaaaaacaagagagatttagctttcaaattgtaacataattatgctcatgcaatccaaataattctcagcagtctgaaattcctcagagacacaaatgaatatattacaaacactctggtcataaagcccatgtttcccagcaataaaattgctgcaataaacatttgggttcttttccatttttaggaccattttgaacaacctgcttctaatgtatttcattagcttcctcaaagtcttccaatgaatgacaaaacctccagtgctttgagtggctgacattaagccataatgttgttttgcagtgtgtagtcttctcactgccaagcaagcgttttctgttatgttcccctgcattaaatctctcccagaaatactgtctgcaacctataggcaactagtaaaatgagattatctcccttgaccccaagtcactccagcattagccagaagggactgtgaacactaacaatactttgaatttaaagacaatttttgtcctcaggttaaaaaaatcttgtactttactctttgaacaaccactcacaaactcttccctgagtcgcgtgtggtctggtaacaacatatttattgataagcttttccactgagtaatcagacagtgcattattttataaagagcttggtatgtgaaaggccttcagcagttctgtaaccgacacaataagaaagtattgcacttccatcagagacattttacatacaagagctgaaagttgttccactgctatgatatttcaaaaagcaatttttaacaagttctgctctttttcatccttaaaacccagttattaaaacaataataacacacaatctcttaaatgaattttaacctcatgttgtcaactgatctcaataaaatcttataggaaactcaaaaggcaccttttgttaccagagtgtcagtcctcaccaggacccttctttctattctgcattttctgtctttcatgattatagctaatatatttcttaagagttactgtgttaagtatattacatttatcataacatttagtcacacaaccataaaaaaaagatatcattgctattcccattttatacatgaatcaacagaagttcagagaagtcaaccaacttggtcataagctagtcagtaccataactgcagttcagtttcagatctaatccaaaaagctgtatctctaaacactctgctgaactatctctttaatctttccctacctatactagaagaatccaatctcatcaaactttacaactcaatggataatggtaaagtaagaagacatctgaaaatttttcctgaaatacgtctcaggttaccacgtcacaggctaaccccaaataaaattatctaataggaatctgccatgaatttcttcacagggaattttctataattcattcaaatagaggaaagttgacttgattgctttttatatatgatgtgaacatgtctatcactatactaaaccattgttgcatagacccacaagactttccatttagagaactgttctcaactactcctcaaatctgcctcctgtgggtgagagacttgagaacttagacccttgaatgctgctttctttctttgcattctgtagcaattaattctctccttattcagaaaaagctactaatagttcatgtattgttgcttatggctatcacttagtctatttataaatgcagcagatttttgagacagtaaatatacaaagacacaaagaaaaagagtgaaaaaaagcatgatcagaagaaaaaagaataaggaagtaactgcatgaatagcatcaactgaaaatacaagaacaactcaaagataattggcccttcctctggctatctcagtcatgaggtattagcatgaaccagaaaaccacagagaagaattcacaaaggaaaccattgctgtgagctacatgaactagcgggaaagtgctagaaaaattctctctttgtctttggactcacagcaaagataacatgcagaatattgtgtttgtatgtttgggaagaaagaaaatcactataaaactgataagagacttcctccaaagagacagtggcagtttcccatttggcatgtttgaagcaatagcaccatttcttaattgtccaatttgttgtgaatagcctagttttccttcaatttaatttcaggatttgtttgatttttaatcacacctgcactttcggaaactctcagagcaaagatttttctgtcctcaaggcatggtttcccacctgtcagaacagggccttgactgccctcagaggctctgaggtgaaaatgaaatggcctcgaatgtttggaactttacttttcctactctttaagaggagatttttgtttggttgggttttgttttgttttgctttgcttttaaagttttttgttattggtgtttatactacttaattatcattttaattcacacagtgctgttcaaaggtgaagacttttgttttattttgtttactactccgaagaagtggtgcttctcctttctttttttttcttttcttttttgtttttttagagacagagtcacgctctgtcgcacaaactggagtgcagtggtgtgatctcagctcactgtaacctccacctcctgggttcaagcaattatcctgcctcactcagcctccaaagtagctgggattacaggtttgtgccactacagctggctaatttttgtatttttggtagataccgggtttcaccatgttggccagtctcgaactcctgagctcaggtgatttgctcaccttggcctcccaaagtgctgggattacaggtgtaagccactgtacctggcctggtgtttcattttgttttgtttttacaaatgtcctttaagtccaaagtccaagagctggatttcttgatgtgagaagaaatctgtgaaagtcagctgcttggcagatcacaaggtcaggagatcccagaccaccctgcctaacatggtgaaaccccgtctctagaaaaaatacaaaaaaaaattagccaggcgtggtggcgggcacctgtagtcccagctactggggaggctgaggcaggagaatggtgtgaacctgggaggcagagcttgcagtgagccatgatcgcaccactgcactccagcctgggtgacagagtaagactccaactcacaaaaaaaaaaaaaaaaaaaaagaaagtcaactgcttgaatacagtatttgaaagggtttattattattatcaaaggaaaggtaacaaaatgaagatggaggttttctcttctggctcattgcctctgtctctgaggagaactaggaactgtggtaagcagatttgaaaggaagaataaaatctaaagcaacatcctatgaggtaaaatcattgtggactgtcaatcttatagctcatatatttcaaattagacttctggttgtgttttatttcaattttttccattcgattttcaaatgatttttattgtctgtttgtattgtttctcatattattattccaatcccattttactaaacatgtttttaagttaaaacccttgatgactaagacacaaccacttagaagataagactgtcatgggtcatactttttttcttatctttacaaggctaaaatgtggccattagtagtttgtgaacccaaggaattcttcagaccaattacttccacaattctaagaaatggggcacattttcagaagattcttaacctactcctagccttacaggtgagcagttattctaagtgaaagcttttcttcttcacaaggaactcacagctttaaaggaaagagggcaggaggatgagggctgcatatgagcactgtaaaaggaggccctagaggggagtgggatgactcacgctaatctactatgattctgactggaatggggttatacgaagggtttgaacatgacaccaaggctttagcatggccctctcaacctgctgttaaggtgaaatgtatggaatgctgttggatattcactcaggtttggattactctgacatatccttccatttcctacctaacacaactttctcaactgtattcacctaaaactatacagaatattaactagagctgatgtgaatgtccacagtaggggaaaaggtgggttatttttgttgttttttgtttttttttttttttttttttgagaccgagtcttgctctgttgcccaggctggagtgcagtggtgagatctcggctcactgcaagctctgcctcctgggttcacgccactctcctgcctcagcctcccaagtatctgggactataggtgcccaccaccatacccggctaatttttttttttttttttgtatttttagtagagatgtggtttcaccgtagccaggatggtctccatctgctgacctcgtgatccgcccgcctcagcctcccaaagtgctgggattaccggcatgagccgccacacctggccaggaaaaggttttaaatggacaagaactatactatttctcagtctcagaagacaaatctctgtttaagccacggtatgtataaagactgcagatgtgtttgtgtatgtatatgtatgggaagagaaaagaggggagagagaagagagattactgaattttctggcgtaaaaaaaatagaacatgaaaaaataaaatgtaattttatttttatttatttatgaatggttaataatagtctacaatagttacaaatgcaagctaatcaaatccacactttgacttctccatctgaaaggtagaggtacagtaatgcattccttgatgtatttcttaactaacttcctgacccataatgagactaagtaaattctacaaaaccacaaatactaagtattcaaaagttactgtgagtttatttttataaactacagcttccaaaattatttgaggctctaatctatcccatttcctggaaaacactagaatcaatcgttcatgagactctgattacaagcttattaaaacattgatgatctaccagatataaactctagggcatgcaaaatttcagaagcacagcttctgaaaccagtgtctggtcttgatgagcgttcagagcagtgtgaagccctcaaagcttttgttttattgaagagatcctgggttccagattcataaaatcttagaagcacaagtaccttagcctattcacaattgaagagaaagagacagagagacacagaaagacagagatagacacagatagacagagatgtcactaaatatttcttctgtctctaggtttccctaaatcactctatctcgaggaccctgaaaactacattgcctttttacaaaagcctgattcgtcctccggtaataccatttaaacacaacaaataaaaattggccagagtatcaacatacaatatctctactgacttaacatggctctcctcaaattggggtgactcatcattaagactgaaaatggttagttttatgcaaatacttgtgaaatttacttccaaaacagaagaacatgattagagctcattttgcagcttgccttttatggacaatcatactgtgctttattttattaaacacttaaataatttatttaccatcaaataacatcctcattaaaggctacaataagggagatagatgtcactctgaagacatatgggataaaaaaatgccaagggcagttttgaagagaattggataagtgaaacaagttcctgagagcatttactccagctcagaaaatacagaagtttgttgacacccaaacatatgtgacacattgaagatggatctttaaagatcctacttggctgaacactgtagaattatatgaagaatccttttcaacaaccatacaatgattttctcaagaagagtagacaatgagcattttgtattacgccgaggcaactgcattgaagacactagctctacattgtacaatcactcacaaagcaattggaatttgacaataaaacaaaccaaggccttttccccactaccaaacaaatttccaagccgtattgttgaaaagaatgcagttggataaagaagtccaaagcctagaagtgacttgaggtttaaagcacttcacagatgctgtcaaaataaggattttcaaagcttgttttcacagtggagagaattcgggcactggagaagcatctgtgtaatctcgtctaagcacaatacctacagggctcattgctttccagagacatggaatcatttaatagtttcacaattcaaacagaagtcctaatccattgtatattatagtaaaacccagccaagactacaaaaaatgtgaatatacagatgcaaaattaatccacttctcaaagcttggaagtgagcagatgatgcattttatgacacaggtggattattttgggaggttgggggcggatacctaacctcatttaaagacaagtttttaataactaagagaagttactacataacagcttaaaatattgagatatcctaaaattatcctatattgcttatatttcaaataataaatttatcaaactataaataatatggcatgttggaaagaccattaattaggaatcaagtaggtctagattcaacattttcaatattttgacttcgccatttatagctgtggactttaggcacatctgaattatctcttgggttatatggttctctttttttaaagcaattggaagaacacatacatcatatagccattagttgtattaagtgacctaccagcatggtttgggaatacagcactctgttagtcacattatttaactccacctagaaaatattaccagacacatgggttcagtggctcacgcctgtaatcccagcactttgggaggccaaggcaggtggatcaccaggtcaggagatcgagaccatcctggctaacacggtgaaacctcgtctctagtaaaaatacaaacaattagccgggaatggtggtgggcacctgtagtcccagctactcgggaggctgaggcaggagaatggtgtgaacctgggaggcggagcttgcagtgagctgagatcacggcactgcactcagcctgggcaacagagcgtgacttcgtctcaaaacaaacaaacaaacaaaaacaaaatactaccagacatggaaagaacactagactgagggtttcaattttagattttatttttattcttttgtggcttcatctcttttactttaagtccgtcttggggttgtctttggtgagacaaaataattgtcccctataaaacagaaggaactcactacatttcacctgccaccatttggcttgtcccctcaaacatggagccttatcagaggggtcaaacaatccttcttttttttttcctggaaaacatggtattgcacagtggctctggccagtccagtcttattaagtagctttatccttgatccatatgtctagtgttcctggagaaacatgttttcatttaataaataaaagacaatgtaatataatggaaagttcctgatacatctacgttgattggttctattacttcccagcagtaatattagacagttttaacctaacggaatagtcactaacttctctctaaataataccatatcttgagtcattgtaaagactgaataagaatgtatgtaatataccaagtcaatttcctaccacctggtcaatgctcaatatacagcaatagtgaagataaagaaggtgacaagtagcacaagattaactggaaagtttctagaaccttatatagggaaggtcatgagaagtcaagcgtttgaagaacaaaggtaacatttaccatgaagatgtggcaaagatggaattaatagccgaggagggaaaataaatatcggcttaggcctcctaactgtctgcagaaatcttcccatagctcctgcctgtttcccttttggttgctagagtttcccaattgctgtgggttgggtaatttgcctaaccagctgaatttattttatttatttatttatttattttgagacggagtctcgctctgtcacccaggctgcagcacagtggcgtgatctcggctcacggcaagctccgcctcccgggttcacgccattctcctgcctcagcctcccgagtagctgggactacaggcacccaccaccacgcctggctagttttttgtatttttactagagacggggtttcaccgtgttagccaggatggtctcggcctcccaaagtgctgggattacaggggtgagccaccgtgcccggcctgaatttattttttttaaaggcttgattttgttgttgttgttcccaccctttcccctgaatactctgcacagttacactggaagtagttaaattcaccattttatccatagatctcagaattgtgagacaaaattaagataaacattagggaggcaagcacctcccctaggaaacgcaatgaccacaggcagcttttactcaatgcactgcatctgaaggcaggccctgggggggacggtgggatttccctgattgggtggggcatggcaggcactctctgtctgatgtctgtgactggttttcctattctagagtatttccagttcacaggggaaataacgcaaatggatacggcaggccaacgatgtaacaaagtaggcatattgttcagttgtttcacccaccttttctcagagccagctctgatcgctactgctggatgatcagtggctttttgtctttaatctctgggcacagatcactggaagagatatggacaattgaaccaaagtgggacagttagcatgtgtctcctactcatctgtaatttagatgcagagtttgagttacataaatggtagggccttagaataaaatttcatgaacaacttctattgtagcccctgaatttgtcatggttcctccatttcccagaaacttcctgttcagcttttcctagaattttaaggatctgtgtaatttccaatcagtgcctcctctacttaagctaatatgagcaagttattatttgttattaagattatttgtttctattattaattctattactaatattaatagatacattaatctaattcaaattaccattaccatctgacttagaatcttgtgatatacaaaagacattcatggaaaataggctggatcgatcaactgctaacctctaaaacatcaatagtcataatcacccaaagccaaattcctttatttttcatttaagtatatgacaaaccttttattttttttagaattttactttttaattttgttttgctggcgtctttgttaaggcaaactaaaagttaaatccaatgttttcataaaattaacaaatattaatagtaaagctcatattacttgacatgaactaaaaactgtttatggggtaaacaaaaagtggcatagatattctagttattatgtgattcccatccaacacatatgagtagtgtacatagcctatctttctgaccttcagaaaagactagtttaagttatcctagacacatgaaaatctatcttgtctttaaaaatctgcagaaattaaaacatattttccatgtgctttaatatcatctaatagatactatttctggcgagtcagaaaatatctttccttctcactgctgtatcctcatcacttagcacagagccaaaccttgaacaggggactcaaactagttcttatataaataaattaaggaaggaataaacaaatgaaaaaaaggtaaaataacctaacaaaaagacaaaaggatttaagtctgatgctgtcaggcaaaggcaaacaggttattccaggtgtaaaatgaatacaatgatatttgtcacatctatattttcccaaaccccatctttaaccacataaagcactgaacacaagaaaaatggcacaaaactagattcaagttactgtaagttcttacagtctcaaaatgaacccacccatgtctaacaatacttattccatccagcattacaatttttaaaagggctctcagatggctgcggctcttttcagacttaattgtgaagagggcactaggaagaatgatccatcgacccaccaaatcccttaagcctgtgtttatttcactttgcaactcacccaacaatgacatagaggcattatagaatgaaagaaggtggagagcctgatggcttccacgcagaggggttcaggtctctctctgggatgaaccagccttcttaatctcttcccactcattcacgattccttgtacagggggcaggaacactgcgagcactttccccagcagtggcctgtcctagtttatgcatccctaaagagaaccctggagaagcataggactcattggacaccacaagagaggaagtaaaggagaaaggaaaatggaatgggacatggcagcctccagttaccatgtaagttgtggagaaatcaaatgtttcccttatgtgactaatcattttgagcattgtccctgtagaaagagagcacagaggagtttggacttgtaattcaggttgggtcacggcttcacgaacattaccttcctcatgagtaaaataatgatagtactaatgatgacaattatgactgataacaataaaaaccatttctatcttccaatatttttggagatattaaatgacagaaggtaattactatgtaaaatttaaagctacagatagatgtcccctattatttttcaactgtgcagaaccttccaacactaagcctagatgcttagctggggttgggagattctgggcatgatagagatggtaaaattagaaacaacagcctcattgactatacgcataatttgaaccaaagcccttattttgataagcagatttctgaaagggttagccagtaagattctgagctgggatgtagaacccaagttattcccagtggaagtgatatagaaagagacgctgtcagaagcaacactggatctagaattgattgtccaatacagccaggtatctattctaaagtacacacacacacacacacacacacgtacacacacaattggtgagtgaaatgaaagaaaagatagccagtgacctagaagagagtaaacacatgggaaagaaaagctctatctccatgaggtgtctagaggaaaaagtaaaagcgagggagacccaagccctctgttatggttcatcatgggaaaataccaacaaaagtagttcatgcagcatcctttaccacattttgtcacaaatctcatcacgcagctgctgctgacatgactcttctactaatcccttcctgcctatgcaacagagctggtgagtagccccatttgagccttccctgataaatcccataatcctcaccacctgcttatgggttccccagcatcggtgatgactgactccttaggattcaaagcaaatgctgctgtcctctctcccttttctatgagtcagccttctgatgataacaatccattgtttcatcatttaatgtggtcatataaacaggaggaggatggctgagattaagatgggacattaatttccatttcctggaggataaatcttctgatgtttccaaacttgtgcctctggcctcctgacagtcccataaacttgggaagatgaatggagtgtctgttttaaagtcatctttaacattttatgcatgggcatgaacttcaaattccagagaccgagttcatttgctgctacattaaggatccaggtggaggagaataagtcaccgagattcaatcatcttctgaaatattgcttacctgagagtcccttcaagatagagtaactgctggagacccccatgtgcctctaacagctggactttggtccttcaaagcctaaatgatccatttggctacattttattttcttcaactcttttcactcttccagatggtaaaatgcaaaaatcttaatattctgcaatggccaagtagctgccacacagtttcatgacccatcactcactctctgattatcctgtctttatgtatgaatgagctcctacataatgccatcagagtacacgacactgcacatcagtatctagcagagtacctacaggaccaaaacaggccagtaaatctaagagatttccgagaagagctgcaaaggtgatttaagaatattgaaagttgatttaggaaggaagataaaaagatctcttgcttaagccaactatgaaaatgtggtaaagcaggtacatccatacatctgaagttcagaaatgcttctaagcagaaggattggaagccatactaaaggcaactgcaaaattggagcttaggaaagagagagactctcaaactgcatgatacatcctctgtgtgattctaagatgccaagaacgcttcaggagctgatgttgcccaagactgacacgagctctttctgcagtgaaaaccaggatgagagacaagaattcttcaggagatcattgtttatggttgtggaagctgagtagtattgagggataatatcatccatattgcatggtgagaggcaatgcaagcatagggcttggcacacacttaagtgctgaatgcatgacagctagtgctgctctactctcaatggtatcgttctccctgccttgcacatgacaaggctgcagtccaatatgcctgccagtcagatgctgggctccttcattcttcttactgagctcccattcaggaatcaaacacatactacagattagcaaagaacaggcttaagaactaagcaacctgctgtgagagagctatcacaactttatttttacacccttttctcaataaccataagatgccaagtatatctttttgtggcttttcactggaaaaccaagtgcaggacttgagaaacagaaggctttatattttacttctaagtacctatgccagacaaatcctgaaaagcactttcagctttttggaaaatattcccaggttcacgggctaaaagaagaccatgaaaaaaaaaaaaaaaaaaaaaaaccttactgcttcatgattccaacttttctcaagttcaataaggaaagaaaccatagcaataataatgccaggtaatgatttaagttttatgagctagggagctttctttggtacttttcagtcatttctcatttaatccttacaaaagcctcatgcagcttatgctttagtggaattcttcaagattccattgctagtaagcactcaaactacaatttgaactcaagccgcctgactgcagagccatgattttttttaaccaagatgcagtactggttcccaaaatgtatgactgatttccacatatatgcccagcacatacacacttcgattgaccgacagtgctgcatccctggtctgaaacatctccggtctgaaacatgcttcaatgtctgaaatagcatcctgaatgacatctcttcattataccctctccccttcactctattctcaactagagcaattcacttacaaagcgagtctttcggccaggcgtggtggctcacgcctgtaatcccaacactttgggaggccgaggagggcagatcacaaggtcaagagatagaaaccatcctggccaacacagtgaaaccctgtctctactaaaaatacaaaaattagttgggtatggtggtgtgtgcccgtagtcccagctacttgggaggctgagacaggagaatcgcttgaacccgggacaaggaggttgcagggggctgagatcacatcactgcagcctggcatccagcctggcgacagagtgagactcagtctcaaaaaaaaaaaaaaactgagtctttcatgtcactccctgtttgaaatctccctcagaataaaagccacattccctatggtggatggagaagccttacacaatctgcctatcactacctcttccaccatgatctctctggcctcatccctttctgttctctacctccttcactctgctccagctcttgtaactttatcttcttgctctttcttgaacacagtggggtcattccagcctcaggaactttttactcaccattcctatgcctggaccgctatcccccagaagcacacatagctcactcccatgccacctcgagattttcgaattcttatcactctatttaaaacttcgaaaaccccacttctcccagactttctaacattctcccttactttattttctccataacagtgatgatcatataatgccctttatatatttcactaatgtatatattttctcttttttaatcaagaatataagatctatgaaggcaaacatttttttttaattccctcctacacccccagcactcaaacagtgtcatatggtaattgtttattatatgaatgtataatatatcatctttaatattctaagaaacatccttcaatcaaatagagaatcttaaatcactgggaaatcctttctgttaagtattcttccaaactgacattaagaaactccaatttattattgcagttggaaaacatttctaaatattactgaaatcatatttctgtttcacaatatttttccttaagcactttgttctcactacaaataggctatgaaggtgaggtatataattgcaaaaaagggggaatgacagatataaactatagaataaaaattattcacctatgactttcaaaaaatggtttttaatcaaggctacagatcatacaacagatttagagcccaagacattttgattggcaataattaggtacaagaaatagaagtggcttttgtttagaatttttttaaaaaaggctccatatatcagtagttggtaatatcagagaggacactatgcattgagtagggaatgataaagatatagtttgccagaccaaaagcaaaagtagcatttgacttggtgggaggacccctaagaacgggagaagcaacatggttagatgttaagtatggtccctgacacagccagccccttcactctttgcagtgaaaaccttcatttgggaaagtaatagaagcgtcatagacaggtttgatgatctgtcggcaagagaaactcattgcctgatcttctggaacatgggagaaggcagtctttcagagtgtctctcaccaacgcgggacagctctatgctgctaacaagatgtaaaaatcccccctggcctagtgtaggacacagatgttacctaagagcactggctggtcattaagtcaagaggtgaagtgactgtggaggagaaagagttagagtaaatggcccaagctaggaattaagtggcagtcacagccagtcttgggaaaaaatatagcacccacaagcattaggatggggacttagtctatcagagggctgatgccaatgcataacacagacaaggaaacagaaggcaatctgtctcatctacagttgcatcagacacagagtcaatatgaaaggccaagggacaacattctttagtgggagcctgcaaacaaccgaagggtacacattgacctgacgccacttccccacctcatcatgctgcatgtagccatgaaactcatagtctccctgaacccaagcaaagaagaaagagcagaggaaaaaagccactgaaagtttaagtgtctgttctaaagagttggatttatccagaaagcaatgaattttaactggaagtcagtaagatacattcaagtggcatataagtattccttccttaagcagaaatgggtgctggcgagcaagcagtattcagttatgcagaaataaagttatatttctacccacctcagtcacagtgtacaaattttaaatccactctatatgtaagggccagtgatttatcagtgctgaattttacagtaaaataaaaatttaaaaagttaccaatggctaagtatagggcagaaatcatgaggaatattaaaaaaaaggttacctcccatccaaggagaaacacggtaaaaggtgattcagctaaaatattataaagccaaatatgaaaaatatatgccctgcttacaataaacctataatatagccccaacatagttatttccaattggtaagtggaattcaatttgcattaaaaaaaaacaagaataaagatacactttacaacttatccaggatttttcctcttgtatatatgaaaccctcactgtttattccccatttccatccagctggaaacaaccatatccattataagattacacagcactaagtgggcacggttactcatgatttgctaatggatgaattgcattttatccagtgtttgcagtcaccttaaatgcagataatatatggcaagttattgttgcaagaggcaagaaacagtcacagttatgtttcactggcatttaacaaatgaggaataagacgttgaagcctttgtgctttgctttaacaagttttaaaaggtaaaagggactggctatgaggtagacagatcactaggtttgaaatcatgttttaccacatactattgatatgactttcaacttctttcaccttgaaaaggttaagtagttacctatagggaacacagagatcatgtacatgaagacttagctttagcaaaacaacttactatatcatatgcccttagtaaagctttgctacacctatcaatatttttattatttatttatttattttgagacggagtctccttctgtcgccaggctggagtgcagtgatgcaatcttggctcactgcaagctccacctcctgggttcaagcgattctcctgcctcagcctcctgagtagctgggaccatagacacccgccaccatgcctggctaatttttgtagttttagtagagacagggtttcaccattttggccaggctggtctcgaactcctgacctcaggtgatcggcccacctcggcctcccaaaatgctgggattacaggtgtgagccaccgcacccggccctatcaatattcttaaaggccaaattcctaacaaaacggatcatcaactcactcttaacccaagattctctccataagctccttttttctagttttcatgtagattgcccatctcatttcccccattcacttctccatgctatcccaacactagttttctccaatcttcaatcttcaattgttttgaacaacaattaatgtgctttaaggagaataacctctctcaatattgagatcttttcgcaaagtcacagaaacacacgcattcacttttaccatgtccaattgtgatgaatgcaaggttctgggaaatgactggccagtgttaggacatagttttcaataaaggaactgaataaaaacctctgtgctcagggaatgaaatccaggagcacagcccaatttgtgatttatttttaacaagtgaatgagaaatggagaaattaaaaaacacatttttggaatcagaaatctttcatctgatttctttgttgcatgcttttaagcaaattatttatttattctgggactcaatttccctacttgtaaaataaaggcaacaaaactggctggatcatttccatttctttccaggttctttcctactttccatgtccacactgtgtgtcataggatggcagttttggtgctataacaactgggcctgcaaggtgcctgtttgagttcataggagcaactggctagggttccaaagctggaatgagagaaagaccaaagtctttatactctatcccaccatcccactccacccctagccccagcctctctgccaggccacacattagcagaggccatattcttcttacctgtgcctgcagctctcctcatctgtgccctccctgctattatggctccctctcgattctggtcaccaaactctcagcctctttaggaccagaggtgatagctgcacatcagctagtgcctgggtgctttcttattgcttataggtttcctttagttctgacttttaaatagtcccttcattaagttatctttaatttctaatttccatttgagtgtgccatctcttttctgccagaatcctgactcactcaaaaatctacatccttgagctattataaaaacatgagacaatgtaatacaggaaaaaaatgcccattttatgtctgttacacagtagggtgatcgatgaatatctggtaaatcttacttataaaacagttattttttgcaaagcactattgtgataagcattctccttgtgcaggtcatgtcttagtcacatgtagacaatcattaggtaagctgcaaagtggccaatttttgtaatatctagtttttgttgttgttgtctatgtcaggcataatatccaggttgccaaatattagtaggttattatgatgtttctcagtatgtctttctttaccaacttatcgatattgaactcttttatctttcctcccaagtgaatccaacttagctcctgagtctcacacctgtttcccaaacatctagcacatcacttagtagacaataagaggtccagaaacaactattgtttctgggagctgcttgccatactgaagaagtagtcagttgtcctgatgcagactggtgagctgtctctattgcctaaatcaataattgtatgttttgttttgttttggttttttccaccattcagcatttaggctatctccataaaagatctggtgagtgcatatgtatcacgtgtcaggaatgcatatcaaattgagaatttactgttttctgtctgggctcagccaacacctcgttgttaaagatgacactattttataagggaagaggaaatttaattaatgcctttgtggcataacttctaacaattttggaatgacttctttctggaattgaaattagttccttgaagatattgctctaaagctccatattgacaataattagatttatttttggtaatctttacacatgcatgacttctcccatgtggctctcatgtattactctgggaaaacacatattaatattcccattttaagaataagaaaaccataacttagaggtgttaaattccaggcacaaggtcactaagtaaatggcagacataggaccagaactcagatctttggaccccaaatttcatttttcactcaataactcttcatgaacaaccaacaatgcgtacagtactgaattagtcccagcacaagcttctgcactattatggtgtccattaattaaggaagtttcagttgctctgtaaacaatctatagtgaagacatatatagtgttaaaggtattgacaaaattctacagcgctccagaggatgtaaagaaggaaaaattctgagagtagtaaagttgggttcagtcttgattggcagataaaagtttttcagggcagcttgatacaggatattttctttctctattaactacatagtatatgatatatctctctttatgttaactcaaatttaattctcagggactcttgattgagaagatttttgagtgtgagaccactagaaaatacaagaagtccacatgtccatctcttaatatgtgaccctttccatgagcatttccaaatactgacctaatcaacagttaaacaagattccctaaaggagtggtctatgtgctatgcatagacctttagcctttagccacatgtaactatgtaaatttaaattaagtcaaattaaaattaaattaaatttaaaattcagattctcagtcacactaatcacacttaatagtctattaatagtctcatgtggctagtggctacaatattgaacaaagcaggtattccatcactgaagaaatgtatattaaacaatgctggtatgcatttgaaatttgtttccttaaaactactgaaccaaggaaccataggttaaactaatacaaccataaagaatacaataaaatattataactaaaagtgatctagattcattctttcatttgttttgtatggtttagtgcatacgtattaagtgcctactatgtgccaggcattgtacttgaagtaagagattaattagcaaaatatacatgatttctgacctcactgatcttaaaacctggagggaatacagataatataacatgcagtttcaacagaatgtgattatttgctattacctctaattttgtcggaatcacagtaaatggaaactctcttgcatttgcacatgcagaaaggggcagacatgtctgttcctgagaagctgcaatctttctgggtcacataaaccatcatgctaactacaggaaagtttccttccagaaatttccataggtttttaagatgtgaatttagcagccagcatttaaatgtttttacctcacatatattcaaatatgagtttttcaaacatgagagcacattttgtaaatcgtaataagaaataagtaaataggccgggtgcggtggctcacgcctgtaatcccagcactttgggaggtcgaggtgggtggatcacgaggtcaggagatccagaccatcctggctaacacagtgaaaccccgtctctactaaaaatacaaaaaacttagctgggcgtggtggcgggcgcctgtagtcccagctacttggaaggctgaggcaggagaatggtgtgaacccgggaggcagagcttgcagtgagccaagatctcaccactgcactccagcctgggcaacagagcaagactccgcctcaaaaaaaaaaaaagtaagtaaatagtctcttaggcagactttatgatacagtcaaagctatcttgtatctagggacatcagagaaaagagcaggtattgaaaatctcaaagaaagagcttgaaaattgagctgaacaattctcagatgaggcagcaccagttctaagcaaggactttggtggttagtgggctggatcttgattactctctcctgacattattttaagatctaactcctacagacagttcaggagaaagaacaagggaatacccacataaaagcaaaagtttatctgtcaagattcttaatgttactttacacttctccctctttgagaaaataataattctttctgatgagaaataatggaaatgtatttttaaaaatatttttctagagacagggtcttgctctgcaatgcaggctgcagagcagtgatgcaatcttatagctcactataacttggaactcctggactcaagagatcctccctcctcagcctcctgagtagctaggagtataggcatgcaccaccacacttagctattttttttcttttttggagaccaagtttcactctcattgcccaggctggagtgcaatggcgcgatctcggctcactgcaacctccatctctcgggctcaagcaattctctgcctcagcctcccaagtagcctgccaccacacctggctaatagtttatatttttattagagacggggtttcaccatgttgaccaggctgctcttgaactcctgaccttcaggtgatccacccgccttggcctcccaaagtggtgggattacaggcgtgagccaccgtgcccggtctattttttcatgttttgtagaaacatggtctcactatgtgacaatcaatgaaccaacactgacatgtctgtatcaaccaaagttcacagtttacattaaggttcactgtgtttaaactctatgggttttgacaaatgtatgatgtcatgtaactaccattataggctcatacagaatattttccctaaagtaaaattcccctgtgcttcacctagacagccctccctcctggtctcaaactcctgtcctcaagtgatcctgccatctcggtcactcaaactgctgggattataggactgaaccaatgcaccggggttgaatatgcttgaataaaaaatagtaacctgaaatttaagtatgtcaagcataacatttccagaaacaaatcttccatgggctaattatgtgtgtgtgtgtgtgtgtgtgtgtgtgtgtttctgtttggggagagttgactcaatagtctttataataaaaataactgaaatgtctttaagtatgacattttccagtcagctataagttctatcatgctttatcaactctcagttggcccagtttgtatatacatgtaacctacatggcccatttagtctttcagtttgcaatctctgatctataatgactttgcctattacctttgtttatttctatagaacatttagtgtgtgttttcagtatggcctggatcaaacataagggagctttctggaccttatgaaacgatttctatcttggtcatcattttcccctaatgactagcataatgcaacacatgatatgtatttgttacatcaataagtgaagaatgaacaaatgcatgtttaataatagtcattgcattttaaggacttgtcattatcgagccttcattatttaatcttattattgatttagacactgtggagctggttctgatatgagaggatttaatgtatgggaaggaaaacgtatggcccttctcatgcaagccaagctgcatggctcactgtcctgaagctggatttgagacgacctctggatatagggaagtcatgcaaaatgtcaaggtgttgggatccggatcaggatataaagaacaaacaagtgttcccaagtgaagactggtttccagcagtggcaagatattggattgtcagtggctggcatttttaatggtatcaatttttggagttacatataaaaagggaatctaactatgatttgttaaaggtgctttattttgcttcctatgctcagtgggcatttagttagcgttctacctaagcactataaagaagaaaggaggaaaaagccttacaaaaccagaagactctgagcatctacatcttacatgcaaagcgataaactgtggttcttcggcttaactcagccttttctattctgctaactaaataggctaaaaatgcacacacaattagaggggcaagtattttaaagagtatatagtataacatattataaaatataatgtaaaaatctttacattttgtgaacagaaaaatgtcctacaatccctgtccacaatattttattagcattatgcttaccctactgaggagtcacaaaaattgctgtaatattgcctccaaatgcttgctatcaatcttccgtcttcagtgaaatagcaccaaaataatgcagataacattttttgcctatctaattcgttctacccccatacctttctccttccaacactcctgcccgggcagttgcccatagtcacaataaactcaggagaatatgaccacaaagcatggtgtaatttttataaatttttgaattattactctttgacatagtttcagaatttggactttggcatttttatttaaacttatcacaagcagagagagagttggatctgctctgcaattaatcatctctgcgttacatttcccacaaaacaacgttaagaaacaaaggaacagaagccacgctaacccagcccttgatgtgcaaataattggcctggcctggcttttgtcattgtggatggcagtagtcccgactaaggtttattaatatatgctctctagacaaacagaacactggaagtcctgcccatccccaagccctgtgaaattcacaaagcatgcctcagcttttcttgctcattgcttttcaatgcagcttcctcagcataaggtctctttgtccaaaaatactgattttgatcttcctacttttaaatactgtagagtgcctaaggcttgaaaactacacatttctgtgctcttggttcaatatgctcagtgggagaaatttatcatcggagttgttgctgttggagaaatacagagatctcctttcccctcagtccccaaagcatctgttgcctggacttttgtttgtattaatgaaatatgccatctgcattgtgcaggcatttacatttcagtaggaagcagagaagggaatcccaatgaggaatccagtagccattataaaacccctttgttctccttcatgtaaaactcaaagaccaaatcctcctaagcacccgtggccactgccgtgggcttcattttagagccaggaaatgtcaaattataacagaccatcatttcactgtgagttgcctcaaaggccactcttctatttggacaaaagattgcactcatggtttttcttctgccttaatggatggcagattcgtcagaacctttttggacacaaatgatagaaacccaactgtattaagcttcaacaacaaagagaatgtactgccggtgcaactgacaaattcaaggaattgtactggatattcaaggaaatgtactgccagtgcaactgagaaattcaaggaatgaatccccaggtctgactgcctcaaggtgctaagtgatactgttaggaattagtctctccctacctctcagctcagcattccttgctttgggttatattcaagcaaattctcaccaagtttaatcctcttccgctgaattttacctcctctgctttgcagccctagtttgaaagaagttcctattatccactagttccaaaagaagtctggaaattgaatatgtttggcttgaaaggtctggctttcgtcaccttccttctcctgaaacagtgtttctagccaagggaaatacttcagcctcatggcagaccagtcacctctcacctcaggatctggagtgtgggaactgctctactgtacacacgtggactgagactggagaacagtaaaggaacataagtgtgatgttcccagaaaagaaaaaaaaagcatgtttaacaggccagagccagagatgtccattccagggagggatggctgaaagaccttccaggatttggcaatttggaaaagtacttagcctcacatgatcctggtatgaaagagctcccttttttgctctgccatcctttaccaaattccctaaggagtgcaggaaagttatgtctagatccacacgtactgcttatctttttcagagacacgtgaggttctaagttataggaaagaacaggtcagcagtttgttgccagaggtaagaaacaaagagctggcaagtgtgaaacaaccttagttgtgtgggaaataggatctggaagaactgaactagaggagccaagaatgacctgaatgcctgtggtatattcagaagaatcaacaggagaaagaaacactggccagaaagtctaattttatttctcaataatcaacatatatttgaaaagtgcacgaaaattgtaatactgataatactgataccgatcataatactcaaacagttaacatgtattcagcaagtagtgagttaataactgtgtttagcacttaacatatctagcctaaatgaagaaatgagttctgggggcgaacacagatgtggctccaatgaactgtctggagggtcaggagagcctcaggacagaacatggtgtctcagttaagatatgaaaggcaagtagaagtcagagtgaaaggaaggctgatctaaaggcaaacagagtgtattagggttctctacagggacagaactaataggatagatgtatatatgaaggaagtttattaaggagtattgactcacacgatcataaggtgaagtcccacaacaggccatctgcaaggtgaggagcaaggaagctagtcccagtcccaaaacgtcagaagtcgagaagccgacagtgcagccttcagtctgtggctgaaggcccgagtgcccctggcaaatcactggtatgagtccaacagtccaaaagctgaagaactttgagtctgatgttcgagggcaggatgcacccagcatgggagaaagatggaggccggaagactcagccagtctactccttccatattcctctgcctgcttttatcctagccatgctggcagctgattagatgatgcccacccagattgagggtgggtctgcctctcccagtacactgactcaaatgttaatctcctttggcaacaccctcccagacacacccaggaacaatacttttcatctttcattcccatcaagttgacactcaatattaaccatcacacagcacatataaaaagttcttgtggtaggtctgagaatgtagtgatcaggaaggaaagggtaattcttgatggctgaagcaccacatgagaagggtgcaaagaagggagagaagcataaaaaatagtccaggaagttaggaaggcagaaaacacattcataagctagactggatttggacttccgtggacctcccagagctgatcaaaggaagagatggttatgtctctgctggtgggtgaagaaaatgagaagtttggatgaggatctccttgtcaaatattctcaaaattctgaatactaggtacattcagatgatacaaatgagactcactcttaagagtgtattatattgaacagacttgaccatcattccaaatttggcaaaagcaagatgcttttccccaatagtaatcatgcgataagttaatcaatttatctacaggttgagtatctcattctggtatttcccaaatgtagaacagtgctagcatatcacaagctcagtaaatgtttgttaaatagatgttatgaacagatgagtattaaatgccttttattttgggtcaaaccagacctgacaactacctatttattctgcatttatttatctcctgaagaagtgcttttcttttacaaactatatatctaaatattgaatggcattataacaaaaaactattatatctattaaatatctttggggatggcttttgtagaatcaccaaggaaaaatcacactcagctctcagtatcaggaataaagattctcctttttaaccatattttcaatcaaattaaaattatcaatcctagaaatatatgtgtactatatagactgaatgtttatgccctcccctcccaaattcatatgtttaaaccttatacctggcatgatggtgtttagagcagggccttgaggagctcatcaggtcttgggggcagaaccttcgtaaatgggattaataccctgacaaaagaagccccagagatctctctcatcccttctgccatgtgaggatacaaagagaaaatggccatttacgtacaaggaagcaggccctcaccagatacctaatctactagtgaagtgatttggggctcaaggtcccagcctccaggacttcgagaaataattttttgttgtttaaaagccacccagttatggcattctgttatagtagcccaaacagactaagacaggaaactgttacccagaactaggagtgctgctatcccaaacacctaacaatgtccaggtgactttgaaactgggcaatgggtagaggctagaagtgtttggaagtgcctgctagaaaaagcctacattgctgtaaagaacctttaaaagtgattctgggtagaaatctcagaaaaaaagaagagatgcagagaaagcctcaatcttagaaaatacctatgtaatcctgaaattaggaatatgaatggcaaaggtcattctgatgaggtctcagacagaaataaggaacatattactagacagtggaggaaggtaatctttgttataaagtggcagataacttggatgaatggattttgtgtttcagtgctttgtggaaggtagaatttgtgagcaaggcaatcggatactaggctgaggaaatctttaaacaaagcactgaaggagtggcttggctcctcctgactgcttatagttaagtgtgaaagaaatgaggtaacatcagcaaaatagtggaataagagctcacctaattgtatctcccacagcaacaataatttttcagccacccacagacaaaatagcctttgtgggaaccttggattaatttaggaggttgtgaaattccaggggagcccgatattcagtagggccattttgagagggccaactcatgcccagatggcagacttggtgatcatggttctgactgcagacctggaaatggctttatcctcttgtggactcagctatggccccattttctcttggtcttattataaaaatcatcagcaaagaggcccagaaaaattcatgcacactagtacattggcagacaggccagccaaagttgagtctggatgtagaccctgaaacagctctgaaacccagttttagacactcttagctgtggacagagaggaggccttctcatccacgaacgcagagggagaaatgcctgcctgagtccccagggtaggcttgccaaactcagccctacagcagatcttgaaatggcactaaaactcagctacaacccctctgagctgttggttgtgagcaatcctacatgcccaggcatctggagggaaacacacttatctatgatcctagagacaggactgcagaccttagtctcagctgtatatcctgaagcatccttgcatgtactgggctgtccttgcattcctataaagaagtacctgagactggataatttataaagaaaagatgtttaattggctcactgtgctgcaggctttacagaaagcatggtgctggcatctgcttggcttctggtgaagcctcaaggagctttcaatcatggtagaaggcaaaggaggaacaggcatatcacatggcaaaagcagaagcaaacaagagagtagtggtgaggtgccacacacttttaaatgaccagatctcaaaagaactcacccactaccatgaagacagcaccaagccatcaggaatctacccttatgactcaaatacctcccaccaggccccacctcaaacattggggattacaattcaacatgagattcaggcaggaagaaaaatccacactatatcattccaccccagtccctctcaaatctcatgtccttctcatattgcaaaatatgatcatgccttcacaacagtccccccgtcttaactcattctagcatcaactcaaaagtccaaaacccaaagtcttatctgagacaaaggaaatcccttctacttatgagcctgtaacataaaaaaaacaaatttgttacttccaagattcaatgagtgtataggcattggataaacattctcattccaaaagggagaagtcagccaaaagaaaggggctacaggctttatgcaagtttgaaaccagcaaggcagtcattaaatcttaaagctccaaaataatcttctttcactccttgtcccacatccatgggggtgatggtgcaacaggtgagcttccaaaaccctgggcagctctacccttgtggctttgcagggttcagcctgaggctgctctcacagtgtgttgagtgcctgagacttttccaggggcatggtgcaagctgccagtggatcaaccattctggggtctgatgggtggtagcccccttctcacagatccactaggcagtgccacagtgaggactccgtggggggcctctaaccacagatttcccctctgtgctgccctagtagaggttctctgtgagggttacacccctgcagcaggcttctacctgggcacctaggctttctcacacatcctccaaaatctagacggaggccaagcctcctttactcatacactctgtgaatctgcaggcttaacactacatggaagccaccaaggcgtatgacttgcaccctttgaagcagtagcctgagctatatctggggccctctgagccaaggatggagccagaggggctgggatgtggggagcagcatcccaatggtgtggagtacagtgaggccctgggccctgcccctgaaaccattctttccacttagacctctgggcctatgatgagaagggctgccacaaacctctctgaaataccttttccccattctctgggatattaacacttggctcccttttagttatgcaaatttctctagcaagcggttgctacgtagcctgcttgaattcctctcctgagaaagcttatcctttctgtgtcacgtggctaggctgcagattttctaaacttttacattctgtttcctgcttaaatataacatccaactttaagtcatttctttgctcctgcatctgataggtaggctattagaagcagccaggacatatcttgaatactttgctgcttagaaatttcttctgccagataccctaggtcatcaccctcaattccaaacttccacagatctttaggacatagatcacaatacagccaacttcttcagcaaggtataacaagggttcagtttctttgcttcagttcccaaaagctcctaatttccatctgaaacctcggcagcctgaacttcactgtccatatcactaacagcattttggtcacaaccatttaaatagtctgtaggaagttccaaactgtccctcatctttcttttttattctaagccctccagattttttcaacctctgctagttacccagtttcaaagttgcttctagattttcaggtatctttatagcaatacccaactcattagtaccgattttctatattaggccattcttatattgctataaagaaatacctaagacaaggtaatttataaataaaaaaggtttaattggctcacagttcttcatgcttaatagaaagtatggtgcaggcatttgcccagcttccggtgaagcctcagggagctttcaatcatggtggaaggcaaagggggaataggcatgtcacatggcaaacacaagagcaagctagagagttggggaggaggggctacagacttttaaatgactagatctcatgagaactcactcattatcacaaagatagcatcaagccatgagggatccaccctcataaccaaaacctcccaccaactccccccacccccaccaccaccactgcattggggattacaattcaacgtgagatttcagtggtgacaaatatccaaactatatcattgtgacttggttttagtccctttaagccatggctggggtcaggactgcctgcccaggtacatattcagtgacctaggaggagccctcccagggacctggaggaagtcactcccagttgtgcaactggtaacaggcctgctgtctgcataccttcaagtggttcttcatcccagtgccagccctactggccaaggtactaatggtatcttgtccaccaagaggtcagacaaaagccatgcctaccagagacactggtaacaggcctgccaactgtgggtcccctcgtggactcatgtgatccagctcaatcgccacaagactgcaatcctataggcaatcccatcagctcagagtctcaacatgaggaggcttttcctgccaaaactagtctgtaaagactagaagcggtatttgctcctgcaaatgcatagccatcaatgcaaggctacagcgataacaacaaatcaggcaaacatgacaccaccaaaggaaactatgaacattctataattgactccaaagaaatggagatctacaaatttccttaaaaaagaataaaaaataatcatcttaagaagctcaatgaaatgtaagaaaacatagacaatttgatgaaatcagaacaatgcatgaacaaaataaaaagtttaataaagaaatataaaccataataaagaatcaaacagaaatcctagagctgaaggataaaatgacaatattaaaaaattcaacagacaactttaacagcagactccactatgcagaagaaataattagtgaattcaaagacaggccatttgaaattagccaagtccaggaccaaaaagataaaaagatttttaaaagttgaagaaagcattagggacctatgggacaaaaatcaattgtacaaatatataaactgtgtgatttctggaaggagaaaggagagagagtaagagacagagaattatttaaagaaacacttgctgaaaactatccagacctttggagaaatatgagtattcagattcatgaaatttaaaggatcccaactaagatcaacctaaagaagaaactccaggacacattataaatgaattattaaaagtcaaagacaaagaaaatcctgaaagcagcaagagaaaagagacttgtcacatataagaaaatctgcataaggttaacagcagacatctcaacagaagcctttcaggccaaaatggagtaaggtaatatattcaaaatgtcaaaagaaaaactgccaactaacaatattatactcagcaactgtaatgctaaagggattctttcaatttgaaagaaaagagttatttctgtttcatgtaacaacatgaaaacatattaaagtataaagctcactggtaagcttaagtatgtagtcaaattcggaatatcctaatattataatggtggcttgcaaatcacttttaaccctagtataaaagttaaaaagcataaaaaaaaactatagctataataatttgttaatgaacacacaatataaaaagatgaaaatgtgctatcaattttataaaaaaatgggaaatggggcagtacaaacatagagttcttgtatgcaaaataaggtaatttgttatcagctaaactaaaatattataattttaggatgttttacgtatgttccatggtaaggtaaccagaaaggaagaaatctctagtagatacacaaaccataaaaagaaagaaaacaaagcataccaatacaaaaattcaacaaatcacaaaggaaaacagcaagagtggaagaaagaaacaaaggaactacaaaattgtagacaattaaaaaaatgtcaatagtaaatccttatctatcaacaataactttaaatgtaaatgaatgtaactctctaaagatacagagtgtctgaatgggttaaaaaaaatcaacaatatgctacctaaaatagactcacttaagccttaaggacaaacatagactgaaagtaaaaaaatagaaaaaggtattctatgaaaaatggcaaccaaaagagagcatgggtggctatacttatatcagacaacatagattttcagtcaaaatctgttagaagagacaaaaaaggtagctacatgatgataacaattgtaaatatatatgcactcaacactgacgcacctaaacatataaggcaaaaatttcagaaatgaagggagaaatagacagcaatcaaataataataggggacttcaataacccatttttcaacaatggatagatcatccagagagaaaattaataaagaagcagtaggcttgaacaacactataaaacaaatgaacttaccagacttacagcaaacattccatccaacagcaacaactacacgttcttctcaaatgcacatgaactttctccatgatagattatactttgggccacaaaacaattcttaacaaatttgagaagactgaaatcaacccacatatattttctgaccacaatggtataaaactataaatcgatatgagaaataattatgaaaaactcaccaatatgtggaaattaaacaacatactgttgaacaatcaatggttcaaagaaaaaaatcaaaatagaaatgaaaagcatttgagacaaatgaaaataaaatacaacataccaaaatttctgagatgcagcaaaaccagtgctgagagaactatatagtgataaatgccaacatcaaaatgaagaaaaaggccaggcgcggtgccttgcatctgtaatcccagcactttgggaggctgaggcagatggatcacgaggtcaagaggtcaagaccatcatcctggccaacatggtgaaatcctgtctctactaaaaatacaaaaattagcccggcaaggtggtgcgtgcctgtagtcccagctacttgggaggctgaggcaggagaatcgcttgaacccgggaggcggaggttgcagtgagcggagatcacaccactgcactccagcctgggtaacagggcaagactccatctcaaaaaaaaaaaaaaaaaaaggaaaagaaagaactgaaacaacctattgttacacctcaaggaactaggaaaataataaactaggcccaaagtcagcagaaagaaagacataataaagaccagacctgaagtaaatgaaatagagactaaaaagaaaagatcaacaaaactaagagttggtttttttgaaaagatataaatagacaaagctttaactaggttaaccagaaaataaagagagcccaaataaataaaattaaaattataaaagcgacccaaaactggtaatacaaaaatacaaaggatcataagagactacttgagtacagttattcaccaacaaattggataacttagaggaaataaataaattcctagaaacattccacctactaagatgaataatgaataactaggtaatttgaatagacaaataacaagtgagaagattgaatcagtaatcaaaaacctcccaacaaaaaaattccagggtcaattataccaaacgtttaaataattaatgcccatccttctcaaagtctttcaaaaaattaaagaggagaggacatctccaaactaattttatgaggccagcataaccttcaaactaaagccaggtaaggataataccagaaaataaattacagtccagaaaccttgatgaacaaagatagatgcaaaaatcctcaacaaaatactagtgaaacaaactcagaagcacattaaaaggatcatacaccatgtcaaatcagaagaatgattcaacatatgcaaatcaataaatgtgatgcactactttaaaagaacaaaggacaaaaatcatagatagtctcaacatatgcagaaaaagcatctgacaaaattcaacaatcactataaaaactctcaacaaattagatgtagaaggaatttacttcaacatgttaaaggccatacatgacaggcttatgggtagtataatactcaatggtgaaaaaatttaaagcttttcctcaagatcaggaataagacaagcatacacactctcatcacttctactcaacatagtaatggaagtcctagccagaaacattgtgtgataataagaaagaaaatgcatccaaattggaaatgaaaaagttaaattgtatgtttgcaggtgtcataatattatatacagaaaaacttaaacattctaccaaaaacctgtcagaactaataaataaattcagtaaagttacaggaaataatatcgacatacacatgtcagttgcatttctatcacctaacaaacaactatatccaaattgagatacagaaattgagatcccatttacaacagcatcaaaaataagatacttaagataaatttggccaaacaggtgaaagatacctacactaaaaactataaaacactgatgaaggatatcaaagaagacataaactaataaaaacatatcccgtgtttatggattggaagaattaatattgtttaaacgtccatattgccaaaagtgatctacaaagtcagtgcaatctctgtcaacattccaatgacatttttcatgaaaacagaaaaaaaaaaaatcctaaagttcatatggaactacaaaagacctgaaatagccaaagcaattttgaagaaaaagaacaaagctagaggcatcacactgcctgattttaaagtatattacaaagtcatgtgatcaaaactgtacggtattggcataaaaacagagatactaaccaatggaacaaaatagagatctcagaaataagcacacacatatgtcgtcaactaatctttgatgagagtgccaagaatatacggtgaggggaaaaaatcacttcaataaatgatgcttggaaaacaatatccatacgcagaaaaattaaattcttttacttaaaccatatataaaaattaactcaaaatggattaaaaacttcaatgtaagatctgaaaccgtaaaactcatagaagaaaacatagtttaaaagctccctgacattggctttggcaatgattttttggatatgacaacaaaagaacaggcaataaaagcaaacacaaacaaatgggagtacataaaaccaaaaagcttctgcacaacaaagaaaataacctacctagtgaaaaggcagtccatggaatgagagagaatgtttgcaagctagctttataatgaagggttaatatccaaaatgtttaagaaattcatacaactcaatagcaaaaaagacaaatccctgattaaaaagtgcacaaagggcctaagtagacatttttattcaaaggaaacatataaatggctatttgtatgttttctttgaaaaatatgaataggtgctcaacatcactaataatcagaaaaatgaaaaatgaaaccacaatgagataccacttcatacatagtaggatggccattatcaaaaagacaaaaggtaattattggtgaaggtgggaaaaaatgaaacgcttgtccactgttgattggaatgtaaattggtatagccattatgtaagacagtaggaaggctcttaaaaaattaaaagtagaacaacattatatgatccagcaatctcgccctgggactatctccaaaggaaatgaaataagcatcttcaagagataccagaatctccatattcattgcagcattattcacaatagctaagacatggaattaatcaaagtgtccattgctggataaatggataaagaaaattatatatacacacacatacatatataatgtattatacataatgtacacacacacatacatacgtacatacacaagcaatggaacattatacagctttaaaaaggaaatcctgccatatataaaaacatggatgaacttggaggacattatgctaagtgaagtaagccagacacataagggcaaataccgtataatttcacttatatgtagaatcacactcatagaaacaggaagttaccagggactaggggatgcaagaaagtgggaaatgttgatgtaagggtacaaaatatcaattttaagatgaacaaattccagggatcaagtctatggcaagggtggtaatggatttattaattaatttgttataatcattacacaaagtatacacatatcaaataatcacgttgtacacattgagtatatatgatttttatttgccaattaactatttaaaatataaaagaaataatcttgctatcaacagatttattaaatgtcttggtttaattttattccaagagcttggtattaatgaataatcatagaaactatatacaaaccaatacactaaagagtaacacaattattgttgatatccaaatttgtcagaattaaaatccaattttcagtttaaaaaagaaaatgagagaaatgagttaaagagggaattattaagcagaagggaaggagaacttgaagatttgaaaaattcttagcctatccctattgcaaaaagtgaaaaagcatggccaattgcctatttgaaaagaagattaatatgggtgtgaactatgaacttaatccaccacccaagcaggaaaactgccagttagaactgaaaagaaaagaaacaaaaagtaatgaaggaaagctatcaggctttgttgtttttgcagcatgggaccagagaggtatatatctgagaacagacattattcttcaatacaagaacaatgaccccggaaggccattcagagaccatcaggactgctttctcaggttcaaaacaggggatcattgctttgctctcaacaggccagaaagcctcttctcaaagctgtgagatcagggccccccagaactgtgaggtcatgagtacccaggaaagcgctgggggtgagaaccctgcagagtagagtttcaagttcaggacttcttccctagtgggcctagaaggtgaaatattagctccagtgggcttggaggcacagcatggagccagaggattattcttgacccttaattccttcccttctcaagatctcatgaagtttgccttgtagtttcaacttacttggcctctgttactccctttcttctttcttatttctcccttttgaaatgaaaatgtctagcctatgcctgtcacacaattgtattttggaagcacataatatgttttgtttcaaaggttcacagctttagaggattttgcctcacagtgactcatacctcgagtctcacacatacctaatttagaagagacttagaagagacttgggacttagactttacagttgatgctaggatgaattaagatatttgtggctaatggaatggaatgaatgtatttttcatgtaagaaagacatgaatttcgaggggctatggacagaatgctatagactgaatgtttatgtctccccaaaattcatatgttgaaaccttatccccagtgcaatgatatttaaaggtggggcctacaggaggtgtataggtcatgagggcaggactctcatgaatgggattaatgtccttatgaaagagactctataaataagatcccttctacctcacattctaccatgtgaggacacagccatctctgaaccaggatgtgggctctcgtcagacaccaaatccgttgctgccttgatcttggacttcccagccttcaaaactgtgagaaataaatttctgttgtttataagccacccaggttatgttattgttggagcagacaaaactgactaagacaatgtgtttattttttctttagctactagacagtttgcagtaaatccaggaaacaatccatcagttgaatgggatcatatcatatgcatatgcccatgacacatttatccttgggctttatttttttcctccactgatttatctaacatccaatgtcctttgatttaaaaattaactctatctcactccataaatctgtgagggactttgcaaaaaattacataaaaggataaacagaccgatgggtgactatacagatgaattgatatctaggtaaataatatctattcaggtctttgcacccttatccatttctacttcctttcagactttgaggatacctgcaatagtaactacatttttttcttgtcagaataaccatatactgagtatgtcacattttggttgtctcctctatttctgggtaccataaaataacatataactatgtctgagcaatggatacagacaagacatgacatgtaaaacttccaggtcagaatacttataatgtgaggtcctccacagctctcttttccaatctcaagaaccagcaatgccacagttggtggactctttaacacttgggtccctgagtgataactatgcagatgagaactcccacatgactcacacaggtcatattgttctttgctgcagcatcaactaatctatcctgaaagctatataccataatgaaatgagtacagagccagtgaaatggaagtggtggacaagcctccaaagtagctgaaactggtaatataggaagtgaaaggaaaaggcaaaatatcaaaatttcactgcagattttgaagtacactttcaaaactgcaaaagaattggtaagggtttagagatgaatcatgaaagtgactaggatagacatagaaacagcaaagaaatattaaatgtgctcttattgtttacctacagaatggtggccctttgtacatttcatgcactcagctgaggtattgcaactagttttaaagaaaggctatggtttgtatataagggttgcatttcaagagtctctagcagtaatccaatttaatctttcaagggaataatacaaacatgggatttgtaatcagaaatatcttactgtggctgaggctttgaaaatgttactttgctttgcttggccttgatttttgttttattaggaaaatggagagtattgtacctatatgcagtgttgatgagataatcatattaaataatccaagaaaatctttggccagggaaaaagttcatttattattagaagccttcaaatattttattttacaataggaagtctaatccacagagagattaacctagttgtccatgtcatggagctaagaaaaatgtcttctaataacctatagaatttgggtatttttcatattttctgaggactaaacaagtagataggtcacaagttaagtcaaaattaatttcagatagataaaagagtgagagtattcatcatccaaaaaatggagtggtagaaaatgaaggaggcctgagagtctctatctatggaactatccgtttacagccaagactgatcacagctaaccacaaatctgccctcacttagaaaagctttccatggtttcttccagctaattcctatatgttttaatatcttttcagagcacaaagcacatgccatctaggatgactaccaggctttccatcatggcctgccttataatatatctcctgtgttattatcattcttactgtttattagactttaaattggttttacctttgcaagtgaatatatttaatgtcagaaataattagaagtcgagatttttgagggtaagtattgaatgaatgttaactacttggcatcttcatacatcatatataaatgtatcatacattatacatcaatacagcataaagcatctcttacagtgctatgcacatagcaggcaggtaatttgtatttgctgaatgaataaataaatacatgaataaagaaagtaataaaaaaattcactgcctgtaggcaagtacctggaagacatgattgtacagtattatattattctattctctgatgggaagagtctgatttagactagaaaattcaaaacaagtaagaggacatcgagactaagcaaatcacagcagtgatacttattagtttatagacagagaccaaagacttataacatggatcacttgaaataaggaccaggaaattcacagaagtaggcaatctcataatgcacaggataacctaatagatctttccacctgttattcctctaagggaggactctttccatgaaaccaaagatgactaacttgaaaggcaaagcacgactgcttaaaccggccatgcatcactggcaccaaactgctacaactgaaaatgcggaaagcaggctatccacattcaagcaaacccatttaattcccatactacatcccttcttgtaacatgctcctcataggggagaccacagtgaggaaatccctaggttctatgtttcaggtctcaagtgaaaaaaaagcaagaaaaaatgatctatgctaaggagaagagggagatgggaataggatggctttgcttagggtctatatgccaaaatgcagaggataaagagaaaagcgaccagcacttcgaaaaggaggttcatgttagaaggtaacatggcacagtgaaaatcacaggtgtctttggagccgaagtctttaaatttataacatgcaacttagtgtctataatctcaagcagtttatttcatttttctgagcttcagtttcccttataaactgcggacagtaccacctgtttctcagggttgccacaggatgccatgtgattattcatgagattgtctggaatatagtagctcagtaaaatataatccctctctgtcaatcctgagagccatttttgacaaaacaaaaagtttcagaatgttgagaagatccataaaatgcatggacctaggcaaagcaggagctcagagctagaactggttacatgagcagaagaagcatccccactgctctcaatcaaagacttgggttctcaaggacaaaattcatacaatgacatctttgggaccatcccttctaagcttttaagttgtttaaaggaaagtacaacaaagaaggctagatgatgcctgttattacattattgttaagactggagggaaaggcattaaatgtaaaatggctaactgtgatttaacaacattatcaaacatgattctacagtaaaaaaaaaaaatcacagggtattaagtaacatcatatcaattccccagggaatatcatttagagacaagataaaactggcataacagtacatacagttggagaattgttatgataagggacaaaaacacattattttcttgtgtatgcatctctttgcataacaaatataaaatgtctgaaagaaatacacagtggttccttttgacacaaggactgtctgtggtttgggcatggggagaggggctatcaaaggaaaccaatatttttatctccattttcaccttttaatacaaaaatgtatttattatataataatacaaatgagggaaaaggaaaaaaggaggcaagcacatctacctccaaaaattagtttggtggacagggagtgtcccaagggaaaaagcaccagccacctgatgctgctgtgaatgtagatgtgaccctctgtacttagtgccagtcttgagaagtgctccggagactggttttggctttgtctattccagagggcacaaagaggtcacctcataagggaaaatacccgttcaaatgacattcttatttctgtctctctgttctcacaactaagcacaatacaagcaagggcctgccattcctgaccttggtcaaccctgatatttcgtccatgtactatttcttccatgtacttttccttcaagtaaaaccattagaagtctgattttcatttccttccttcttttcccattcaaaaagagaagtgctgagtagtaagtagcaagagttccactccaatgtcagggttctgtggctcttgcctctctgatcacttaaccaggaaaggtaaggaagaagctactcaacctaattatagataaaaatagcatggcatttgagtgtctgtgcttttatctgaagaaggaaataaggtaagaccctaatcttaaatgatgcatatacaaatagcggtagcatttagttatttttatggataaaatagctttttaagttaattttctttaactttgatgctgatggcacaatagcatgatggcacctctgtgtcattataaaatgtctatcatctccttacggactaaaagcaggaaagaaaaaaaaaagtagtcctgtttcaggctccaaagtgaggcaccgatttagcacttgtcttctcttctgaatttgcagctggagataagctaagaattgggcatgaagaggaaaaggaaggaaaactcaagttgaaataacgataagcaaatgctcagagttgttgatgtcatcctagacattgttagagaggcaaagacagtatcagtcattttgacaagccccttctgttcactgttactgctttcccagggaggctttctttcacatttaagatgagaaatcatattcctctccacccacaatttcccctttctttttttcactttgttaaaacatctaaaaatcatgaggcaaagacaaactggcaaaaaaaaaaaaaaaaaaggaagaaaatgaacaaacacaacaaaactgaatgaagcccaaagtgtctgaagagccaaagcagctcccaacttacaagggggtatatggtaaacattctcaatgatgttgcatctccccagtaaataataaaataattggtacttgtattcacagttttgcccacatctgatgttgaaagcttagactagatgaactaatatgcatatgtaataaagcaatatagaagataaccatactgttcaataaacagtaaaagaaactaaaatggactggaattatttgaatgttaattcttgaaagtaagttcaattacagaaccttgcagtggatagatggaaagtcacaaggcagaaccctttgaaagcagggaatatgtcaaaattagcccagtacttagcacaagagagaaacacaataaatagaatgtatcataagttaatgctgcaaatataaacaagaaactgagatgtgtccagagttgaagatgatatattggataacttttagaacgcttaatttaactcaaaatgtaaggattttcttttacctacaggatacagcttagtgtttaaatttgcaggccctggagacagaaaataagggtctaaatctatgctttgtcatttactagctaggggacttgaacatattacctactggaagcttcagttacttcatttgaaaatggagacaaggttgcaaggtgtggtggctcacgcctgtaatcccagcactttgggaggccaagaagggcagatcaggaggtcaggagattgagaccatcctggttaacacggtgaaaccccgtctctactaaaaatacaaaaaaaaaaaaaaaatgagctgggcgtggtggcgggtacctgtagtcccagctactcgggaggctgaggcaggagaatggcatgaacctgggaggcggagcttgcagtgagccgaggtcctgccactgcactccagcctgggcgacagagcgagacttcgtctcaaaaaaaaaaaaaaagaaaagaaaatggagacaatgcaaactgtgaaggttagagtgagaattaaataatatatgaaaactttttgtaccacgcttcagtgctagtgtgtttacaggtatgtgttgttattgttcttgctgagcccaggagccctaggaagagatatgtgttcagctggcctccaagttcatgactcgttccaaaattaggtcctaattttgatctctgcctgcaattgagacaagaccatctgaaatgtatttaagtcttgttccctttgcaaccctggttccaatgttagaattaggtatgtaattagaaacctgtcagataggtaacataaaatggaatcaggaccagtcaggttttaatttttcctttttttctcccaaaccggtgactatgaaaactagctccaaaatgctcttaactgagcacagaaaactgaaaaggaaggtaaacgaaccattaatggcatcaattcttccctgcaaacattttgctgggaactggtggtcgacgtgatctgagcactagtggggcagcacaaaaaaagataaaagaaaaacaggtaatctgagtctatgagtcagtgatccatcaacttgaggactcatgtaagaacaaaatcaaaagtgaaaaacaaacaaaacgaaaaacagaaaaccagccaaacctgataaaaaagcaaccgtgtatgaaacgtgtaattttctctttacaaaactcacagagcagacagcatctctccaatttgatcaaggaagtgtcagccttttggtcagcaaaatgcaattgtggaaagctgaattctacctcactgcccactctgctcagctttcttttctttctttcttttctttttcttttttttttttttttttgagatggagtcttgctctgttgccaggctggagtgcagtggcgcgatctcggctcactgcaacctctgcctcccaggttcaagagattcccctgcctccgcctcccaagcagctgggactacaggcatgcaccaacacgcccagctaatttttatatttttactaaagatggggtttcaccatgttggccaggatggtctcgatctcctgatctcataatctgcacgccttggcctcaaaaagtgctgggattacaggcatgagccaccatgcctggccccgctcagctttcttaaagcaaaatgcccattttctttatttcagaaaggcctagaagtttcacaaatttgctcagctagaaattttcaaggattataatgatatttgactacttcaacatgaaaactgctttggatttacctttggaagttgggaacagcttaaagcattctgcctggatgtgcttgatctgaccaggaaggctatcttagaaatgtcaggagcatggatattcactcggtcactactcactcatcttattagtggtggctatacaatttttgcatacagaagacattgcttaacgcatttgcatatgggaaaaatctctgaaagtgtggcttttgggactgcatcagaaggctgggaagcaaataatgaaggtgaaataagggggaaaacaggcttctagccaacttgaaaatcagtatttcttgctcataacaggaaaactaattcagtaccaccaacacctggtggtttgtgtcttaattgaatcattcagttctttttttccccctctgctactaataactgaagtttaataggattttaacatttccagcaaagtggcacatatccctagctctctcagaagaggtaattgaccacgattgtattaaaccatcattatgggaaatgcttcaggtcccagaagaaatgctaccaatgcttgtaaattggaatgtccttccttccttttgtccctaaggtgattttccagtaagctaacgtgttgggcaaatgtctgtaacacgtgattaaacatgattcaatctaattaaatacttatttaaggtcaatttatctctgcttgactttattacctcctgtttgaccttggcccttttctttccttcctgaataagtctttgctttggaagcgtcccttgagtgacaataatccttttcattttaggctcactttaagcctaacctcttccaagaaaaccaacgatcacttcatcctatctaaaacaaacaaacaaacaaacaacaaagcactctccaatgtctgctcctagtttttaaaattacaagtaaacacttagatcaccagcctagaaaaatatgacttaccaagagttccaagccatatagtcagcatctttgaaaattgccctgcaccacccagaaaactgtgattcataaataagaaaaacgtcttcgatagacaggtatctaccttattaaaattcttacgtttagattgtagtcaaattttaatgagaaataaaaataatctggcttcctgttgacctttaaaagagaagaaccttgtgagattctgtattccattagcttaatctataccatttccagcctttgggatgaagtcagaaatcctcgttaggaacctttctctgcatatttgtggagagtctgtctccatgtcatcagctcattatgaaacactaaggagaggggacacaacagttctgctcattgcagaggcacttcttttgatggatgtggattttatctcctttaatcgcgggcatttccctgcatcccagttgagagggaggatctgtgacctcaacataattgtattaatgaatcagttgcaagcagaagggacacagtctgtccatgacagaaaaacgagcctaaaagatatgttaggaactaatgagtaaattgggagaatacttgtaagcactctgcttgccataaatagcaacagcaagggaacagcatacaacttagcgccacaggcaagtagcctttccatcccagcccactcacttgagcccagcagtggttaacatgatttacagatctttgatggctttggaagtaaatgagatgccaaccccaatcttgtttgtggcaggctgattattcaaagatatgtaattgcataaaacaaaaaaaaatgctcatgttacattggcttttcaaggaggtttgctgataaagagctagatcttgccattaggtaagagagattctagatgaaaactaactgattcaggattctatgctgtcatttggggcatttcttattcttatgtgcctggaaccaatgaatgcacttctgcttgaatatagctcccttactttcagcaccatagttgaaattccaattttccaggatatatctgtttgggcctccataggtctggactcctccactactttgatttccttagaatacatgttgtgtattggtgattctatgtcattggcatgtctttctgttcattttcttaagtattcttgcatcctttttgtgcatcttccccacaggcataactttgtctatgatttggttaattcttaggacagcagggaaatgggatcatgttcctgaagatagcagaggaacttaaacaaacaattggctctagtcaagtcctctgtgaacatctcacgccttttctgattttgcatcacctcacttgtgcttccatcctgcatagacagctttccccttctgccctcatgctcaaaggctgcctttccatctggcattgttcaaaggcacacagccttaccagatttcttccacctggtaggtagggcccacctccacctctgaatgtgaggcaaactgagagaatggagtgaatgtggcaataaaggctggtttttgagtcaggcatacctggctttaaaacttatctctttcctttactagctgtgtgaactttggccagtaatgtatcatcttggaacctcagattcttcattgtaaattggtcacacttatagtgatttcagctatttcacagatagaatacaagtatttctgcaaaatagctatgaaagggactggaactcaggaggatctcaacacattattttattttccttccagtatttccacttactacttgtacactcttcaatataagtataaggtcttacaatcttcataggcaggaaacaaattccatagcacttccatttctacttaggaaatttaagtaatccttttctccagataaacataagcccttcttccagaaaaaaataaactaagcctaaatcatgttcttcatgagaaagaatttacacaaaagaaacaagagattaaagtgtactttgggtgaacacaacatcgggttgcatgatgtcccatcttgctctcacagttagggaagttgcaaatctcaagagtgacctttcacagtcgctgggcaaggaggaaaggcagaaggggcaatagagtctagattttgaaatcatcagtcctgtaagtgtttgatcccatcactgtcatttaccagctggttggctttggataagtgtctgaactcgttttctcatttctaaaatggaagtaacaacagtactttgtgatgattaaatataatgaaacaaacccatggaatgtgcttagcaaaaacactcaaacacacacctgaaccacagcatagggaactgctgaagaactgctaccattagttccttaaggaacattttcctagctgggacttcattaatcctaatacccctttatcgtggagatggagcacttcttctattttctccttgcttcataatgctgatgcgtgatgttgattaacatcaattctttggcatttctccccactgccctttagctatgatctcaatctccaataaggtgtcctgggtcttactcccaggtcgtgccactattcctggtgatgagactctgataaaaatacattaaattctgcaaacttcttaataagaggtctgcctaaaaacatataatgcacatctgaagtccttttaaaccaataaattatttgcaaaaaaggatgctctttctcaacaccagtccctgagcacaaactcgtacaaatatcaaggcaataacaaaagtttccgttcagattcaagacaccaagtacaagtcttgctggagcaggcttcttcagctggttgctattgacagcagactgggtgaaattgttctgaagtaccacatgcatgataatagctgtctagatacagcaaatagatataagcaaatgaatggtcttggaactgtctgctgtcattcatttaaaagagaatctcttggaggctgactacctttgttcaaaaataaatttaactagaatttagttgccgtgggacgaaagaacatagaataaatccatcaggctcaagcgagagctgccagttccttcaacgttaagagaaatacaatgattgggctcaattgctcactggcataaaaagaagggagaaaaaagaatgttcaaataactctgttgttatcaaaggctgcacatgagcctgaacaataacataattgcctttgttcattagggagaaaccaggtggagacggtttaatgtcttaattaggaaaatatttcacacgagcataatttaagttttaaattttacccactcttcccaatttgtcatttaacttgaaaatgggagtgtgttcttgtcatcttacattccaaaggcttcttcgaaacaaacctcttcaaaggaagatctttaagacccttttcaactgctcttctaattctcctttctcagtgcccctaataacttctttgatggcttggatgaaatctctttttacttattgattttagttaccccatcactcactctattgctattgctggattctgtgtgagagaccattgatcatttccttaacttcacaaaagctttgctttgctcaagtgggagtttctgtgcttgttgatgtatgtttatccattaggaatgaaatcatgttgctctgccttacagaggatccacctcatctaacttgagcagacttgataatgtcttcaatatgtccaagttttctatatattctagggaaaaagaacaaactatcaaggaagaaaaaatgtttcacatgcaataaaggaccatccaactggagggaatcgctgtcttccaatcctaattttaagacttcattgtgagttaagagaacccaaactttctcagtcaaaccaccaataatgagacaatctgaataacctagtcactctagtgtccttatgtagaagcagaggaaaatttaaaaaaaataggtttctcatcttatggctacttttatttacagaaggaacaagtggactctgctatacagttacaaactgcagagcaacaaataatcaacatttctcaaaatcaagcttcatacttataatagttttaaagtagaaaacatattgctaaagcagtaacagatgttaaataattttgagaggtaaaccaggtattaaatgattaatcaaaaactttccaaaatctatccagaagagcaaaggctgggagcaacttatttagagttgtaaaaggagttcaacatcgtaacaacggcctcacatggctgacaagagcttctgtgcagcagacaggcaatggatgggagcacaaaaatgtaaagtctttcgacttagaatctaacatcttttgttcccactttggcccttatcctacctgaaggtgaacagatttccctatggactctggaccccagagctccttcctcgcagaaagttttctttttttttttttaatcctagattactcttttaattggaattaaaaaatacataaatgaaatttactatcttaaccatttttcaatgtacaatccagttgcggtaagtaccttcaaaatgttgtgtaaccatcaccaccatctatttccagaatgtttccatcatccccaaacagaaacactggagccattaagcaataactccacgttcctccctcccaatcccccagtaacttctagtctactttcttctgtctttacaattaaatttgcctattctgtataactcatagaagtgataaaggctagaatttgaactcacttttcaaagcctccttgttgcaaacaccacgtgtaggtgtccaggtcctatatacactctcctgctctttatagtacctgtccttagttctgagcattcttgcatttgggcttcttttgtatttcttttaatgtttgtcccctggtgttgacacagacattattattggcatgtcctcttcccaggtctctgacttagatctttcacatcacatttctgccttatcctctgacccaactcctgctcctccaagtcttacctcttttttctaaaactaatctatcaactatagagcctccctcaaaaactgctgttcccacagtctagctgcagaccatctcttggatgttgcagcattttggatgaaagcctctctcttttggcccgatgcagtggctcacgcctttaatcccagcactttgggaggccaaggtgggtggattacctgaggtgaggaatttgagaccagcctggccaacatggcgaacccccccatctctaccaaaaatacaaaaattagccgggtgtggtggcaggtgcctttagtcccagctactcaagaggcacaagaatctcttgaacccgggaggtagaggttaccatgagcctagatcacatcatggcactccagcctgggccacaaagcaagactgtctcaaaaacaaaagtctctttcttttatacttgagaataatgctaggcagagtctgctacacagaggatgctatcatgaaaatcctctgtgacaaaaatcctctgtgactgagttatcgtcaatccactttacagactgagcagccgaggcacaatgataggtgggaaaaatcttatcttcctttctttccacttctttcttgtccactgcccttagcctccgtccaacaatgaaccactgctgttggctgaaaaatagaaaatttgttttccatcaatgtttctttctttgagaagaaagtagcaaagtaaaacctagaaagttaaacttctcagactcaactaagtaagaacttatagataattctcttttgcctagcatttaaaggcatcgaatacaggtcaatttctctctctctcaccctctctccctttcccctcttctttctcttttctctcatctttcccacccatcatccttacctcctcaagacagtcaggttttataaactccaggcaatcccattatttattcctatacccaagctttagctatgaatagacaatttcacatttttcctatccaaacccacctattcttaaaaattcagtgagagcccctcttgtttagcactatcccacccattctgctcttaattccggtgccatatgttaatttacacaacatagcacttaattttcaaattagtagttccttagttctagactcaagctccttgaaaactggagttatgatgttatttgtaccatgtacccatcatggtggcaagcaatctttagcacgctaacagtagacaacaaatacttgtttcttgattcgataattcagtcacagctgggctgaagtttatctccgtactgtcaatgaaataaagggctggctaagcaaattaatactgtaaacatagagaatttggcctactttatgtgaaaatcaacacactattttaagcagcacttccgtgcctagttccattcaaacaatcgatgtgctgattgtgattattgtctgtttgttaaagcattaaccagattcactaagattaccacgttcaacagccccgttgttactctatgtgtataaccatatttctgctattacccttctcatatatttcaaaaataaaaaaaaataaaaaacgagaccttgtacaactaactcaacatacacacaagcttttcccttcctttgaaacaacaatcacacttttggaagagtcagagcaattttgtttcgtcccccttatcagtgtggggacaaagggaactttccttacacccgctgaaggttcagcctctggaataaactagacaggagaaaagacgtacaaatttattacattcatattcacagagtctgacaaaataagagattcaaagaaaggccagattggttgaattttaaatagaattttgaactacaggaataaataggagcttgaaggctcctgcagagaaactatgagaaggtgaggggaggaactgcactgtgaacgaaggttgtctttttgggtggatacagctttttaggcagcagtcctcagaagaacaggatccatggacctttggtctcctttccagtgagctaatcttttgattgatattatagggagggggctcaagacaactgcattccttctgcagaaaaaacttcccttacttagataagggaacttcagagaaagtccctcctgtgtttcaggagggaagggtagaatgccggagaaggtcagaaagaccttgattttgaggctatttctgaagcctttcaatatcctttatttcagagtactcagtgtgctgaagcagtacatttgggggtatcattttctgagttccaacatcaggtacagaagatgtttttacaggagttagaaacccaggctgctggaaggcctttgtgggaagaacccacaattcagcctcattgcatttcttactttcttcccttgtgtctgtttcaccagccttggtgcatgtatgtaactgctggcacttggagacaactgttgcagttttctaacattcagaactttagaaatgtgccaaccaaaaacaaatctagctgtatctgtgaaatgaatggaagtccaacagatccccagctttcaactttagattttcttctgtcttttctgtctgtctaacaaacataaatagcttactcaagcagtcctttacactgtgtcaaaagactgctgaacgaagaaaacatatgcagaactacagcttccaacaaactttgccacaaattgctgacatttctgtgtgagtcagaattctctccctatgcactgctactgttgctattattactactagtagtagtagcagtgctagtagtagtggtgacaataaaggagtcagagggtcttcctggccctgggaaaagtaactggcatactttcactctaataggttggggaccagggggagttagaaactgatgtcaggaaggaaaaaaggaattatgtggccacaattaattccatcaagaagtaactatcattttactgcaaatatttcacaactttttaaactttacgcttttaactcctactgaccagcctcccttctttctacctctaactaaagtgaataatttaagatttacattccatcggccaggcgcggtggctcaagcctgtaatcccagaactttgggaggccaaggcggatggatcacgaggtcaggagatcgagaccatcctggctaacatggtgagaccctgtctctactaaaaatacaaaaaaattatctggacgtggtggcacgtgcctatagtcccagctacttgggaggctgaggcaggagaatggcttgaacctgggaggcggaggttgcagtgagccgagatcgcgccactgcactccagcctgggcatcagaccgagactccatctcaaaaaaaaagacttatattccatcattccacagtagcttagtgtaactggaccacaatgtaagggttggggtgggatgagaaatcggacaagtcagcagaggaaaagtcattatcgttccagatacactatagggaacccggaaggattttaatgggagtacaacaatcaaatgcatctttcaaaaacttaactctcgttgctcagatgatgtcctgggcccttagttgagtggccatggctttgcctgtgataagaaacacacaaggaagagatttggaaaggagaaaaaggtgctgtgggaatgacactcatgcttttctgcaggtaaatatgtacaaatacatctttcccataaactccatgtgggtgaggatctgtcctgtctgaacacagggcctaacacataataggagcttcctaaatgtttttcaaatttgaaatttaattcaaataatcaaaaggggactgtgggaaagaacaaatacatgggtaattattcgttatggtaaataatttattatggtaagatcattagtttcttttaatgattttatgtcctttctaaaacaattggaaaattatttgcattattcacatatgtgcctctctcccctattgaaatatgaagtccagaaggctgaagactatatttactttcccagatggcactgagcacagtgctttgcacatagtacatgcaaaattaaatgcactgaagtataaaaatggctgatatcctcttctcattaagcattaaagaggcaaaagtatcatacacatagatcagaattcccctcaacaaagaaaaaatatacccagacaattatgtcaccaaacgtaactttaattgtatcaaataaacacaagttgctggaaaaatcatgaaagggcattgatcaaactatcctccttaaccagcacctgccaatccagaagggtgctccttatagaagctctgatatagaatatacattggaagtttcctaatggctccagctatcagtgtatctgattaacaccgtattgtccagaaagcaattacgtccaagcattattctctacaattttgtagaagaaagagaatattataatgaaacgacatatattaaatacccagtaaagtgcctggccagtaggagacccacaataccagacagccattgttgggtttatgtttcttttttaaagtattattaaaatcacatgtcctttcataaaataatcccaggtgatttctagaatcaaaagccagaagacagattagagaagctactaaaagcaaagagggaagaaaatacagatattacatatggttgttatagcaactgaaagcagcccctgatctctctctcattctttcccacctcttgctatgatcctgttttcaaataaataacctctggtttttcttttaaattgtccatcaagatgaaaggaaaaggtggcccttgtttagtagtaaagagtgcagttgtagaaaaaaaaaattggggaagaaaaaaaggatgaaaagaaaagataacttaaaatcaaggaggcaacattgagaaatccatttacgcaaaacttaggaggacgtttttcaccaaagacttttcacaggagtgactctggaacccatatgcaggggagaggacaaaagtcctggctttcttcatacaagtgaccttctgaaatcctaaaaaccaaaaagaatgagagaacggagctcaaacaataagtctttactttcctgagccaagttatgggttccacatagcctacaacaaaaacacaatgcatcatgttcagattgcatagccatcaaagcttgaaaacagtgggtttgctgcagtagtaaagggtcttggagacctcagagtttcagtgcagaaaaaaaacaaggcttagagagggaaaatgacttgtccaaagtcacaactggtaagtgagaggccgaattaacaataatatccaacacttgcaaagtgcttaggtacagcagatgctgttttaactgcctcacatatatcatttgatcttcataaccacattgattattaagtccaggttaaatatgagaatggaggcacagggaggtgaaacatcatggccaagatcacccagctagtaagcaggagtaccaggtttcaagcacacgctatgtgatctccggtttcacattcgtagctaattcggtctacactgacagcctccctgcactccaccagaactcccctccgtcccctgcttccttttgcaaatttgagaggaccagtcagctccacctaactctatctgggaacaaattcccctcaaatcactctatcttctacagatgtaaggccacagtctagcccctactctagataaaatcttgtccagtgttccattttggaaaggaaatgtttcaccaacagaagaatctggggctctgtggtcgtaaggctccccatgggccctttaactcttggttcccataagggtatcccttaatgtagctaccagcctgctgacacagccatcattcctccagcctggaagccaggcactagagaatgctgagaagtaggaatggcagaggatgaagccaaccttgggtgttatgtaggcactggatgacacaggtgccagagcattccgaggccaactgtactgatcctactgggtcccagtcttttttgacctagaggaacactttaatctaatctcatcctgtcctggatgtcagcatatagtataccattctttctgaccagactctgcatcctccatccccgacaactcaaatttcaactccctgaatttatttttactgccctgccagactagcctacatcccctccatatgtactagaatgtatcaaaagttctgcaatagtgtcagttacaagaatattcatagcaaaaatatctgtcccaaaactgaaaactactcaagtatgcaccattgggagcatgaggccaggtgtggtggctccgcctgtaatctcaacactttgcgaggttgaggcgggcagatcacctgaggtcgagagttcgagaccagtctgaccaacatggagaaacgccatctctactaaaaacacaaaattagctgggcctggtggcacatgcctgtaatcccagctacttgggaggctgaggcaggagaatcgcttgaacccaggaggcagaggttgcagcgagccaagatcatgccattgcactccagcctgggcaacaagagcgaaactccgtctcaaaaaaaaaaaaaaaaaattcaatactgttaattttatacgcttttttaactactcaattccaagttccatgaaggcagaagccatgtgtattctgttcattacaggatctctgacacctattacgttcctgaaatataataagccttctatatgtgttaaatgagttattgagtggaaaaatttccattattatcacaataatcacagccaaaataatttctcttatattttcatttctgcaaatggtatggtgactagcacataataggtggtcaattaatttttttttaaataaaagaatgaatcctctatctcctaaatgatctctccaccccttaaatcctttctgaatttcatgactaaccattcttattttcatgtgactttccttagttcattctttacttaaaatatttactggctccccacctgtacataagagaaagacaatacttggtgactaggatctgaactatctttgcagattcgttgtttattattctttacgaggatctatctgtccaaagagaatgtgttttcttactgcatccttttcatacacagtttttcccctcctatttttccttgcttgctccaaccctcagtaatcctaccttccagtaaactgtgcccagggttgatggtctacaccactcatcaatcttttacccattcttcgtctaagataggcagacagagacatcagttcacatttacattttatttctcatgtagattattcacactttgaggacaaaatatcttctttcaggcttagaaattatttttaagagtaaagattttcaaggcaatttaattgttcataagtgcacttcatgtgtagagtacatcttaaaattttaggagatttctcactgaagccaaataacatattttgaggaaaaaaatgtatgtgccaggcccctgggtaagtgaagcctcagtgcctctacgcggtccatactttccgctgtccctcactgcagactgacccccacgagcaggctggaacaaatgttcgttgcttcaagatatttcatcccagggacaaacatattcctttcctagacttttcactcttttcctcttctctagccacgtaagatggagttttgtgtgagaaattcctctggtgccaaccaaatgagggtaaacaaaatccatctcccctggcaaagtttctccaatctaatttgtgtaattacctatctccctaatgatgtgcttgtttacagattaaagctatgaatctaagcatgaaaataagattaaatctgatgaattaaattcccatttgcttaaatcttctggatattctttctttaaaaagaaattgcaggtagaaaagaggataagtcactagtcttggaaagccagaaacacactttttaaaaactggaaccaagctagtaataggcagagttgtgcacttagttttagccatgttgatataagattggcttatttggaaactctgaagaaaaaaaaagtcaagacaaaatgcaatttctattactatttatctatctaaaagctttctaaatgaaataaagacactgccacctagaccctgtgatctggtcctgcaatcaattggtgactgcagtgagctcctagcaaattctaggggatgccagagagattgggaagagagagagggagagaaagagaaaaggaaagacagaggggaaaaaacagacagcagattctcaaaggtatagtcaggccctgacacatatacacaatcagtagagattggtgaagcccaaatacatgacgcagtttcatcaccaaatggctgctatgatgctctccatatgccaaaccatatcatctagtcttttggcaagctcttcactgaactatttatagtgattgcagtcctttccgaaaaacctggaatgaccaacacatgatattaataacccagacatggctaataactggatcatattcagcagctccatgcacctggccaaacactaagtgcttcacgtatgtcctcaccacactcctatggggttgctagcatcagtcccgttttgcctttggtgaaattgagatgtagagtgtttaagtaatttctttgaagtcacctggctagcaaaaagtggagaaaactcaaacccaggttcatgggcctccagtgattatctaaagcatgatattccactccttcatcagggcaaagctaacactgcaacagcattcaaattaaatccagtaataaaataatctccatcttgacctcacagccagtcatgtttttctgttatctaccattcaaaaagaaaatacatgtatatttatgtttatgtgaacacacattaaatatctcaagtttcagccaccaaactttccttgcagaatctatgaagttgagtttaccacaacatcacaataattcttacatactgattccagcaatacagggcttcaaagacttctagaagtatgctatgttaaaagttgttaaaattcaaacttctaatttcatgacatgtgcagttttattgtcagcaataattccacaatatcatttttgtggtttgcttctttgtggctgacttgtaaatgttgagttttcaaacaaatgaacaaacatttgttcttattggcccatgttgtcacagactgagctaaaattccacgtttactgtgaatgcctataatgttttttaagtgaaatgcattctacaacctgcctttagtagaaaattcttacattatgaaggccagctgtcttaccaaccattgtgataaaatagctaatattatgtatatatattcttgtatatacctatacatagtcccataagaaattgctttcaagacatctatagctctattgtctcaagacatcattcgatatcccaacatataacacacatggtaattctggctgagcattggacaaaatgctttacatgcatgatctcttgtaatactcaagttaaccctgttagtggtcacaatattagtttcattttatgaatgatgaaatgatcttggaaaaattaaatgaccagtccaatatttcccgactggtaaacggcagaaccaggaattcaaacccagtcttcaactaccacattacactgacagtgttttgaaccctttatgaaaagcaagggcatccacactctgaagtccttcacagcatatttagttcagtctctacagtcctcagatttctcatctgtaaaatgaggacactggagaagatgacctcagagatctttcttcttcgtaagcgacccatgttaactacactcagttaccaaaatcagactggtggaaaagcaaggaatgaaaggtgtctggcaaaaacccatgtgcactcaagtagagttcataagattctggactaagcaaccccctgggctaagttttatcttggctacttttgtagagaggaactcaatggaggggaggggcacacacacattatttaatactgaaacaaattaaaattattattgtctcctccatctaataacataaacttcagcatttccttccagagcctattgttaacattgttcatattctccaagctgaggaagtatgcagtgagcccagtggggattattggactatttttcaaaaaggtagtagttatgtaacacagacttgctctggggcagtgctcagatcactggctcaaaattgttcctggctcattatcatgtaataaaaagaagttattattactgttcctagtctgtgtgtatgcagaagtcccacgcagagtgcagtggtaacgggcatggggcagaggaatcccttgggtttccagttaaggccctaattgggtctattttaaaggctgcctgtaacaaggaggagtttgtgcctttgatcatgactccctagatgcctggcttcctgttgcactcaggagcttcccccagcacagtcccagcagtatgtcctgcacacagggaactatgctgaggcagcagagtgattttctgtctgtggcaccatcccttcacttcactgaatattgcacaatcaaaaacaccagcattcaccttcttgtaaaatagtctaattccttctcctagacttgcagtgctatgggaaagcagttcttggcaatttaaaacacacctgaatctccttcattctaaggagtgggaagataaagtggaggaggaaaagagattggggcaccttgaattatcctccccaagcaatttaatcactttaatctcccatggctttcctattcaattctagggaaatggaccctggcttggccctcttatttgctacttcccaggggccattctccatttacttgtggtttccaagtgcagcctttggcagaggtttgcgaggaggaaatgatattaaaatgtgtgcccaggagatgcagattctagcagagttcctactagtgactgatttttacaaacgccagcttgtggtggggagcttggattttgtggcacagagaacccgcgctgcaagaagcagctaaaaccacaagtgttcttcttccctaagtgttcaactacactccaaaatgttttaaatcctcttcgttaaatgacacttctcaagtactagtgtgagaaaggcactgtgttaggcatagtgatgaagaaagtaaatgtcctctattccttaaagctacttagtattcactttgagtatttattaaacatcacactcagaagatttatccacagtctaaatttatatattttatttgtgcactggtctatattaaaatgtcttagtatggctcaaatgcatactttctattcctagaaatccctctcaatcattagtacttcagtctaatgtccagtttcacctgcggttcttctcccagctcttcttcaatgccatcatcactagatcataggtagggtgacactgacagggttatggaacagataaggccttggttattgtccagtctggcattctcattttgaaatgaaggaaataagccagagaactaaaattactatcattaaatacacaggaaatttgtgatggaactggggccaagaccaacgtgtcctgactcctagcacaggcctccctgtatgtagtttctaaaattgctaaggtcacatatgttatacctccagaagcaaaggatgaagtagtatataacagacaaaggatatcacatcactcttgatcatacacattttgtgacagactgtgtgcactggccctgccctctatagtgttatcttgagaaagtaggtgtaaaaatcacaagtaccatcggtatccatggtcaggcactcacacaatgccctgaaaatgagttcaatggatgaattactcctacaagtagctttgcaactggtctcccttttttctatgtttcacccatacaatttatttttgctatatatgcttttcttccaaactaaaatgctgattatgtcactcctttatacattcacaataaagtccaatctcttattttgttttgttgtttttgtttttgagtcagggtctggctctatcgcacaggctggactgcagtggcacgatgttggcttgctgcaacttacacctccagggctcaagccatcctcccacctcagcctcccaagtagctgggactacagacgcacacctccacacccagctaattcttcttttcttttctttttctttttgagatggaatctccctctgtcacccaggctggagtgtagtggctagatctctgctcactgcaacctctgcctcctgggttcaagcgattctcctgcctcagcctcctgagtagctgggattacaggcacgcgccaccacaccaggctattttttctgtatttttagtagagatggggtttcagcatgttgatcaggctagtcttgacctcctgacctcgtgatctgcccgccttggcctcccaaagtgctgggattatgggtgtgagccaccacgcccggcctaattttcctattttttttgtagagatgaggtttcaccatattacccaggctgctggtctcaagcaatccactcacctcagcctcctaatgtgctgggattacaggtatgagccactgcgcccagccccaaactctttcaatctagtttgcaaggcccttttttgtaagatgccagtttttctctccagcctcatctcccatcccatcttccgctctgtattctcccttcctttcatgggctgttcccttttgtgctctgaggggccacacatgcttatccttccccttagagcttgcttgtctcatgttttcatctggaaaatcctatttatcttttatatttgccagaaacatcatatgtgatatcttcttcaaaacctttgctgataccctcaccttactccactcccatttggctagattctcctcctttgcacataccaaattatatttcaactatttaattctccccttagactttgaactacttgagaggaggactatttctgtgttcttagccctaccagaaagttaagcacatgatagggttaataatactaaaacaaagatgaagaattagtaaacaaaactcaaaactgttgggcacatgcatccatatttttaactattaccctttccttcctcctgtaactctttgctgaccacagatgatgtgcctgatatcaaaatggtcagccacagagctaggcacacaactctcacatctcatcatatacaaggcatatccctgtggaacaccacctgggtttaaagaaagagcatgactctgcagctagctggcctctgccaaacaaacaagagcccatggccttgccatattgggcactccgtagtgagcagctgaaccccagctgaagagccaggttcagcactgtctcatagggaacagctccacctgctgaactccttgacattcctctcccccttcggcacagctttgctagaacctatcaatataagagtggtcacaattttgagaaatgacagcatcacgatagagacagagagacattttgcattccgtcacttgcctgcattttttacaggattataagggtatatgtgtgacaaatatccacatcacgctgttaaaaaggggaaaaaaaagaatagttacgtcaatataccaaggctttctacagtgtctcttttaaagaattaagccatcaggatgcatggtgctatttaatctatctccctcttcaacaaggtggcaataatctctatcttccagtggatgcagggggaggtgtaaaagcatttatatttctctgcttatgtccatcagcaaacaacgtgataaacaccaatgtgggtggtagtgggagatgagatggggcaagcaatgaataaagcagagtgtttggtaggaaagtcttgggcaaacatatttggcatttcctgatggtacaagtttgttaaactaccaggaattctagaaaaagcgaatgtgactgaattaaatgaccaaaagaagaaaatgaggagcctggagaaaggccagaagaccagcaacttctgggaaggaaacatttcgtcagtcatcccagactggcagattacaaaaatggttttgtctaaaagatgcaaaaaccatttattatcctggttttctttcttgatggtggtccaaatactgcattttaagaaagtctgtcctactctaaatcactgtgcaggaaaatttacccacgtgcaccaagtgttttaagaaagaaataaaatagaattataaactcatgattttgaaaacaattgagcataaataaaatttaagcaggtctaaaaataataaagtccattaaaaatacaaacaagttggctacagggaagttttaataataaatcaaggtcagacaattcaaattttgttccaattgaattcaggcaacttaaatgttagggtgaaatacagcaagttagcaagtgcacacacacaatctaactaaaacagtttctgatttgggagaaaagaggacaacttttaaatagagagaagcattttccaggtgagagaagaaattattataaaaagaaaggagcccaaattatttgcaaaatgactatcattttagctctatttttaagtcagtgccttatttcactattactgaactttacacaatttcatcattttgtcatgtacacataaattttttgtttaatcataccactggggcaagcatcctggttttcacagggaagtagctccacagttttattgcatccttatataacagaatttgcctcaaaatttgaagacaaagcagagacactgaatgagattatccagtttcaggtataagtatagcttatgatatagatgtagaagcagaagcagatacatgtgtgtctgtataaatgtccatcacatacacccacacacacaaatacaactcaccaatgtccatgataaggagaatcctaagcgtttgtctctttagatacagatttctgtaaatgcattttttacggtatttaaaccatgacaaccagcactccacctattgcctaaaaatgttcatctgatttcaaaaaatgtttcctctaaatgttttcaattaactcctaacgaatgagttagctttgggggttttgaaaagtctacttcccgaaaagaatcctggatcataacgtctcaaagactacagaacgtgagtggatgccccatgctcttagcttatggaggatcgaggctatgactggttttcatcatgaataaatccccagcacctggtgtatgtcaggtatacaccaggtatccaattaacaatcactaaatacaggaaaaacttgaggctacttgaagatgatatgtcatagcgtcctaaacgcagtagaatatagtggttaagagctgagcttttcagaccccaactgcatggggtctaaactgtctggtgtttttagaccccaacttcacaactcccaattctaccatctgctttctatgtgaccttgggtgagttacttaacctctcaccctaggttaagtagcttaactagactttaatttagagaataatgattgtgactacttcctattgtactgggaatagtacaattccttgtactcatgtctagcgaataataacagtacctacttcctattgttgcagatatgtgtttcccctcaaatagtgcctggcacatagtaaaaacccagtaagtattagttattattatattaactatcacccaacccctaagtccttacctacatttaattgaaattctatcataccccaacttaattgataaccccagcaactctcaatttaccccttcaggtaaatgtgcctgaaagaaaacgtaagtttaacctacaattctttttcttattggcacagtgctcttaggtcagtccattatcacaaatgcaattttatccttctcataatgcaatatgtcctcgtcatttttcaaacgttcttgccctgctgagactttgcaacatgggcgctggttctcagttcagctccttaaatgaagagcaggaagctattttctccctcaggcctttggcagtgctagccctgactagacagccatcagcccatcctatccactggagcagcatgctttatcaaagtgcacccctaccctccctgccacaagggagctgttgcctccaatgcatctgatttgatctgaatctacgcttctttctctctctctctgtctctctgtctctctttctctctcccctctctcttcctgtgtctcatttttggccacttttgtagaacaatttggatgagacaactcagacagattatacttcaagaatcaggatagtgaaaactatccaggcagactttctttatggtatatcaatgctgaccatttatcttctataccaagagaggtaaataaaaagattctatattgctttagtgtcctgaaaaatatgcttattgcaaaccacctatgtgccaaatactggcatataaaaataaatgaaatgaagccttgcccttgagaaactcactattaattggagcacacactagatgatgcttagtgcttggagggagacatacagagagtgacccggcacataagatcagatattttcttcatgatattcaggcttcccttcttcttgaaagtgttggagaaatcgtcagacaggaggtgatatccaaatgaggacttaaataatggaaaggatttaagtggacacagacatggcagattgagtttttaaacagaggcagtaaagttttaggcagcttgagcaaaggggcagggacggaaaataaatgatccactttgtgactggaagtctacaatggttaggagtgtgtatgcctttgagccaggaaaaccaagggtccaaaaaacactctcaagttggcatgcagatgacaaccacaggacctttactgtgcctcactgcttacattctctccaatctcctaaatcaggccttggcaaacgttcctgtaaagggtcacagagtaaatattttaggtttgtgagctatacggtctctgtcacaactattcaactttgttgttgtagcaggaaagcagccatagacaatatgtcaatgaatgagtgtggccatgttccagtaagattttatatcaaataattttcacatgtcatgaaataccattctttagattttccagtcacttaaaaaggtagtaaccatctttggcttgtgggccataaaaaacaggtggtaggacagatatagcccatgggctaaaatttggccacccctgtgtaaattacctcaaatcctacctgcaacaaaagataaattatgtctttccctctaatggggaatgcaaaggtttctttaaagatattttcaatacctggatttaagttgagtaagaggtactagggtacttataaagttggtgagcttttaaggcaaatataattttcccttctccctgccctaagattttaatctaaccaaatgaacatcaaggagactttcatagagggcattaaaccaaggcttaggtgattggaagggagctaattcctactctctggggatagtcatttatttgtctcagggcatatttgggatctgctgaaaagctctttcttacctaatttttgtcttaaaataatgaaattcctaaactgattctctactacctagcaaaaaatgctaggcaaaaatttctaaagtcacaacaccctaaaaccagatcgggaccttgtaacatcatctcaaacagcagtctgctgagacttacgtgcaaggaaagaagggaactgaaagaccacgaaggtatctcttcaactactcactggctggtaagccagccctgagagcacagctccctctgtctctgactatacatacatttccgccccagtttcatcctttctgttctttttttcttttatttagaaggtagacaagaagaacggaaagggccaaccaattaaaagctaactttgctttctgggacatttccatgtatttagcgtacatacactgtctccagttggcaaggcataactaagtttggataacactggagtggaatattctattgcattttcttactgctgtaaaaaaaaatcgcgctttaatcatacgtggtaaccatccgattcatcccaatatacttgtatctaatactgatttgagaagcatgtccaagaaaataccaaaaacaaccactgttaaggctctaaaagcagaaacatacagaataaccaataaaaaaatcccatcaccattgtgctaatcagatttaactgtgaagagagaagatagtgatgctttaaaatggttttgtgtacgtgcacgtgcatgcgcattcttgattgtgtgtgttggttgggtgaagatttaggggagcaatttatctctgagaaaatcagattcctttgtccagtttgaggacaagaacacaacattctaagatgtggaatctaatctgatattttaaaacactgttagccttggttccaaatatcttagacattgagacaatgaagaaagtgttcaaccagtcacagcttggtgattgtgctaacaacctaagatcaacccaagacccaagatatgaagaattaaaaacaggcactaatgaccttttctcctaccccgccctattctgtctgcaaaatttttaatcttgtataaagacccagcttaaatgtcacttccctttaaaaccttacctcccactcaggcaaaattaggtgtcccccagtcatctttgctcccatagcactttgcacaaaactctattatggctattatgcacttatcacagtaaattgcaatttattgtttatgggtctatttccaccagaatatgcacccttaagggtaaagatcagatcttattcatctttgtattcccagcgctcagcacagtgctgacacaacagccacttcaaacatgttttagtatttttattattaaagaaacgcatgcccatgctaaaaattcagaacagcataactggtataaaaggaaaggttaaaagttgtctttccaccattcagaacatcagtccgacttccaaaacaaaatcactcttaagagattcttaataatgcataaatactacatgaaccccttccactccacacccatctgatgaacatatggcttcaaagccatcacacatgcaagagtggctacctgtgctaaccatctgacatggttgggtgcaaaatcactcaaagcaaaaggcaagtgaagcactgtgcttttggaagggcaccgtcttcttaggaccagttcttctatgcccttgatttgattataagttcttctcactcactgatatggtttggctgtgtctccatccaaatctcatcttcaattgtagttcacataatccccacgtgccatgggagggaactggtgggagaaaactgaaccatgggagcagttacctccatgctgttcttgtgatagtgagttctcacgagaactgatggttttacaaggggcttttccccgtcttcactctacacttctctcccctgctgccatgtgaagaaggaggtgtttgcattcccttcagccatgattgtaagtttcgtgaggcctccccagccatgctgaactgtgagtcaattaaacctctttcctttataaattgcccagtcccgggtatatctttattagcagcatgagaatgaaccaacacagtaaattagtactgagtagtggggcactgctgtaaagatacccaaaaatgtggaaacaactttggaactgggtagcaggcagaggctggaacagtttggagggctcagaagaagacaggaggatgttagaaagtctggaacttctagagaattggaaggctcagaagaagacaggaaaatctggggaagtttggagcttcctagagaattggagggctcagagacaggatggtgtgggaaaatttggaacttcctataaactagttgaatggctttaaccaaaatgctgatagtgacatggacaatgaagcccagtctgaggtgatctcagatagagatgacaaacttgttgcaaactggagtaaaggtcactctttgtattagtctgttttcatgctgctgataaagacatacctgagactgggaagaaaaagaggtttaattggacttacagttccacatggctggggagatctcagaatgatggtgggaggtaaaaggcatttttggtggcagcgagagaaaatgaggaagaagcaaaagtggatacccctgataaacccatcagatcccatgagacttattaactatgacgagaatagcacaggaaagaccaacccccatgattccattacctcaccctaggtccctcccacaacaagtgggaattctgggagatacaattctagtggagatttgggtggagacacagccaaaccatatcattcttgctatgcaaagagactggtggcattttgcccctgccctagacatctgtgaaactttgaacttgagttaaatgatttagggtatctggtggaagaaatttctaagtggcaaagcattcaagagggagcagagaaattctggggggagaaattcaagcttgctggagaaagtggcataagtaacaaggagccaaatgttaatcacaaagacaatgggaaaaatgtctccagggcatgtcagagaccttcacagcaggcccttccatcacagacccagaggcctaggagggaaaaatgctttagtggaccaggcccagaacccactgctctgtgcagcctcaggatatggtgccctgcatcccagctgcttcagctccagctgtggctaaaagaggccaatgtacagctcaggccattgcttcagagagtgcaaaccctaagccttggcagctttcacatggtgttagccctgtgggtgtgcagaagacaagaactgaggtttgtgaacctctgcctagatttcagaggatgtacagaaatgcctggatgtccaggcagaagtttgctgcaggggtggagccctcatggagaacctctgctaggacagaggagaagggaaatgtgggtttggggtccccatgcaaagtccccatggggcactgtctagtggagctatgagaagagaaccactatcctccataccccagaatggtagatccaccgacaacttgttccatgcatttggaaaagctacagacactcaatgccagcccatgtaagcagcctggatggggaccccacacatgggacctagcgggaggtaactgaatcatgggagtggctacctccatgctgttctcataatagtgagtgagctctcatgggatctgatggttttataaggggctttccccccacttcactctgcacctctctcttctgctgtcacatgaagaaggatctgtttgcttccccttctgccatgattgtaagtttctggaggcctcactggcgacaccgaactgtgagtcaattaaacctctttcctttaaaaatcacccagtcatgggtatgtctttattagcagcatgagaatggactaatacactcactgacacttttgccttttattttcatctcttcctctctttttatgattctcctgctttgtttatatgcctccatcacagctctgtctttgtctcccaatatgactttctttgcctgtggtctctccgtgtctctttgtctctcatctttcctttttcttcctcttctcaatctgcctctgctctctggctttccttctgtctctctctgcctttgtcatgaacttatgttctttctcttcccttctccctccttccctctccctccttcattttctccctctcccttttcttctctctcttattcattttctgtcttccatatatctgttatttatgtctctctgtctccttctctctgttttttttttccatctctccttgttctggagctctctttccaatcagtgctcacaatcagtaaacatccttactgtggccttacgatactaatatttcgtttttaagagtggagacttaaatgttgtacattggtgcttatgttgctgtgaatgtatacagacatataagagcgcacatatttattatgtatatatttatatgtacttatatgatatgcagatggagaccaaaataaagacagagattgagatttaaactgaaacatatattgtttaactgggtgaatggaggtcactggaatttctgggatatatagtcaggttggtgaaactaccatggatcattctctctggaatcaacaaaggcgatgataaacaaaaggcctggtagcacatgctgctgcatactcaggaaacagacagagtgatcttgctcttttgcaaaaagcctggacagcagactgtctcccaacaatagtgattaaaagggaaacaggcaacttgaatgtgagctcttgtacagttgttgcctggaattcagttttaatgaggccaagttcacaaactcgtttgctctctctttcatttattttcattttaaaataacttttaaaaataactcaagcaatacacatttattaagaaatgacaaaaagaatgaacacaagaaaccttgcatagaatcctaacattcatcattatcactggcaaacattttgagtcatatcctttcctgctttttttcccacaaaagtttaattttacagtatataataattgaaaaaaactgtttcaaacccttactatttccagtatatttcttttcttttctttttttttttttttttttttgagatggagtcttgctctgtcacctaggctggagtgcagtggcaccatcttggctcactgcaacctccacctcccaggttcaagcaattctcctgcctcagcctcccaagtagctgggactacagacacccacttggctaatttttgtattttaatagagatggggtttctccatgttggccaggctggcttcaaactcctgacctcaagtgatctgcccgcctcagcctcccaaagtgttgggattacaggcgtgagccaccacgcctggcctccaggtatatttctagggacttgggatatatgagagaacaacatagacaaaaactctgacttaatgggtttatgtttgtactattttgtaatcttttattctggtattttgtggacagtttcccacttaaaaatatatgtttttataatcaaccttttaatgacttcattattctacaacacacaggtacaaagttataggttgttcacaacacatgaaaaaaaaacactttcccaaggaaatagcaaataaaattggaaatatttagtaagcaaatattaagtggaaacagctagagttgctgacagggatgctaagaagattaggacagtgccccaatcttcaatttaagaaaatagaactggaccgagagaacctaaatgcagaaacagaaacaacatcatgaatgtcatattacaaacatcttttaataggccatactggagcactattaatatcaatgaaactgtaataacagctaacccttattgatgatttagtatatgccagatgttccgttaagaagttatattatctctgttaatttctgttaagaagttatactatctctgttaatcatcaagccaccatataagaaatataccattagtaccctcattttacagatgagggaactaaagacagagataaagttaattgcacaagttcacatatctagtggatagtagagtcggcaattaacccaataaattatattttaaatcatgtgtactttctgccatttaagacatattgtggttatgtggacagccatggaagataattttttagtatacattgaatgacagaaatttcacctgggctacactgtactgtcctgtgtgatttatagagccttacattccaataggtcttcactgtagggggtcatggtttctattgagaagctgataaacactgtggactgcatctcttcatgggaaaaattaaagcatattaacacaaaattatgcagacaatggaagaagtccatggactcttaaactcatgtgcaaatcttaaggaaatgattttcaaacttgagtgttcccaagaatctcctagggagtttgtaaaatatagatgcctggtcccttctccccatcaggtcattcaaaagcaggacccatgaggacagtactttgagaaacactgccccaggcacctatgagtgagcccatgcctgcccagttaagaattcttctaccatttcagcaaaatgcaagtcagggcgagcagggctgcacatgataaatttctaaaccagggtgctgaatgtgcccaaaatagcctttttccctttaatgattataatcaagaatgtacagtgggaattgctgagataaggggaagatctttcgcttttaatctgccccaccgacccatccaccacccggccccaaaccaccaaaggccctgcagcagaaggattgatggcccatgattttgtgtctcaacagctcctgttactctggttagggaaagatgactagaggcgtcaatctattggttccagggcacaacatgattagttggttgtctgataacatgattcttattagcactttctttaaaaagtgtacacgttgtgcacactgtcactgtagggtcattagtcagcagggagaaaccaaacagcacatcccacacatcttcccaggataacaagatgacacacattaataacccccagaagccacttgtggggatggacacaggtgagggcttcaacccaaacagcatcatggagcgggttattgccaagtaaagtgtcagtgacctgacaatggggtgaagtgaaaggaagaccccccaagatatgtcattcatataaagagctcccctaccaccccatctgcactgaattgtggagttctttccaaagaaactcagaaataaacccattcaaaaataaacttatacaaaaataaacccatacaaagcatgatttatagcacaaagagctttggttccagaaagggcaaaaatcaaatcccagctctgccacctgctagctgggtaaccttgagcaagttgtttaagcttgacttctacagctttagaatgaggataacagtacgtagttcataaaggtgtcgtgataatcaagtgaaatcatgtggtgatgttccagatcatatttccagagaagctgttcactaaattggtggttatttatattatttttgttaaaggagacttctgatataatcaatatgtcttatgtagatagagttgtccctgatattcagcaaactttcctttgctctcttcttccactctcaccccaacagttagaagtagaaaaagctacatctggtaactcagttataatccttgagcaagtaaaacccattagcatcaacaggcagtccttcagtttgactactgctgctccaaaatgttgattgacactctaggtttcctatatgggaagacgtagtgagaccacctttaatattatttttaactagcttttatctgcataagaaaatcaaagagaggaagagatggctatacctcccttctaccccaagccgctattgcaataaacccagtcatgagtagtctcatctctgaagtctattagcagtggaatacatatggcagacaggttattactgggaacctcacttccagaaggtcccatcatcactctttaaggtaatttcagtggtttaaacaatgccaagagcatgacttttcatgaggctccttgttttgaagcccaagacaaacaacttgaaaagctgaacctggaactcaggagctctacagccaatattcactcttcttcccacaatggaaaaccttaaggatacaggtgcatgggcttcagacaaactacaaggctagggtgcagctgtgttctaactcttgcctgtgatgggcttcagacaaactacaaggctagggagcagctgtgttctaactcttgcctgtgatgggcttcagacaaaccacaaggctagggtgcagctgtgttctaactcttgcctgtggcaagccagcagtgggtcaaaccaagaatcactcctacagtgtgaccaaatgttatttgaccttcttcttccactaactgacctacttaataggaacatcttgttttttttatctgagagtgtagatgatatttgtctttcctatcttatagaatcgtggtgagaaaaaataccttaagtaatggaagtaatgtgtcgatctttgaaaactgaagcattttgcaaagagaaaaaagggctataactgatctaaagtggtataaaaacattcaggagtgctatagaaatagacacaatatctttcatatgtgtgtaaaatctcacataggatttccgacagagcatccacgtcctttttttactcctatctacattctaggataagctctgttctttcattctaaacgttgcactctaagattccacctttgcttcttgccaactgtttgcttactccatccgtacaatcggagcagagtttgagctccttgacaggaaccactgcacttttatggagcctggcctcacctcgcaatgaacacatctcttctctgccatcccctttggccactgcagagatgctgtttggccagtttcccctccaggagacacaagtgccttctctacaccttttagccacaaaataagggacagtaattaagacatacacaaaaacaggacaaatattttacatacatttagtggctgaatataagctggcaaggagaaaaattaatttatcctcaaggcagcctgaacagtgatctctctcaccaataacttaaacaaaagaaagtccttttgtgaaaactctgtgtggaaagtatcaaggtaaaaatgaaacaatgatgactccagctaagatttaatgtgcaaataaggtcagtcatgtctctcaatgaccataaaggtttttattttcctactgggcttggaatgtacccaaatttactacaagattgatgtgtatattttttgcttaactcatatttttcaatcattcctaaggttaaaactttcgttaaacatagtttttaaatcaagtaatttaaattcctggatataaagaggaatgtttacatctcttcccttgacctttggttatgacatccattcagctaaaaatatccttgtaataatctccaactgttacttacaatcttctctacatttcaaggtttctctgaagtacctactctacaatccagcttgaaggccatcccagccagaagatgcccaactctcccctgacttcctacagcatgttctgtcctcagagaacgtacatctcctgctgtctcttaagaagtttctttgggtacaagaccgagagctcattgagggcaggaattatttcttttcatcttgtgtagcacttcacaaatatccctatgccagtgaatgacaaatattaggagctcaataaatatttgttgaattaaaactaaacacaataatttgcgtaaggctcttggcataattttggcacatagcaattactcctaaatgggagcaattattattttcatatataaatgagattcatgtatctgcttttttgccctatcctatgaacttctaaggtctctctttaaaaaaatgtggatgtagttctgacagtcaacattcatgtcaatgttctctagaaaatctcattaaataactaagagatttttactttccaatttcacatgaggcatttttttgggggggaaggggggtccaaagttagcaagttccttaacatgaagatgtaatacaataaacccaataaactatgttttgctgcaaacccatgtgcacagattgaaatgaaggcctgctgggatctcacattacttgatttcccctaaacagatatgcatatgaactgaggaaaaaggaagaaccttgtgaaataaaaggtttgttcccttacaggtcaagggtataggtcattatgtcatttctacatccccaacactcctagtgcactttacttagtaaatgcagcaggtatccagtatctgtatgaacaaagtattaaattagttttgacctgtaatggattttagtccattagtgccattttacagaggatgaaattgaggctacaacatttcaacatgctatgactacgtatctaatttttgtatacagccagtattataacccacaattcttaattcccagtagagaaatctttcttcccatgagtaagtagcatttattgagcatttactaggaataaagcactttgtatccacgatgtcgcctcctgaggaaaaaacctccgaaagatatactatccccatattttagatggggagactcaggctcaaagaatttaagtgacttactcaaggcaacgtgctgatttagcaggacaactaagattcaaactcaaatctgtttgatttcaaacccattgccttccaaatcacaccacattagcattcatatagcattaagtactgagagaaggaattacgtggacttgctagagaaagctaaaatctttcatcattttactttttaaaaggtcagctcctccccaccgaaaaaaaaaaactgtatcaaaatgtatagccaagtcaagcattcacagccagtgtgtctataatatcagatttgccattaaattagaaaaggaatctattcctgaggaacaactgagctgaaagctgaatgatcgcaggttacctcttgctcactgaatcaccaggtgcagattccatgtctcactgaagatgaagaggtgggtggatgagagaacaaccaaagcactacttaaggtaaagggtgcaatgtgacaggcacatgttaatgtcctcgcttttctacaaggagatggagcttccagctaagagtacgtcctcctccaccatcatcagaaatcaactcaagataggattatctaaaatataaactccaaaaggtctgagtttttccgtcctactttaaagtccattgaacaagcccttctgtgcagtctgggaataggatcactttgggtgacagtctctgttctgccactgacctcctgtgtctatttggcaattcatttagcctcttggaacctcagtttcctcctgtatgtaatgacaataataacacctacacatgacatttctgtgaaaaattaagtgagatgatgaatgtaaagcatctaccccaaaagttggcccagattgggactcaatttattcactaatgttggatggtaaatgtcaaatcccagaacaactagaagcaaagaggtacacagaaatcaagcagtccatcatgtgctatgagaaatgtaacattaaagatgtcatcatggaaaaatagaagtcaagtaaaaccctctgttaacaaatcttgtaatacaattgccagtgagaaaggggcagagtggtgaattgaaatactaaacttaactccggcataaaaatatgaaaaagagatattaacacccgtcacctacttactacctacaaaggattttataaagattaatgctacagcactttaaaatcccttggaaataaggaataaacacatacaccattatgcatacatataaaggcaaatatatattttaacactctaaggattactatataaatttagatcagggcacagcatgcctgggatgagtagggtgggaacaatatgttcttgcttacgacaccaagctcatgacaaatgattcatacccagcacctttcatgccagaagatccccccaggtgttccaccaactctagcaacagtttccatcaatcgagactgcagtacagaggaatcacatcacacccacagacgaggcaaaacagacatgtctttatacaactgctcaagtccaacagctgagggggcaggaaagtgaagggaaggaggtgagtgaaccatccagaattcctcaccagattgacaagcagcctataattaccatgcatttgcaccttgaatgcaggtgttgtcataatcagagactcttcatagcaaaggctttttgctaaaggtgagaagggttcacaggatgtgcactgcctgtggtcctgaatgggtctgggggcagatttataggggaggacatctaaatgtgaaaagataagagtcccccatgcccctccaccactccaatctggccctcgggtttaaattagtggatttcccaccctggggtaaagtgaagtgctgttgagagttccaaacaagtgtatgaggctgtaaagtcacactgccctcttatgtatagcctggctcctaattctctgtagttaatctgaccggcatagcccccactttagagatgaaaaaatccacattcagcggacactcaacttgcctcggtcaaaccacaaataagcagaactagaattcaggtctccactctgctttgcattctacaaaacggccaaaaaaaaaaagtttatttatgctttctttccctttaaaaaatattttaaactttctctgagtctggtccagatacgtaggactggctttgttttggaggacatagataaagactatttctctttctccactatctgtatgtatatacttaaaaaagaaaaagaagaaacacctttgtgtgtgatgaccagagcagagactgggtcagcagaggtctttatggaataagagacttcagggggcagaaatctcacctcattagttaacatgatttgagtgatcaaaactttaacactcatcacctcatttcctacgttatctcagacctgcctgcatgttcaatgccctgaacctaataagccctactagaattataagcaccatttattattattttttaatgctggcagtgcttggcaccatttcctaaacggaggttaaaaatttgccaaagatgtattctacttttctctttctttccaagatctttcaagagatgagctaaaagaagaggtctaatgggtgagtgatattttacagcttgaattacattaaaagccagaaacattctgagtccaaagtcttttacttcttaatacaacaagagctaacatgtttgatgtgtttcaaatctccccttaaagccagaagctttgagttaatcacttaaagcagtgtgaaagttattcaatcagtttaagaagattcgagttcaaattagaggattaattttagtggctatgatatgaaagatataatggttaaggtaaggaatgagggcaagggtctccagaacttgaatggaaagaatttcagcttcatttatttgatcaaaccactcctgagaaccatataaaatcacagactctgtcatgaaggaggaattgtagggaaaaccctgctactactctcaggacagatacatcaatgctaaatattatctatcatgatgtgccttaatacaatttatatctgtgtacccaaggaattcatgatgacagattagtattttaaaatgttcacaactctcattaaaaagctgacaatgagcacaactcactaaagtggcacttctctgggaaggtttctgggaattacatcacaacagaaaacgttttgaaaggttccagactgcgtaaattgtgcatattacaaacactacaatctcaattacctggttgaagctgtaaaacttgaaatttttttcccccattttacccatccttggttgttatgttcttgtctatgtctggagaagtttccacactttaaaatcacttttagttattacaatcaaagctggttctctactatttcaactcactgaagtttctaggttcaatttaaacaggaatagctccctcagattgcagacatgcaagcttttctgaaaatctaaaacctttcctgataggaccaaagctcatggacttgcatcctaagtcccctggaatccagcctcctggaattgagcaatccctttcctgccttcataaagggaatgttaagtctttatttgtgctcttcattagaggaggtcaggcaatgggggagaacagggagttgttgtcactgggatatatctgatcttcctgggactgaccatgccagagaacaaccgctcattcacgggctggaaagccccagttctcaaaacaccctcgcttagcgctgttagaagatgctggagagttcctgccctgaaacttgcatccacttggtccctaaagcagaggatacactaaagaacaccttatatactctccactgcagttctcccttgtggagaagaaggggttaggagctccgcatgaaattaaaataaaataaaataaaacgcctacatatatgggtcttcttaatcttctttgagccagtacataggtctggcaagtaaagggaaagtcacttgaggggatgtcagcttgcctggaaatttaaccctttcatctctgtattaggagaactttaacccctctgtttacctggtcttcagttccacacaccaatgcgaccaaggcaacaggaaatagggatttgactcctcagtttgaagctgtggcatttggagaggactctgatggtgttggtgggagagatggggaggttggtctcctagtaggtgatgttaactcttgggggaagtgggcagagaccagtttgcagcatctcccatgtccagaaaccctatttccccccaattctccatcagatcacacagccgactttaaccctttccatctttccacccctttaccctcagtcccattctactcacgctgctgttgtggccagaccagtggaccatggcttggttgtgtgctgagtctcccgtcagcgcaaacgtggtgctggtcagtctcagctcctccatccggaagcgggtggctttgtccgggtcccgctcccgagtcccaggctcctgctgccctccatctcttagcactccccgggggctccgactcgcgccctctccccgttctgccttctcctgatccgctccgctccgtctcctccggccggagcgtgcagcaaccgccatggatgccccagtgccccgagcccgctccagggatagcgctcggtccccgggggccactgagaacaggggacgcactacgaggggcaggggcgtggcaggagccctgcctggccgcccctggtgggaaaagcccctaggggtcgaggccgagcgtggagcggagctggggtgcggcgaggggcagcaggagccgccgccgcagacgcccggggcgcagaggatcaagagccccgcgccggcgaggagcgcgctcagccgggcttgggagccgccgccggcgccaacttttcccatcgcgggagcgaagagcagcggagagaggggtcccagaacgaaggtggcggcacgagctctgcgctggcggctgtggggggccggcgctcaggaccccaactccatccaagttgcgccgcggtgggggcgggcggaggcggcgccgggcaggtggcggccgcttgcccgggctgggcttgtgc

SEQ ID NO: 1143 - DNA, 586046 bp, Homo sapiens
ctgtatccagttgaggctaccatgtttcattctagtcaatacataccatgtcctgcaaaccctgcccagccctctggtccaccagccttagcctctgaggcctctccttcttatatactattaaagcaaatgctttgctctttgcccataaacatataacattttaacattttaagcccaatattttagggagggttttgcaaaaggaggaataaactaatgagagaaaaaaactagatagaagcaagaggtttgtttgtttttcccccatcccaatcagaggaagcagggaaaaagccatcttagctgtttctctcaggggtgttagagcaaaagaaagtggttatgtcaagccagaaaggggttagagagagagtcagccattgcctactcagccgaacagctggtggctactgggaatcatttacctatgagctgggattccaccttctcatctataagctggccaggcctccttagttcagtctgagggacattgggcctgctttcagagtgactgactggactgatcatctcttgttctttctcattctgcatctgggcataaacattaatccccgggatcttcctaaaatattaatagaaaccatcactgctatgcacatcactgtaacacatgcttctgaacctgtcagggagaaggaagaggtcaggggtgggggaacgtggatagagggacacgcaccttttaaacttgtagatgacgaacactgccagccccacaaacaccactgagagcagcatcagcatggcagatccactgtgggttggagtgaggtccaccaggggggcttgtgggggaaacagagcagagaaaaatgagcagagaactgggcaggtgagactctatgagaggctcaaatgtttcacacacaagcagaggtaagtcctggaaaaccatgtgggatatacacacaagatgcatgtcacatggctgacatgggatgcatctgagcccacccctactcccaccccaaatgttcctgctctgcagcagagcaatgaaaagcacagaccccagggccaggctgtctggattcaggtcccactctaactagctatgtggtcttgggcaatttgcttcaccttaatgtaccttatgtggtaaaataaaaataatggtatatacttcattgggttcttatgaggattaagtgagctaatgtatgttacgcattgagaaaagtgccaggcacatagtaagtcatgtacctattagatttcatttctactgctgctagtattagtattattaatcaatatttataatataataattatattttattatactctgagtgtaagctttttccacaaagcaaaacagattgccaataaaaccacctgcaggaatacatttgtgaattcaaccaccccgtcacccctactccagtagttgtcatgtgagaaaaataattggaaagttgtcatacgtgagagaaagaacagcaaagtgatggagcatgcttgtatttttgtacacaggaaactgatggccaagtgagtatttcacgagggtagccgcggagatgctgaaggagggatatgccacctggctgtctccacaatctcccaaaagctctgacagccctccccaagatgctccagcctctcaaacacagtgagtttttctctcagacaaaacagaagcctctgcctccatgaaagagtctccctccctgagtttccccttgaggtgcagtctggaaaacacttctcgccacctctccaccttcccccatctcacagtcaaacctgttgtacctgtagactttgcaattaatttctaccctcttaaaagttgacattttgcaaatgtagtgcagctcgtgcataaaagacaagccacatgtactccagggaagccttggtgctgacctttaccttccatcaacttaagcaaagcctgatacccagaaatacaggtgacctttaatcaccattttctgtggttttctctggtgtgagccgagagggcaacattctaatcacccaggtaaaaaagttcaagaataagtgactataatactgatggtctcagacaagactctcagttgcttctgctctgtctactcttttcaggattacatctcggccactctgtattgatactgggaagcatattccatctaaccacatagttttggtgaaaaatgaaagccaccccttccttctcagaaaatagtcatttcaggagagttggctttcaggaggcactgaatataaggaacccccccgctattttctctcccctgtaagtcaaacttcacctcagttttgaaatgggaatatgtaggtttgtgtgtaaaagatgggtggggtcccactgccgtggaacgcccaaggcaaattttcttttggttcaaaattagaaaacaaagctctcaatgccatcggcagagaggttcagaaattcttcagaactcaccctgcaactggtaggatgtcatcaggggaagagaacaccttccatttgtcatagacattatcacaattgattttcacaaatggaaggcagtgactatgatccccattaaacagataacaatgaagttctcattggttagtgttgttttaaaaggacttagtacttactagtaaatggaagaaccaagacttgaacctgaatcgtcatacatacacacacacacacacacacacacacacacacacacactttctatatactcaatcctgggctaatttcagtaaaagacatatttctgaggatggggattaggactaagactatagcacaaaaagcaaattaacaaggagcacaagttaaaatactaagttttaaaaggagcagtaggaataataaatcatgtacgcttacgtttggaagacaggtatgtgtatacatatatgcatatgtgtatatatatgtatggatatgtatgtgtgcatgcaaacacacacacacagaatacagaaatgaagcctcatgtacctaccactcagcttcaacaaccatcaaccaacagccagtcttattttatccagtccccacaacctccaaccactggattattttgaaataaatcttggaaaacttataatttaaccacctataactctaaaagataagatctctctctctctcatcattaccacaataccatcatcacatcaaggaaattatattaggaagatgttttaaaggcaatattctaatgcaaacccttaatttgtcagggaacaatggaggctcggaaggggccacagatgattgggatggttagaggttgaaataaagctaaacttttcactcctaactaaatgctctttcagcataaccagaataccagtgatatgaagcaactaagaatactgagcttgcttgaaaaggttggcatttgaaataaatggaaaactgagagaaaattactttgtccaagctgtcagcaacacagcaaactcgcatatgcatgcatgcacacacacaaacacatacacacacacacacacacacatgaaccttttcccttctctttccttcctcctatctctccccatccccaggttgtctttcgattctaaatcatttacacttaaatcatcattcttcaacaagcagcattaacactgttaagtaattagcatattattctgggaaaatgaacttctgtatcccagttctaaaatgtgtgttatccattcaccctccccatctctgcatcagtcagtcatttctcagaggcaggaagcaggaagcaggaagcagccagcagcagtggccagagactgactaccactgccctctgttccgtgggtggtgtctgcttgctgattggtgcctgagtataaagggacctattattgctccatacaacagcagctgcatttcttagtttgcccagcacttaggtgcatttgtgtgtgttttgctgagggatggaaacttgtgataaatgggctttagcttgttgtgtggaattagcatactttaatccctttccagttgcagcttaaacaaggtagacgtgtaggggaaagtgctgagcagttttttgccattattcatgcacaaagtaaaacatggataccagcagtactccaagtgactcaacatttttaagcctgcgtacttgcacatatcatttctaaaatcctctgaggaatttggaaatgcattgaatttttatattttattcatgaggacctggaacgataataatgggaacacttacaataataacaacaatcttcttgtgaaaagtgattgccacgtagtaagtgctaaataaatggttatagttgtatgtatgagaacaaattcaaaattccacatttggggttaagtaatgatatgagcccttttcagaatcaaacctggctctgtcacttatagactaagtgacttaaattaaatctcagtttcctcatctgcaaaatggagacgaaactagtgtttagtctagaaatttgtgagattaaaatgagatggaatttataaagtactgtcatagtatttgggacagactacatgcccaatatttctaacattgtcatattattgctatcatatttctgaaagtgtattcttctacagaaaaaaaatcctgaaaaatgatgacagttccctggtgagataatttggggcaatgatacatacaacattccccatatggagattcacaatgcacatcagtatattaaatgatcacagcagcccttgcagaaaagaacacatttaactttaccatagtctttcataaactcatttgaccacagaccctttgcagaactaggttccacataacactctaggaaatgcctctccccaggcactgctttccctgttgctgcagttttttcgttttgttttgttttgtttttagatgaagtcttgctttgtcacccagactggagtacagtgacacaatctcgattcactgcaatcttctcctgtgttcaatcaattctcttgcctcagcctctcgagtagctgagattacaggcacctgccaccacgcatggctaatttttttttttgtacttttagtagagatggggtttcaccatgttggccaggctggtctcgaacgctaaccttgagtgatccacccgccttgacctcccaaagtgctgggattacaggtgtgagccattgcacccggtcccccttgctgcagttttgccctttgctcggtttctttccaagttttaaggtcaataacatggtagcatcacccagtgaagccatgcagaacaatcttattgttgtccagtgttcactttcattctatcaaaaggacattcctggagaactgctacttgcactatgaccccgaaactttcaactctaattctaatccaagagttagtgttttcaggatgttgtagaagtaatttaccataccttgatattcttttttcctctcctgaccccaaagtagactcaattcaggcttgagttatatgctttgaatatcacaaaatccatgtggtctgaaatattttttcagaaattacagtgatatgggaatagcacagagaaagtttatccagaatgcagaataggcagaaaggcttccatttacagagcactttcagttgtccaatgggccttccctccatttagaaacaaatccaatcatcagagtcttaaagtttcctatgttattgggaaaaagccacaagactgcagactagactaggtgggaatttccagggaagtctcttgttaaagtagccaattgggaggccattagactgaggcagctctggcgtcctgggttcctatgtaaccaaaccaaaacccaagtaaagagtaaacagtcatattctaggaaaacaaaacttaagcttaatcaattagaaaccactagctaatatctaatgagagactttctactagaattatccaaagaaggctattcctccattttaaccgatcaaatattttctttgcctagctttcaccttcaccccataaaagcctcatgccttttagggagccctaaatcaactgtggtctagtgctaactgattaatgaatcattgtttgcccaaataaactctttaacattttaatgtgtctcagtttgtcctttagtagctctaatgacaagtgaagcattgtttctgaatttaaactgagggtgaatcttcagtaatatccagtgacagggagttgaggtcacttagccaagtaatgacaaacatcagtaactccaagaccaaccatcatcataataaacagacaagaggagaagaatgacttatggttttctaaggttggaaggtgatgattcctggctactatgtgaaatattcctcaaagtgtagcttatggactacctgaatcagaattacttggagcacttgtgaaaatattgttagctaggcttcacttgaaaaaaaaacatgtatagtccaaaaaaaattagccaggcatggtggcaggcacctgtagtcccagctactcgggaggttgaggcaggagaatggcatgaacccgggaggtggagcttgcagtgagccaagatcgtgccactgtactccagcctaggcaacagagtgagactctgtctcaaaaaaaaaaaaaaatgtatagtctttgagagtaggtctccaaaatccatatatgtgacaaggtacccaggtaattattatgtataacagtttgagaataccgcatagcaggccccagatattctcactcataaaacttccagtcctgtctttagggcatgcctgacttttatattttctggatcactaaaacaaagcaaaaatacccccctacacacacaaatgttcccctttgctgttgatagtagctcaatctggtgatggctccagaagaaagtttgttaaactacctaaaagcatctcaagtctcccctaagtgagcagtcagcctcatgtagatatggattacattgctggctcaatcctctacccttctctgtgtctaaactttgtgcaatgagtttgaagcttgtctcacctaaaaggcaagaggtaaaatctgtttcttcatgtcttgaatctgagctattattataatctgcatctggcaatggaatgcaatggaagcaatggtgtgctaattgtgaatttcacggccttgcatacctctgctttttctcttggaatcctaccactgccatgtgtgagcaagaccagaacagtcaaaggatgaaaggccatgtagaggccaggttaattattccaaccaaagcatgctagagcagcctgcaggcagctgacccgtaacatgtgagacagaccagccaagatcagcagagctccccaaccaacaacccatagctgattgcagacagacaagtgaatgtagataagactagacgcataagcaaaaataaatgcttactattaagccactgaacttctaggtggtttgttacatagcaatagcttatttactttcctcaaaagtctctttcaactggttaaacattcaattaccaattattacctttgagctccacattagccaatttttggtatagtcttctatccccactctcagggtggcagggtaaaagtaagaagaccatacatattattttcaaagataagacactttaagaatgaaagggggcgctattaaagcttacgctgatatagcatagataacccaggacagtcctgatcactctaggtatcagaaacttggtgtctaaagggtagcttgtcctatgttctggcatcttgtctgtattttatatgtgttatccttcccctttgctttactttttttttttctttttgctaatttctcttgactatctgccttgccttcccctgggatactgcatttctgacgcatgtttgtgcccctgtttctgttcatctgactgttccttgctgaccattctctgaccaagagtttccagacatatcctctagcctggctaactcagtctagttaccctgtaatcatttcagccccttttacggtcccccgtaatctcagaaaaaaagaaatggtgaagaaagaatttattagaagctaggccaggcatggtggctcatgcctgcaatctcaatgctttgagaggctgaagtgggtgaatctcctgaggccaagagtttgagatcagcctgggcaacatagcaacaccctgtctctacagaaaataaaaatattaattggatgtggtggtgcgtgcctgtagtcctagctactcgagaggctgaggcagacagatcgcttgagcccaggtgttcaaggctgtagtgagctatgatgtgcccctgccctccagactggaaaacagaactagattctgtgtctaaacgaagccaacgagcaacctcattgctgcacgctggtaggtagatgaaaatatcacatttaatcatattgcggggagggatatatttagatatatatctacatgataaacccactattgtttataacaccataatgattaaataactatgaaaagccgctgggtctatgtatctgtgcaactacctaattacttgaagataaaaaatatatttattttggggaaaaataaaaggaagaaaacatatcggtaccaaggctttacttaaaaaagacttgtaaatgattactatgtagataatacggtgaccgaaaactaaagagacagataaacttactggctgtggaagaatttcaccagtactaatttcatccctaaatggaaaatgttattgcaacaatttacttcactttacagttcagagttccacaactcctatttggcatctgcatccataatgttgtggctgagattatattgtagtttctaaaacttcttgacgaacggtaattctcccttcaagtggaaagtctttttctcaatgtgaaattgtagtgcagaattcatgatgtatcacgacctaggtcgaaatttgaagtttcttattccctcccaaatttactcataacacatccagtggtagcaactgaagcctggaaatattaattctctaatatctctgtgataacatctttttattacacctgcaaaagaaattaaaccagtcagcagcagccatagaggccaagataacacaagataacagttttattaaaaaacccacacatacccttgacaaaggacagttttcctgaaccgagcagtttaaataaggcaactgatagacagacaggaggaggtagaagcaaagttcctgtgtattttttttggggggggtcatgtttttttatttaacctgaggtttgaggctcttcctttgataaatattaaccctttaccatttttataatgtgcgtttatccagaactccagacgaacagcgaccaaactggaaagcccagcgtagggcaacctctgaattctgaaatatgtacagacatatagtgaaatgtagctgtatcattttatgctcacactggcacatgaacagcatctagataatattatttgtttaactctcataaaactcaaggctgttcaattacatctgccattaagattccagttcacactttaatcatgtttcaactgcttcatggccacagctcttggctggcctttgccattcatctagattatggatttaatatgccccagattcaggggcatgtttcattttctcccccttcctcattgtcatttgcccattctgccaattaggttagctccaaatattccaagaaattagattttaatatttattactaatttcctcctgtacttaatatcacaggctctccttatttaattcatgcttctgttttagtggatggcttgagttgtaaatcagatttattactggagatagtcgttcacctttccttgttatgcagatggatttctgtctgtgaaaggctgttgaacagtggttgttaagaccagtgaagaggccaccgtcgtaagcatcattagcagaaacttgctaaaaatgaagattcctggggccgggcgcggtggctcatggctgtaatcccagcactttgggaggccaaggtgggcagatcacgaggtcaggagatcgagaccatcctggccaacacggtgaaaccccatctctactaaaaatacaaaaaattagccgggcgtggtggcaggtgcctgcggttccagctactccggaggctgaggcaggagaatggcgtgaacccaggaggcagagcttgcagtgagccgagatcacgccactgcactccagcctgggtgacagggcaagactccatctcaaaaaaaaaaaaaaaaaaaaaaaaaaaaaagaagattcctattcctggctccttgggattcttcactgtgtgtggtgaggcttagaaaatctctatctttataaagcttcctaagttaattgcaatgtaaagtcacgtttgagaacagctgctatttatagcagatatctcccaccctgagttggaaagagttttctaactatggggcagggtttcatgtatctcaaatgctttgagggaactagtcagctccagctcttttagttctttgagcagaagtcccaccatccaaattgcagttcatttgcccagtacataacttacgaagggcacataatccctaaagggttgttatttgctatttaggaggtatccatctagttaggcttttgccttctcaaataaaagtcagtgttgccccttgcttgccctctttttactttctattctcatggaaaccttacctattctgtcttagaagagtcaacaggttttcaagtcatttcccactccctccttctccccaccaaatataaggactaaatttactcatgaccaagggttctcatgagaacaaagatacagggtttgatagagcttgaaagatttaaatcggcaattaaggctttaacttatcacctgtcagcagattcccctcacctgatgatctgctatgagatggtaaattaaagctcatagttgaatgtatattctggtcctggtcttctcacctgagtttccattccatatttccagcttcctgatggggtttttcacttatatgtttgatgacatccaacccaacatgaaccaccaaatttatcgtctttgacgacgaaaaaaaaaaaaaaaaaaaacaagctccacctcccaggtctccatctcgactaaacaaattaccatatcttgccacttgccacttgagttgtaaacttgtgtgtaaatactttgttaaaaatagaaatgataatggagttttgcccaaacctattattaaaggaaaaaaccccaaaatccttctagcagcctttttttcattttccaaattcattataccttatcatctcaaatttgcattaataaaatttcttcactagcgcacaatggatgatggacaacaaagtttataatatactagcatattatttttcctgaattttatccctctccctttgctcattattttaccctcagtaaatatactaattatgaatatttgagggtatatatctagaagccccaatccatgtcagacaacacataattttatacataaaccatataattccacctttctgtgcctttgtgcaacctggcctctcaacctgcaatgcttatttgctctttttttggtgaattcctattcaaccttaaagactcagctttactgaatcttctgcatagaacattttttcattctcctcatttagaatttagtaaagtttcatgcaactagtatttgtgcctcaggtctagccagctcagtgtgagtgagggccctcactcatctcatatgccctgataaactataggtttaaaggaataatttcaaagtaaggcatagagtcatgtgaagaataagatgataaatctaaaaatggatcctgcccttgagtacatttcaagttactagggtcaatgagaaaactattggcactttagggatattttcttaacggctcaggtttgttcttccacaagtaactatatggatcaaatggtgtgcattagattcagggccttccagattcttgctagaaaaactctccctaaaatgacatcatagctgttttatgtttttgtttttgttttgagatggagtcttgctctgttgcccaggctggagtgcagtggcatgatctcagctcactgcaacctctgccttctgggttaaagtgaatcttgtgcctcagcctcccgagtagctggggctacaggtgcacgccaccatgcctggctaattattgtacttttgatagagatgggatttcaccgtgttggtcaggctggtcttgaactcctgacctcaggtgatccacccacctcatgctcccaaagtgctggtattacaggcatgagccagtgcacccagcccattatagctcttaagatacacgatacagaaggctagggcaaatgcatacacgagagatggggaggacaagggaggcatcacagaagatgtgaagaaggtttggctggtttgttaaggtgaggagtgtgcagtccaaggtacgtgaccatgagctatgccatgaagtgaagctgctctgacactgaaaccatgtcttccagtggccagagcaataaaatagggaccagtgattcagtctcttttggtaacagtcgcctgccagtcgttctcccattctctctcagatctctctttctgggacgtagaactccaggaaggataggcccagttttctttcaactgcccattccccacaatgtgtatataaacaattacaatgcatatttaaagaacacctgccataagaaaaaaaaatacaaagattccctagatgcttattgtgtaaatgaatgcaagtctccactgatgagttatttgataagaagaagcatgtcatggggacaggttcacaaatgaataaactgaataaactggatctgaaggttaactgcgggaatgggattttgaatatatctctgcaggctataaattatgcatataattattcataaaaacaatatttgttaagcacctgatatgtgcaagttatctgctaggtaaaatgatgaagatgatataaagatatatgaagaagctgatataaagacatgatgaactatatccaaaagaaattaaataggagtgattcaaaaggtgatggtcatgatcatcaacatcagacagataaagatctagaaatccatgtgatttcagacaaggggaagatgttgtccaggcaaatgtctctggaaagatgtcatgcaaatgttggcattgaactgagccttaaagtacaggtggacaaggagaaataggtgaagaagtggggagaaatattccaatctggaatatcatgagtagacgtacactttggtcaagacagcagtgcttccagtctaacactagcttgactgcattctattcccttttccaactctttgtattgtttttgcaacatcatagcctttgtttgctaaacatggatgccagctgccatcaggtactaaaagtcaaagggagccactcaggccatgaccctccctcaaccttctggataacatgtttctcattctcccttattctcatacaggttcaagtctctcctttccgcaaagagaatttcagaaacatacctgtcaggagtggttagacccttaagaaaaactgcatgaaaaccaagaaccacaggaatggctaggaacaaaacaaggactacattcaaaatttagctcagcttagataccacagttaatgaattcccaaatggaacgtgttggtgggtggggggcagacaccatccagtctctaatgacattcaggtatctgcaaatgctttccttgtgttcccataaaagcaaacagggaagtgaatctgaaaaccaaaataaggctagtaaattcttgaaaagagacagttctttttccttggagacaaaccaaattatgcatttgcttctctcaccaacaacatactctggctcaaacatttttaaaagaaggctgctgaacatctgctgagcaattaatgggatgcaacagcatgttgtaatggtccctgggaaggtattagcaatcctgcttatgagacatgaaatgttgctaacaatggttcttttttttttcttttaatttttattttcccctgcctacaggggggatgagagaaagagaaatagagttgatgtggaagttctacatctaatactcctccccactgtttctcttttttttttttttcaggcttccttctccttctcttcctagccacccaaatattaatgtgttaatttcaacctaataaaagcaattgtggtggctcatgcctgtaatcccagcactttgggaggctgaggcagacagatcacttgagctcaggagtttgagaccagcctgggcaacatggtgaaaccctgtctctaccaaaaacacaaagaaacttagccgggcatggtggcatgaatctggtcccagctacttgggaggctgagggcttgagcccagggggcagaggttgcagtgatccgagatcatgccacttcactccagcttgggtgactgggtgagaccccatctcaaaaaaaaaaaaaaaaagaaacaaaactgtggcaagtgtgtctcggcccaccgataccctaccaaagtgccaagttttccatgagtgaagggggaattccctccactgttttttgtatatgtagggtctaccaccctattcaaatattttttttctttttttcttttaatcaggtagctaaaggtaacgtaggagcaatcaccaacaggaaacagatccctcccatattttacttccttatcacaattgctgttcccgttgacacgtttgtcttttgcataagaaaatcgagccctgagtgactgtgctcctgtggacaccgccagctctaatgcgttatgaccagcatagccaaactcaatatagcaaaagtttccaaaactcagttattccatcagcccatgacattatctttgtttacttatcaaactggagctaattatccacatataaatctatatctactccagttgctgaactagccatgacagaaaacttaataatgccagttgatcaggcttggaattatatagccgaaagaccctactatcaaaactaacaggaaagatttctacaatggttggaagtcaaagaattttctcactctctccaaattggtccaggctaagattgggcttttatttggaaatggatatttttttctttggtgactttgtgttacacatacctatactgcaaggggttcttctttaaatctcagtgtgcatatctgggtccccaaaatatacctcccttttgccagcccttcttcccaggagtcttagtcctgcttccgaaactcctagttatagaaaaaactacaaacatgaattggaaacatttttcagttcttcccaactttgcattattttttgtcatctggagtttttaccagtgggattaacatatcatggttatcaggaattgacttcccttcccacatggagctataaatccaaggacctttggatgcctttgctgtattcagtttctctggccaagccagctggccaaaccagtctcagctaattacccactttttgatctcaatatttcagcttggtcccagctctaaactatttgtcattgaagaaagtttccttaagtaacatttaaaataaggtttccttttttttacataccacttctccctaaagttaaatacggttaacatatcaatcttttaaaattttttaaattcacacataacaattatacatattcatggggtacatagtgatgctgtgatacataagcatagtgatcagatctgggtaattaacatatccatcatttcaatcatttatcgtttctttgtggtgggaacattcattatcttccaaaatgatctgaaccatcattagagcataatgcaataatcagttaaataaaaaccagacacagatggaggagaagtatggaaggaagaaaaagagtgaaatgtgaatggcctccagaattgaagaatgggagaaatagggttagttccaggtctagcttgacctccagtgctctcctgttcaacagagcaaggtctccggactaaaaaaggcactgtgttcggatacaccaaacctaaagatagtgttcattcaaaggctgcttatgctataaaagcaaattttgcatcatgaaggatagacaagttggccacatcccttcaaacccagacttcagtatggaatatccggcttagttgtttttaatttctaaactcaaagggaacaagtagtggctgatgaagttcagtctgctacctaaacaggctccatggtctgattagatgaaataaatcagtgaatctttttaaaacgatattcagtggttactttctactcagttgacatttgtcagtggcttggctattaggatgactacaactcttgtttctggaatttgatcattctcccatacaactagtcatgtgtgactctgccatgtgctacccccattcaccaaacaccaaagctcaacattttgggtaggaaaaggccagtcaggaccatcaaatgccctgagataagttggcagtggcagccttttcttcagagaattttcaccagcatacgattcagaaagtggcttttaccagcaatagcagtttatgagggcagagactctgtcccctatgttgacaacattgcttggcccagcgtaggcaggcactcggtaaatatctgttcaatggatgtgttagggtgaaaagatgcagaataggagatgtgccctactcaatcctccttgctccttacactcatctttttcaaggaatgctctgaatcagtcacacttctgttcaaaggtcttgatggcttcccagacctttgatggcttactcactaaagtaagtacaaacggcacaccctggcatgtttccaccctccacacctccatactccatgctgaggaacagtgactttaaatagtgggattgaaaaaacaacaagagcaataaaatattctatgaaatccaataaagaaaaaagataaaatccaagaaggtaagaagtcagtggtcagcctgcttggccttccgctagacctagcagagcctcgtgaaatctccaggaaaccagagaatggtgcttgcaatagctactttttgtcctcatttactcagcatccccaaagccctttaggctttacttccttggtgctttggtgcttagaatgacctcttgcatttaatgctatccatactttaaggttcttcctcgaaaccacctactccatgaaacaatcctgtatcattttgacaggatataactcatacctgctttaaatttcctatacagctttagttgctaataataataacagtaaaaataaatattaaagctatgtttcagacactatcctaagtgcattacctgaattaatcttcacacaatcccactggcagagatgctattaccatctctgagacatacagaagttaaatgtctttcccaggattccatagtgagtaacaaagccaagattgaaaccaatgttctgactggaaaaaaaaatccaagtgcttaaatatgttacgtagtctctctctctataagcatttatgcagtttgctcactgactactctccactgccaattcttcccatcccacagtaccactgccattgctacaccgaacttccccacaccacaaccaggttataagttttgtgaagatgaagaccactttgcactggtgtttgtactccatggagcaccagcatggtactctgcaaaaataagtactcaataaatattgttaatttattattaatacatcacaacaatgtctgtttctaagtgcttgtattatcattgaaaactatcctaagctacttgtgttatcatctattctaagttacttgtattattattgaaaactctccataagcttagaaggaggatcccccatcctcaccaccaccttctcagttgaagagatggaagctcaatgacattaagtaaattgtaagatcatgaccaattccaggttcaattcctgggtgtggccctgtaccactcctaagttcctgctatctctactgcgttacattatcctgaaacgtaaagaaagaaaattctttgtaatatgaatatgttgaaaataagactttgcagaaagacccccacaaatgtatttgttaatgttattttcaggatttctgatgagataaataaagcatgcttccatgtgagacgtatataagcggtttgctgacagtttttgccagagactaagtataaaatattaccttctcactgggtcacccaggttggagtgcggtggcgtgatctcggctcactgtaacctctgcctcccgggttcaagcgattctcctgcctcagcctctcaagtagctgggactacaggcatgcaccaccctgcccagctgatttttgtatgtttagtacagatggggtttcaccacgttggtcagactgatctcaaacacctgacctcaagtgatccacccaccccagtctcccaaagtggtgggatcacaggcatgagccactgaacccagctgaaagtgtcacctttttctgttgtttaacggttctccattaaggcagaaacaccaagcaagggaacctccaagatccgatgactgatttgatttctgattagcattgttaccatctagcctttttatgaggaaggaagcacggactaggattccctttgccagagccaccagccagaaccccgggacatggacactgacccgctgttaagtgagcagcatggacaaggactcggactcctggcttcagctcgaagtgtactgagttttggttgagcgtgtggatcagcaattctgatatctgaaaaaagaagcatagttagtgacaccaaaagtgtcatactgattataaaccaataagcttagaaatatttactattttcaccaaggtatcacaatattatacccgtgagttatataaataaggtttatatgattttgatttaattccagaatatgcagatacaattatttttaagcatgacctgtctttacgtgctaattgcaacaaaatagaagaaactattagtgaatgaaaataattatactctttaaaaattattctgtatgatcttagaaaacttacccccagtcttttgagagaacatttgttatgcatgaggacttaaaagaagtatatacaatttacacattccgataagattaatatatattcattttacttccattctatttcccaaaccatgtgattttcacaaaacactttatgaatatttattgtatggtaaatatagttctgctaaaatatgcaattgaaacaaagtacagccacaacgtaagtaacaaattggctaacctttatttcatgcttataaatattatctaaactgttcctcaggctgacacacggataccgggcagacccatggaattctggactatgaaatatttaaccccaagcacggggcaaataacttcatttgggtagaaatagtgtaaggtaaggttttatggatgaggtaaaatggttcgtctgtttagagtagaaaacctagctccatttgctgtgtcctttataatgttgaggaatttctgaaaagttacggggataacaacactcctattatattattattattattattattattattattattattattatttgagatggagtcttgctctcttgccaggctggagtgcagtggcacaatctcagctcaccgcaacctccacctcctgggttcaagcgattctcctgcctcagcctcctgagtagttgggactacaggcgtaagccaacacacccagctattttttgtatttttagtagagatgggatttcaccatgttggccaggatggtcttgatctcttgaccttgtgatcagcccgcctcagcctcccgaagtgctaggattacaggcatgagccactgcgcccggcccactcctattacttttatctggtctgctagccttatttttaatattctaataatcacttaatattttacttaacatgttatttaagtctaattagatgctttctgaccatcattctgctaattaaattcttaatttttttttccttttctatttgttgagttttatttccttcagtgagttgccaaaataacgcctttaatccctttatttgttaagcagggcctgatggcttagtttggaaacagacagtcacctgcagaagcccctgattggtgacagaactgaactgccccacagataaacttctctcctgaacaacaggaacagaggatgaccatcactgcccagtcgttgagcacctgggatccagagcaagcccagcctttcaaatgctgtcatttagcaaacaatgcagaaaaacaagattgtcataaaactatgctgaaaacaaaaacaactttattctgtgtattaggctacttcttttcttgggtgctgggaatcaaccagaatgattcaggtttacagaagtggatttctggccgggcacagtggctcactttgggaggctgaggtgggtggatcacttcagttcaggagttcgagaccagcatggccaacatggtgaaatcccatctctactaaaactacaaaaaattagccaggcatggtggtgcacacctgtactcccagttacttgggaggctgaggccagaaaaatcacttgaacccagaaggcagacgttgcagtgagccaagatcatgccactgcactccagcctcagagacagagtaaaactctaattcaaaaaaaaaaagaggaggaggaggaggagaaggaaggggaggggaaggagaaggagaagtggagaagtggatttctaacacagattgcatacaatggttttcctctgtgttcttatcttttaattggcagagtctttataggaatcagacagtggagtttttagaggtctatcacaaaggttttagctatgaaatacacacacatacatgcacacacacagatacagaatttcagaaaaaatattttttattcaaatatgaaagacttggtcaaaagtaatgagggaattagcctgttttgccaaatttatcacatggactaaagggaactacatgtatttgtgggagaaagactccccactttcaaccaggtgaagccatatttctttctttctttctttctttttttttttttgagacagagttggagtcttgctcttgtcgcccaggctggagtgcaatggcgcgatctcggctcactgcaacctccgcctccctgattcaagtgattctcctgcctcaacctcctgagtagctgggattacaggcgcctgccaccacatccggctattttgttgtttgtttgtttgttttgtatttttagcagagacagtgtttcaccatgttggccaggctggtctcgaactcctgaccacaagtgatccacccgcctcagcctcccaaagtgctggaattacaggtgtgagccactgtgcctggccgcaatatttgtttcttatcactgagaatgttttctcttcaagtgagatataccaatagctaaaccagaaaatggagtttatcaaaataacatatttttaatttataatctccaggagagacccttgtgaaaataattaactacttggttttgttttggtttacaacattgtttcattggctctatctgtgtcacttacaaaattttaagaaggaaatttaaatttaaaaattatctggtaacagaaagtacgtttcatatatttaacttgcatcaaaggacattcaacaatgaacacatgctttgtgagaaaaaatttgcataagaaaacaaaactaaataaaatttacattgcatataagaataatctcaattagaaccatgtgcttttctactgaaatgagtatgaaactgttgacagattttgacaatattttagatgttttccacaccacttgtagaagtgtttatcctgtattttttcaaaagattacaagttgttacatatattctaaaggacattatatatgctgtgaacactattttggtaaagttgcttgcttcttactatcttttctagcagaacacatcttaggtgtcagtgctggcatcttcatggaaaggaacatggagcttaaaggaaataccaaagtttattcagttaatatttgaagagttgagactagactttggctttgtttgactcctaatcctagggtatctccattaaaaatattttccttgaacaagctgacaaagagagagacagcagaagagagttggagagacgtctggcaggataggtttataagatgagaaaatacagcacttatattaattatgctgccttctctcattcatctgtgaagcacccgaagttaaaacatcagccccaatgcccagtgaccaatatgggctacaggagtggggatttcctaacaccatcctcagaggggccactttctgttcaccagttgcataattgggtaatgtttgggagagtcttcggctatagaaaggagtagaataaactgcattctactggaaagtatggcaacagcctaaatgagaagaaaaacacttgcctgatagagactcaagtgaaatactgtgtgatttctaggagggagactgaacctgctaaagcaaattgaatttatttctttttctttttctgtctggtgaaaagcgtgttgtcttaacaaatttcatttatcctgtatacagtcatccctcttctgctgctttccagcacagtccattttctattccacatcagctaaacaatcacgccatagaaacaacacattattcttggtatctgcctatttggtggaatatgcctattattcaagtgcaacctacatttcatttaaagtcccacttaaaaggacagtggaggctcaattcgaattttaggaaagctatcatcaaaaggatgtcttgggagggacctgtgacagggaaaacaccaatgttcctcattgtcttcttcacacaagaggaagattgaatgcagcactcagaatcaactagatatggctgtgggcagggccttcaatcaagaaaggtcaattttttgctcacatgtcatatccatggcagctatgcagtggtgttgggctccctgtggtcacacagggacactggctggtggagcggccatcacaagcatttccattcattacatacagcacaagagggaaaaggagctagcaaaattctacaatgtgcatttgaatactttagcttggaagtggcacatatcacttctgctcccacagtcctgaggctctgccccagcagaatagactcatggtacagtcctatcatgtaccctgaaagcagtgggctggaaatatttagtcacacagtgatggttaccacacaaagaacacattcaacatccaaacaatttctaatgaaatcaagagggggaaacactatcagatgatcagaagtaaagtggcaattcttgaaacatgaaaaaataaaagttttaaggacagtagagtagtttataaattcatagaacacataacccaaataagtggtacaaggtaaaaatgcagatgcaaatgggcttagacaaatgtattaatggcaaagctacactgggctaaaatacgaatatttattctgaaggtggtaggatgaatgcaaatcttactgaacttaatagcattctagtgccatgtttaaagagggtgttgcctgggatgacctgggagctggctcagttggtcagtcttgattctgccacactattaaagtctcttcaagtagcagttgaggaatattccttttgtgttaaacagaggaagatctttcccaattcatacattttttgcattgaatgacagggaagcaatggagccaaatactaaattctaattaacagtagctcaatttcattccttcataacacacacacacacacacacacacacacacacacacacaaacacacacacaaatttagcctgattaaagtgcctaaggggtctcctggataatggttcatgaagacacaaatccgtcataaatatgtgtttcctttggatttcccatcacccactttaagcttctctctacctcctcctgacacatttgctctggtccacctcttacctcctccacttttggttatagttctcctacttcagtgaccttccttgtaaactccagagtatttttgtaatttgactccccaagttaaaaagatctggactgataagcaaaatgtgtggatatacagaaaatagagattattaattccatttcataataaatttctattttcttaaaactgtcaccctgctccctatcgagatctgcctttcctttcttccttaggtttcaggctctgcatctgccaaccgtgtagagtaataaaaacagccaaggaagaaatatatatatttttgtggttgacatttttttcacatcttttttgttctttttagatgttctaatgtcctttaaggatcctgaaagacaacacacctaggctccttatctccccagcacagcatcacaaacaatcacgatagagcatggcggtctttcctccctacaggagagacagaaacaaatttattcacccctgaggactccgaggggagcaaggaagtgggatgcttgaggggcagggcttgctccacatctaagcagctggcctcaggacagcagcacgcgctccccttgatgaggccagctcagggcacaagagccttttctcactcaccagagatcccaaataaaggctggtggaaccctcccagacagaggtcactcgattaacccagcccgcctcatcctgataacagggtcaagtacttctcactgtgaagaattttcaatttatttcacagacaagatagctcgatccaagccagcatcgctgctccccaggaaggctctcagaggaagctaaggaaggaggactgagagtcctttgctggggccctgccctcccattctttagggcacctctgtctaggatcccagttctttcactgcagggggatctgtactgcacctttacaagaaagggggccaaggcgtgaaatgaggggataaggacagcccttctcaagtttccgctgagatttagagtacagccttcaaaggagggggttcatttctgttctttgggtttgctttgcatttgtcttaaatttctgtataatttatgataccagaagtcagttgcgtttgcctcccagcattccctctcccttccccacattgttctttgaggaatccatgtccttgtctagtcttggtccatttggttcagggagggtataaaacgtctcagttgtcactgacagcacattatccccaagactgcagggactagctaagagatgaccactttaaacaggtcagacaagtgaaaactgtgaacctgcaactctcgctggtgcaatcaggtgagaggtaccgtctttggattgggttgataaactggctaaatagaagttggggatgcctgtggccattcttgctttcctatgtgttggcttcattctcaggccaacttcccatatggtagccaggaaaacagacggagagagaggaagagagggaagtaatttggtgatacttttgagtggttctgaattcatctatgcctcaactgtacctctggacttctcaattaaattaattcaaaaactccctttatttttacccataaagttaagtgattaagtcagagcagagaatgaaaggacccctcctggattgaaaactatgggtctccaggagactcccctgtctcacagggtctagacatgcaccttggtttaataagttgatttcaggtgcatttttccatcagggtaataatgttctccacaactaagacactaatttctgatgtgctctgtttggcatttgtaaagtcactgtgtctactttgctttgagtcctggaataggctgatacactggcattttccttaaacaaatttacagtctctagcttggtaccttactttcttttcatgctataaatctgcataactcgcatgagctcatgccattcagatacattccttccttattgtccttgtttttctccattttgagtaactgcattcattaatgttttttcccttattcccatcatcctctcttccaatacatgcccttgactataccagtctatttaataggcctaaactcatttttttcattttccacatctcttcttaccatataatgaacatgaatgtaaccattatctctatatctccagtgaacattttactcaaggccaagtactttgctatatcatttctttaatcctcccagacaccccatgagataagtgtgactttggctcaattattcaacttttcttgtcctcactttcctcatcggtaaaatggacataataaatatcagaggtgaaactagaaactggttgatatttacgtaaacctgtgttctaacaaaatagacagactcttctacatgtgtgccaattctaagtcacacagccttcaagcaagctagttagtttcagatctctgatgacatggttcaccaatgactgatacagtctgccttgagggccacactcagctctctgagaatgcctttgcaggaaacacccagaagagacagagaatgaagggaaacaagaagtctagagaaagcagacagtcaaagcaagacacatccatacataagtataagaagtttcacagaatggacccctcttctttccaaatttcccctcaaataatgatgtagaaaatacaacacttttagaaaaaaacatggaaagtgtgagaaataaaagtgcacagatgatgtggtaactaggaaaaaaaggtgactctaaatctgtaccctcttccatacttgaaaagattaaaatctggatttcatgaaaaaccagtaagatttagaggaggtacaactgcaaatgttcctatctaaaggctttggatagggatctgctttccctctgggttcttgacaatgttgtgataagaaataatctattctttctcccaccaaaatgcagtgcagataataatttgtagagtatgatgggaagctgaggtggggagtgaggttagatgcaaatctgaggagttacctgctgcccacccttcacctccacttcactaggaaatggggttcaacagggctttccatgagagctctgctcttcattacttgcacacagagaaaattatacaggggagccttctgccaagtgaaaaagtggcagctgaaaagaaggtgtgtgctaggaggtgggccatgccataatttggggttgtttttaataagactattatagaagtttctcaagtcatcctggaagactaaagatcatggggctagattatgggtttagtaaacagaaaatctccaagtactggaagggaaacagccaatatttacttagtggccgagaggaatcttatttttaatctatttacctggaagaactgataaatcaaaatcatttcgtttctaaaagtgcaactaggccaaggctgatcattttaactgaatggacaaagaaggataacaacaacataattatccccactacagagacaggagagtcttttaaagttaaaaggaggaaagggaagaaaaaagaagactaaaggggaaaagagaaagagaatcacacaaatacacacacagatatacacacacacacacacacacacacacacacacacacacacacacacactcaaatgctccagaaggtagtggagatgaggaggaggtgaaccccacagggcagtagagttgctcgggagctaatgttactcattacaaacacaaattagatcatcaaaggattagtcatttgtataaaagttgaacctgttaaaaaagatatgcatgtcatgtcatttgcttctcacggcattcttgtgacaagtatgatattgttcagcaacttgcttttttttccacttgatatcacggacaattttttgtgttggtatacatagattaatctaattcattgtaaactccacagagtattccacactgtaaataatttagccgttccctgctgatatggtttggctgtgctcccacccaaatctcattttgaactgcagttcccataatccccacttgccatgggaaggacccagtgggaggtaactgaatcatgggggcagttacctccatgttgttcccacgatagtgagttctcacaagatctgatggttttatatggggctttccctgcttcactctacacttctccttgctgccaccatgtgaagaaggacaggtttgcttccccttccgccatgattgtaagtttcctgaggcctccctagccatgctgaactgtaagtcaattaaaccccctttataaattacccagtcttgggtatgtctttattagcagtgtgagaacagactaatacacctaccatgaatgctcttgcatgtgcttttggtgaagctgtagttaggatcaccagtttatgggtcagaaatggaggcttagaaagttgaagactccacaaacggttgaagctgaaaacgtctccttttccaggggactcacctgctccaggtcatcagttgaccttttgttttctccagctggatcctgatagggtaggacaaagagttcagcagtggtgggtaagccagggagcaccgccaccaggatgtgctggcctggaacccctgtggcctgagggacagacacaggggctcacattagtgctgcagagaagaaagctgagaagggaccaagtatttggtggggggatcaggggtaggcagaagacaccacaaggggcctgaaagcagaggcctgggcatatcaggcagggagtatgtgagagacagcactgggctattaggtccaggctccggagtcaggctgtctgtgatttaatcccagcttcaacaccgtgagaccttaagctcattgcttgtgttctctatgcctacattcctttaaatagaagacaggacagttgcagtacttgccttgttcatggctgattttgaggattaaatgagttacacatgaagtatttacagtagggcctggggattcaaatgttagctctttttgctagagagcatctccaaggtggtgaccatgccagtgagaagaccttcactttatcatctgcccctcatgccttagccctttctaacctagcttcctccttcgtcagcccactggagttactcttcaaatagacccaccacatcctaaccacctaacctaagaggacatccccatatcacaaccctcaggaggcccctgttgacttttctgcagcatcagacctgatgaccagccctgttccctgaagcaccctgagccctccacttggccacactgactcttctgttaaaattacagatatcactcaaggacttcttgtttatcctagctcactgttctctctcttgagcttataccccagggtttcccctgaatcctctctctagatgcttctagaatcaatagctataatcccagcttctctctccagcagtccaattctgatcatgttccttgtccaaaatgcttgcaagaattcccaatgctaacaggattaaggacatattcaaggccttctgcaatatggtcccatgcttcctttccaaactaattacccacaactcttacgcttttgccaaatgggatgatgtacaatttctcaatatttcagctttttcctgcaaatgttcctgtgcatgttatctccaccagaatgtcttttctctgcctttgctatttatccttcatgagtcatcttaaagcttatttatttcattatttcccaattaggtgattatttgtttttgaactccactgtgctgcatttttttttgaagtagcaagaaattccaggtattaggtcctcacctaatgttataagttacttagcacaatcccaggtacttcctgggtgtattgtgctaagtaacttatattatttgatgtgacctccaacaacgttactattataagtaacttataatattattttaggcaacctccaacaacaaccctttgaagcaaatatgattacacctcactctgcagtgagaacatatcatatgctggggtcctcaggaagctgactctgagtttagcatgcaggatgtttactaagaagtgctcttgggaacaacacctatgggagcaaagggaaggaaacaaacatggacaagggaaaacttgagctgccatgtaggcccatgacaacttcaagagaccccgaggggagacagaatggcccttcagagttgtcttaaattgggctgagatggccaggactttacataactgcaccagcctgtcatcagacatgagccaccctaagaagtgacacgacttggaacccagctggtgaagactctgcccatagccctcccagaaaagacaataagtgtctccctgaacagagatctgggtggtgcatctcaatttccactccaggaaagatggtggctgtaggaagattagacagtggctcaaggccatctaggaagtgactgctgatgcttttgaagcctggtctgactgtgaagtctgtgttgggacccagtgctctgtacctcccttctccagacactgacaaacaacagctcctattacagcaaaccccacactgttttatgcccttactagactgtaaactcagagattgtgcctgaataatcttcattgtacacaaaaatgtttataatgacattcaattaaagatttcattgtgaaatgtcaatagcaaaagccattttgaggaagaaaaggcaaacaatttaatactaaattttgtttcataatgaatagcaagaaaactgcaaataagctgactctcagttgtacctctcatagggtttattagtgtacacttgccaatgtggtcccttgggacttaaaaaagtggccaagtgcaattactgatctcaaagtcagtgcaaattgctaggaaccaagctctgcatcaactgcttcttgggattgggtgactagggagccttgaaaactagaaggtattaataccaccaccaccactgctataaccctgccctgagggataatgagtcaatctgtttattctgcatattcctgattatgctacacagcaggctagaaatcctgatgagcagtaatttctagcctaatggacagctggtagaaaggtggaggtacagggcatctgatctctaagtaataagtgtgaagagaaatcagcctggaaggctggacattgctgagctagtgcttggttgatacatcacctgggggagttggacagatagaggacctatggggacacaggtccctagaatgctgcagatgagaagagatggacagtgggttcgttaaagagcataagtcatccttcttggacagcagaggacaaaaaccagttgttaccctagagacggatggctcagagtagaaaggcctattccttttagggttgtagtctggtagtcgtgcctcctggtggtgataatgtgtaaccaccaatcatgtcacagatgctgaaagccatagagacagaggtgggtggcattgctcagaggcacatgaagataccccttctttaccccagtattccatctatccctgtttctccttggaataaggaagaggatggccctagagtggagtggttaggaaaccacaaaaatcaagattcaaaccttgatggtttgactccagaatctgatctttaagtgcatgaccttggatgagtaacctaatatctctgagtttcatttcttcacctacagaatgggtagttctgaaatcacggtttcaacatcgtaagcttatttgggggattaaatgtgttaaaataatgcaaagcactcaaaagagtatctagaatattttaagtgctaaccaaatattaacaaaggtaatgaagacagggaagaccagctccttgcaagaggctggatgtaagatctgttttctgatcaggagttatctgaatgcctttatttcatcatctttttgtgtcctgtggcaccatgtgttggaagcaggaaagaatgttcagcaaacctaaactgattttcattctgagctaagaatatgccctgggagtggataactcacttctgattttccgcgtttgcacaataagctcaagctgccccatgagcggctatcccactcctctgctcactcatgaaagtagaataaggggccgacgcagtggctcacgcctgtaatcccaacactttgggaggccggggcagttgaatcacttgaggtcaggagttcgagaccagcctggccaacatggtgacacccgtctctacttaaaatacgaaaaaaatagctgggcgtggtggcaagcacctgtaatcccagctacttgggaggctaaggtgggagaatcgcttgaacccggaaggcagaggtagcagtgagatgagattgagtcactgcactccagcctgggtgacagagtgagactatatctcataaaagaaaaaaaaaaagtagaacaaggaggggaagatgtgcctaaaagaaggtgtcttctctaattgccagtgacatttgctcagggaaggataaaacacaaccaccttgttattctctgagaaaccttaggaagctttgtcaaatacacaaaagcccagacattggactcaggcccttaatttcaattttgcagctccatcctctattagatatgagagtttaggcaagttacttaacctctctaaacttcagttgcctcatctacaaagtgtggataataattcctttttggggctgttacagtacagaaatttctttaaaaaaatgaggaaatagaaatatgactaaccatcatatactgaatgctcactgcactgttatgctcacagttgcggaagttggaacctgggaccactcttactaattgtagtcagccgaggacacttacatgctgagttccttcactggcaggtacagtagctggttttataattcctaatggcctaattgtgaactctgctacagaaatgtggacaaaggagtttaggatgtacttgtcctccttctctaagcagaacaagagtcacaagaggcaaggaccccatgtttgtccgtggttccatagttgcatcccctttagggcctttgaggtctctgcatgtgtggggctcagctttgcagacatcaggccagaacttcccatgggctctagcttcttcctgctgggttagtttgtttgtttttgtacaaagctcccctttctgtgaaattcttcaaggacagagagaaaaggtacccgggcaagagaagaaactgtgtgcactcacttccaccagggattttttgatgactcgaccgatgtccctcctccactcagggatgtccgggttgtagtcatccaggtttggagaaaaggacaagcgaagagaccggaattcctctggggatataacagtagatggagtactataagtcaaatagtcctgtcaagaggtttgttagactttatattttatacaaaatggagggtccttccccttcacttaccatagggacctttttagaaggcaagccactaccctgtgaatatctcaccagccccttcttttctttttttgtttgttttaaggagcggagagtttaataggcaagaaagaaggtagaagaaagaaggaagaagctcccctgtatagagacagagggagggggctacaaagctgagagaggagaccacccccccagactacccctggccccccttccccccttctcctttcctctgtctccccctttcccccttttctccccctcccgcccccacccccgcagcgtgaccgataccatccagttatatgaggaggcagtgtctgatttgcatagggcttagggattggtttgaccaggcatgtcattcatgatatagacagggaaaaaactggccctctcaccctagccttttagtatgcaaatgcagggtgccatgttgttctacacacagagggatacgtgggggcagccatgttgccagtcacatgtgagggcaagggcaagaacagggcagggaattgccatgtttggttggacccagtttctaatggccagcatttgcataccaaaggttgccagcaggctctaagagcccgtagccccttattttctaaaccaaacccctaactttgttccatgcctatctttgcagcctttgcctattattcctagttctaggttctgcgctcctggatagtaaatgatctggagcaacctgaatgcatggtaggtttatgaccctgggcctctttgcacacaccgttcttctgcctagaacgccccattctccccactgtccatgcacaaaatattcaagctctagttgaagcactccctggctcactaccctcccccggctcactaccctcccccatcacattttaattttcttttttatggcactactctgttttgtacatactttttattattattataggattatggaataattattatgattagatatttataattatcactgtaatcattctattgctatcgtttgtttgcatggaagtttcatttaatggaattttatgttattcagggattttcttcattgtctctgtagcacctgagttagtttggttctccaggaagcaagatggtgattacacaggcaaggattatatgaggggaattctctgtgcgagaaagtgggcaggaagccacaggagtcatggagaactatcgaccaccgtgcatgcatataggacagtcaaagagaggaagaaagagtgggtgactactctgcagtctgaggaaggttcagtaagcctgttcaggagtcttggagccaaagtcgctggcagaggagtcccctgcgttccaggaatggttcagccttagtatccctgctatactctgtcattggcagggtaagtccctggaaggtggagccctagccctagcttggtgataagcttcagagcacagcactggtggccttggtcagttacactctctggagttggaggtctgtgaagcccattcttgtggcttcaacactccttacccagcatagtgtttggcacataatagactcagatcatatggctcccctaaaacctgccagtgcctccacattgcatttagtataaaatttagattcttaccacagccttcctggccctacataacctggtggggacttcctttgtcctgtcctacctggctttcctgccctctctgtgctccaggacctgtacttccctgtgctcctcaatcctgctggctctgtccataccagctctctccacttcactggactgtagcaaactcccctctcatcattcagtctcaccccgagaggcctttccaaccacccaacctcaggtagcctcccttccaccatcccatgcacccttcatcactggaccctttgtctctttttcacactcagcgctatttaaattattttgttttcattgatatgtccttcaaactggaatataacctcaatcaggatgatggctctgtgttcctggcccttgtctagcacacagtaggttttcagttactatctatgagtcatttataattaataaacatttgttgaataaatgtatgcttaacttatggtgtagccttctcgaaatttatgcatttatttatttaataaacattttttatgttaagcatgcccttttgtttcattagggtccaagcgacattggggatgccaatttacattcaggaagcacaaaagttcacttgtacatttcctaacaatgctaaggagttatcaaacacatgtttcgaagactctgactttataaggtatgttttcgtggcagttaatatattccaaagaggtattgttcaaagcttgactattttatgagtcactggtcacctatgtgaatattacctgatggggaacaatgaaatgcacgttaactaaatagtgtggtaaacagcagtgccaaagaatcacccattaagtcctcacttcttgctatgaagatttaagtttatgtcattctcactttctccgtacctcttaccaaactgcagagacttcatccacaagggagaatgtttatcttagtaaaaggacacaaatgagaaaatgatgcagctccctccgtaattacttagcatactaaccagcatggcagggaggcagaatggcagggaaacgtacttaagttgattcaagaaataggggatgcgtgtgggcggactgaaaagggtaaacaccaataatataatattttttgcagctgttgagagagataaagtctatacacttgcgtatttttatttacaagcaaacttgtgccctggagcaaattagaagaaacaatgcaaactagattttctttcttttaattgattgtgtggctttgagtagacaaaccttcccctgtcaatttcccaaatgtgatgcttttttcagtcccatcatgacaataggacttcatgttcccatcaatctcactaaatttcaaacaagtttctgtttcttcctgactgtaagctcctggacttgcttttcttagagtattctggaaaacttacaattgtaaattccttctctgtcccttgagatgtaaaacttctacaactcatgaatgtctttctcaaggacctgggagccattcctttgaaatgtaatcatcaagaaagatagcacccctccctatctcccagtctctgcgggagagtaggagactgacttccctaagcagtgattaactcacacagatggtctaatcacactggaaacccacgtgcttcctaaagttctccagtattttcccactagctaaccccagcgtttacaaatcttcctgctttttctttcagctgggttcaatctttcctgtttaactttgcctgctccaacttttgtttaaggagtcacacctgtcattaaaactgtctgatcatggaaccaggtgtggttactcatgcctgtaatctcagtactttgggaggctgaggagggaggatcgcttgaggccaggagtctgagaccagcctgggcaacatagggagaccccataactttccgattatgtatatgaatctctggataactcaactgaccaaagacaaattaagggtggccgatggtgcaggaatttggttagaagaggaggagaaccttgccaaatctcttaacgaagagacatatgataacctatttttataaagagtgattcacccttgggtgatacctgtaaagaaattgtagaaagaggaagaagcaagcatagcaaggcatgggaggtgcttacaaacataccctctggattcagaattcttagctcgtttattatacttgtctcatgttttctcatccgtaaaatgcataattatagaatatttctcataaatctgagcagatttaataaagcagatcaaaccaaatgcttagaacagatgccagtggctagcaaagtcttcatcaatgtcaattactatcaccaccaccatcgttatgatcatatttgtcaccaatcagcagaatgactttaagccagtaattccctatgtctgggccataatttcctatctataaaatgatgggctggaccagataaggccaagatttaaggttttcttcatgattctaatgacatcaccaacatgcataaccaagaggacatctgttgggctaataggtcagtgcccattagtgcaacctgtgacatccaagagggagagaaaggaaaaaaaaatccagtgaaaataaatgagaatcagttaagtaggatagtttcagtgcatgggccctgagtctagatgggttgggttgcaaacccagctgcaccacttgctagctggggcaagttattcatcactctgaaaaaaatggggatcataatatcacctgctttacactagggttgttatgaagaataaatgcattcccagcacccagaaaggagatggagaagggaagagaggcagactttgccgcactctatacacagccactgtttggccacctcgtaccttgctaatgggacattggtaggaaaatcacagccctggtttatttcttattatctgggctgatcaagcctttcaggaggaagggagagagaagaaattataaaatctaacacccagccatgaaaggaatagtgtccttaaggccttttgatccttagatgtgttcaaagttgcttacaaattattttctgattttgaaggtcaagttggcaagatgagcattaacagaacctgactcctcacaggaaaatccagccccaaattatctcatcaaaatcaactgataagggaactgggcaattgacattatttggaccacgagctaggctgtctgtctctctcttgctctttcttttttttttttttctttcgagatggagtttctctcttgttgcccaggcaagagtgcaatggcgcgatcttggttcagtgcagcctctgcctcctgggttcaagcgattctcctgcctcagcctcctgagtagctgggattacaggcatgttccaccatgcctggctaaattttatatttttagtagagatggggtttcaccatgttggtcaggctggtctcgaactcctgacctcaggtgacccacccgcctcggcctcccagtgctgcgattacagaagtgagccgccgcacccagcctctcttgctctctttctcatcctccttccttcctccctccttctgcctcctcctctctctgcacagcatttccttctcctatctaatttccacttcttatatttcaaaagctaatttttcaggattcatatgtaccatttccatattaataataaacatttttgccatgtactagtaacacttagtgcatatccatatgactatctttctatgcagaaaaagatttaccaaaatgaaatcaatccatcaagtattttttttatttccagttttcaatcaatgactccatcttttcatttcagtacacattcattccatctaatcctgtgaccatattcaatttccccaactgatcacaaaattagccatttgttcaaatatcccgtctatggctatgtacgacatctaattgttatgacccttccatcactctcaatctagcagataattttttttatgatacagatttgtggaagaggtttttaaagtatttagacaatggcagatttcccttattagtcaagaattttaaagttgaacttaaaaaaaagagattcaacattagctattttattttgtaactggtattcaaatattactaacaatctaagtgaaatgagttagccttacacatcctaaaatccactttacactatgagtgagtgaatagtcactctacctctaagaaaaccctttctggatcccgtgacgctgttttaccagtgattcaaatttccctacaggagaagatgagactcgcctcagctctttctcaactactgccctccgttctccaggtaaaagtcacagctgggggatggtctctggcatcatggcacaagagaacctcctctgagcatgaagacagcagtagatccactgagatgggcactcaccatatactgcgatggtctttgtgtcttgtaggatggcattcccagctgagacctgcactgtgatggtattcattccttctgaagtaaatctgaaggatatgcttccctccaaggtgatcaaaggctaaaataaacaagggcccagagtgaagggaaagctctttagttacaggtgacacagccactaactgtgagccaacaataggctgtctaacccagcagaggctcttcctgatgtaccacaatggcactgagtccctctatgcctccctatcatctcaagcccaaagcagaaaagaggctattggagcaatgactccaagcaagtctgcctattcattgtgaattcctgatatcatcctgattcagggctggggagatggataggtcttgcttgctggtggaatgtatgtctctctttatgcatgacctactcatatcaagcagatccctaatacaaggaaatgatcaaagcaaatgagaacgggggctcatattaatccagatggaagcagcagtcactgaaaatctataagctgccatgtgttcatctccagggtgtacgatttctgtagaattacaatggaacatgaatccggtacaccaaaaccatacactagttaaacagcagtggccttgtgtgctggcccgctttgagaagcctcatcagcagtttcctggaagtagctgctgtggaaacaagcactaattggatagtggtttgaggattcaaaacagaaaaaaaagaaaaaaaaatttggcgtggtgcctgcaatacaatcgactgctagggtcctagaggaaaaaatattagcctactgacctcccttgacacactcctcacaaacatttatttcccatcttttcttaattaatttaaaaatcaaaattcatttaattccctgtatggcagaaagaagactaacgcccagcatgagaagccttttcaatggggtctcttgagaatctggttttcttttaaaaggaaaaataaaaaaaataaaaaacaatagggggtacaaaaggaagttgttcagtacattcaccttttagtactagttttcagggaaatgacatagattcctgctcttccgctatggatagagggcccactatgggctgagttcacacacatagtttcaggtgaaattaaaaagggtctcttttcagtttagttatggttgcagtagaggtgagaggttctttccactgtttaggtttgtcctgggcctgtgcaaaattatatctccagctaaagccaagtttcagctccagagcagaaaaatgtttttattaaaataagagacatcgtatttgaagagcaaagtcaccaagtgaaagcagctctgatggaagaagatggagtgtttcagtccagagcagttcatcccagtgtcctttggggcctcagctctattgcctaacttacatttggaagcactttaatttctgagaatggaatgagttcaaaactgaaatagaccatgcagcctggtgtagaggaaagaaacattagtggaggcatcagaaggccttaaatttggcctcttatgaagcagctggaagagatcaaagcaaaccactccagctgcaccaccctcacttttctcatgtgcaaaatgaaagacttagagtaaacaaggtgttaggtctctactagatttaaaattgccactgacttttgagcatagggaatatttggaaaaacatataaaagttaaagctgacctaaataaataagagttttgatttagggtaagaaggccattgggggtgggttgtaatggaaatctattgcttgcgcctgtccagttgcatccagttgcttcgttttcttttggtaatcacttctccccttctgtagttcacgtggttccgaggagactgacttcttcacctccctctctacccccagcactgtgatcaaggcctggccagtaagactcaatttcaggactgttgttagaactttcaggaaatagagtttaatttctctgctaagctagggctgctaagagtcactacaaagacaagtacagctggagaaaaacgtaaacatagaggaaggcagagatgaaatgcagaaggtggagaggggccagagagagagagagagagaacataatgatgagatacttgagcaccaagggagcttgttgtccttgaagctacaactgcttctacactctagggttcataagccatttcattccctcctttgcttcaggcagcgtgaattgagcttctgtccctagatcgcatgtggaaggtgaacccacctccgtgttgtttccgtaccaccacacgtaagtgagggtgcccacttggctgggccacagcactgccgtcgcattgacctctttgttctttgtggtgacaaagggaagagacaggtgcacgtgctccaagggacctgaggcacaagagaaagagaggccatggatggggaagagcttcctctgctctgtcctccctgctctgaagagatcacacatttactcttgaagcccccaaaacctggctgccatattccccaaaagaagtgttcagatgctttccccactttggagaaagaatacattgagcacaattgcatcttgacattttgcacttaccaatctttctaccagttctaacacctgagttaggtgtgtgtaaaagttaaaaaaaaattacaggtaacttatgaagtccttaagaacaggcatcatttgggatttcacaaggcaatgcagtctttccaagaggttgtatccctggtggtgaaccagagtcatgaagacctcatagaatccatattgatgaagggtgaatggacaaatcttcaaaccactctctatgtcattaccctttattatttattgggttttaaaggtctgtgtatgtgtgaatgtgttcgtgcatgtgtctgcaaagctgtctagttaggtaagcatggcacacacactgtgtttggggttgaattaagttaattcaggacagaggtgtgtgtgtaagtagatagagagctctgtggttctcagaagatgctcacctaaaatatagaatgattttatctacagaggcctataaaaactggaaaccttaattagatgtaccaacctcacaaagatatgaatgccctcttcataaagaaccactaggacctttccttcaaccctcaatcttctctttgagtcactgtttccaggcaaaatgcagcttcctatgcatttgccatccccatctttgtcccatgaggtagaggagagagcaataccttgggtctattcacctggtttattacctcctcttctgcttgccctgtaaatgtgtttcccagagtcctgtgttgagactttttcactctctacagacttttctactaggcaacaccatccacaccttaaccttcaaatatcaaatgcatgtgaagggctctaacacccctttctgggctctagactccttctgggggggtctagacttctttgcctccagcaatcaaatgttctcaaggaccctgttatttccctctcctgtattctctacagtttggtgattaacactcatattcatccaggagcccactccagaaacagaaagtcaatttcaatttcttttttgttattcacatccatttaggaaactgacgatttggtttcataaatctctctaagatatttagctcaccctccctaatctggcgccctggttcatactctaagcacgttctcacttatcttccagattttcctgcctgtaacctttcaccacccgaatccatcctccaaatggctgcaacagtaatttttctagaaagcgaagctgatcatgttactcatacttgttcaaaattaagattcccgtgattgggaatgtgatgtggtgtggtggctcatgcctgtaatcccgacacttttggaggccgagttgggtggatcatgaggtcaagagatcgaaaccatcctggccaacatggtgaaaccccatctctactataaatgcaaaaattagctgggcatggtggcatgcacctgtagtcccagctactcaggaggctgaggcaggagaattgcttgaatccgggaagcagaggttacggtgagccaagatcacaccactgcactccagcctggtgacagagcaagattccatctcgaaaaaaaaaaaaaaaaaaaaaaaagattcccatgatccaattatgataataatgatagctaacacacattgatttaaaatttgtgagacagaagacagaggctgaaaacttcttgagggtaagaattcttcatatttatcttcatacacaaagactagcagagtttctaagacattatagatgctcaagtattcactgggtaaaacaaatgatataacttcccatgtccgtctttgtgcatgctactccctctttagagaatgaaaagtctggtgatcagcatacagaatcaaactgatcttctggcctataaagcatatgttgagaagcagttgattataagccagagcagttcaatgaaataataaaagggtaacatttactgagcgatgactacaactaaatgttctgctaacgactctgtttttcttattttatcctcacaaaacaatcttatgaagtaggcactaatatcctccccgtttagagatgaacaaagtaacgtgactttccccaggtcatacagctaggaaagcagtttggtttcagagcccttgttctgagcagatggaagtgtttgaaagaacctttccagtcaaacaaaatagctattaagagttgctgcctcctcatcaggtaaatatgtcccaggcattggaaaatgcactttccacctggtttcatttattgcacaagtcttgccatttccctatcaaatggtttgttccagcaagccatgtcctggtccaccccagggcctttgcttctacacacctttcttatggcacctgtcagtcttcaaatctcagttccagcatcccctcctctgtgacattcttcctgagtccctcaatctgcgttaaatgaatacattagaatacaatgactagataaactatgctagaaatgctagttccattctaaagaggttcattttgtctctcatatgtgagctttttttttttttttttgagacagagtctcactctgtcgctcaggctggagtgcagcggcacgatctcggagcattgcaacctctgcctcccaggttcaagcaatcctcctgcctcagtctcccgagtagctagctgggactacagacacacaccaccatgcctggctaatttttgatttttagtagagacagggtttcaccatgttggccaggctggtctcgaactcctgaccttgtgatccgcccgcctcggcctcccaaagtgttgggattacaggcgtgagccaccacgcccggctgagcattttttaaaagtcataaaccagcgtaagaacaatgcctatatgtcattgtctcaatgaaaaattcgaatcttgttagtaaaacatggtaattcattcactcagtttttttatttttatttatttttttattttttgagacagagtctccctctgctgcccaggctggagtgcagtggcatgatctcagctcactgcaacctccacctctcgggttcaagcagttctcctgccccagcatcccaagtagttgggattacaggggcgtgccaccaaatctggctaattttcgacatccggctaatttttgtatttttagtaggtacggactttcaccatgttggccaggctggtctcgaactcctgacctcaagtgatccacccacctcggcccccccaaagtgctgggactacaggcgtgagtcactgcgcccaaccctcactcaatagtttttgagtcctgtgatctgttgggtattattctaggtgctggggatacctggcatttggtggagcttaggtatttctgaggaaggagggtgctgaatgcataaagcagaagtcggtgacagagtgctatttttgaaagtgtgatgatggaagacctctcagaagaaatggcatttgagcagcaacctgaataaagtgaaagacagcaccaagtatcaattttgaaagctccagggtgagggtagagtaagtgaaaagaccacgaggaagagggatgcctgccatgtttgagaaattgtcttattattttttcatttattttcacataatcacgttttggtcaatgacgattttttttttttttttttttttttttttttttgagacggagtttcgctctgtcacccagactggagtgcagtggcacgatcttggcttgttgcaacctctgcctcctgggttcaagtgatacccctgcttcatcctcatgagtagctgggattacaggcgcctgctatcatgcccagctaatttctgtatttttagtagagacagggtttcaccatgttggccaggctggtctcgaatttccaatctcaggtgatctgcctgactcagcctcccaaagtgctgggattacaggcatgagccaccatgccgggccaatgatgaattttctaagagaaattcaagacacatagtacgttggccttgtaggccctgaaatacatatgtgtttgtataagttcacgcatacatgcatatacattatatatgcatacacatattaaatttatctttcagatttccacagcctcttttattcatttacttttcacgggtttaaaatacctggttcctgctatccaaaagcctattctttgaccatctctgttaatcacagagggtgcagtatgccctatggagccacagaggtgaaactccagaccctggaggcccccagctggctggctgcgttaagtaggatgctgaactggcagatgcggctccatcagacaggtgcctgcaatgcacaaaagggacagtaggtggcgctgcatcattccatatgaatcttcctggaaaggtggttgagagaaatggggaattgtgtgaactgggtttcccctctcttttcttgtttatagccctcctgtgctgcaggaaacaactgacgcccgtgaggctgcacattgtgtgattctgtgtgtgtgtgtgtgtgtgtgtgtgtgtgtgtgtgtgtgtgtgtgtacactggctgctctggcctgcctgcagcatttatgatgtggagacctttggccacctaaatattgtgcacatatcatattgctatttgtctgcaatgtttaaaaaagctactagaagaaataagaatgattcaaactattaagctgagatcctaaaacagagtttctcaaatttcactgtacgttaaaatcatactaatctcttcaaagcagattatgatgccatacttccaggaatcctaattcagtgggtctgggataagacccagaacaccacatttttatcatttaatttgggggcaggtggctcattaagccacactttacaaaattctagtctgacgtttgctggtcaataaaatgatggtgtgaatggtcgaaaaactacgtgggttttcaagctacacagatcattttactctaagatggggccagaaagtcatctgcacatggctcctatataagggaacagataagggaagcagtttaggaaggactacaagatccaccttatcttttttttgtccccaatttctgttctgcaagtttgcagtcttcagtgatttttttttttctgcaagactggctgcgacaaggcagctttctgagcagaaatctgcatgctctctaaaacctctgccccatccgactgaaggcaacactggctgcagcacgtgtctcattagtttgcaaactagcagagcacagtgaatactatccccaaggaattaccaactgtcaggctacaggagattaccaggcgcccagcaagaccggcccactcccagaaacactatgcaggaacatcggctccatttgtttcagatgacctttgcaaacccatctttttttttcaaaccctctggtttggaatcaaatcacttttctgcactggagagtggtcggaatgtgtatgtgagacaggcaatgggctttcaagattgcccctgagggtaggaactggggaggggcagaggacaggcttggtgagctaagagttgctgctaattctcctcttcctcatgatagaaaaatcaagttttactaggtgccagggtaccatatattttgcttgatgggacttttgggaacgagatgtgcatctacttgacagaggagaaaatcaaggctcagagagatggagtgacttccccaggagtttgaaccaaaatctggacctagtcagaatgcccgactcagtccagtgcttttctttcccctataaagccacctctcactgccatatcatggcactttggcatccacagtcactcatgacaccctccatctttaagatgcctgagagtgtgactcggttatgttcttgttctgacttgctttgagcataaagtgatgccagagtcacagtgcttctccaatccttgatttctccatctgaaagaaaaggccagaagtctgttatggtatagatgtgaagatgagcaaaaagagtttgtgggcatagcaaagcaccctggatctttaggagggaggcactaaccaaacatgtcagaatctgctgaaacagttatatgagtttatatgtatgtgagttagcaaacagcttcaaacatgaacttgcttttaacacagttagtaccaaaaagccaggcttagaaagaagttccattatatgaggcatgcttatccaaccacttaacccaagatgagtctacaaaattaaaatcagaacacgaaacattccattacaaattatcttcctctaaggttaaggtcaaatatttggtccaatcaactaggctaatgaaatgaaagaattgcaaatgaatgaagaaactggtttcttttagaagggtttccgcagcccttaatcttaagcagagacaatctctgtgtgtgttgttttcctctccaggatttcgttaactagggaggagttttgcaggggagcagtagacacctcaaggggtatgatcacacacacaggaatgagaaaaaaacctacagagtgacaaggaggtgaagctatggaagatttaatgggagaccctgaaaaatttagatcagaagctgatactggcttttaaatcagtatttacatgtgattggactacggtagatgtataacaaatttgtggtatatggaacacaattataatttgtaaggaagctagctctctagcaaaatcaccccttatagaataagctatgagataataatatggtctaggtaggagccattcttggcaaatgtgctgtcatttttattgcaagttatttttgctactaatcattaatgtttgtgacgtattgttaaagattttagtatgatcatttctatgataccattgctatcatttccctacatactaacatatagggaggtgttatgtcttagtaagtggaaagtcctgaaagtctatataggacgagttagggatggcagttagatggacaggagcccccgtgatgagtactgaactatgtagttgtgtaacaagcacactgcttctaaccaaaatgtttatgtttcttcaagatgatctgtaaagagtagggagtagatagtaaaagctaatggagacagctcctccaatcccaagccgctcttggcactgacactgaccttagttatcaagagctaggatccttgcggcaggtggacctgagtctgaagcatggttctgctaggtagtaggtgggccacttcaaacaagtaacttaagctctctgaacctcaacactttttgtaaatagggttactaatagtgcctacttcaagggactgttttgagaagtgagataacatatattaagagcctgtttagcacaaagtctggaacacactgtaaactatagccaaaaataggcagattgagttggcatactgagaatcatgtgtaactttgtcagacccaaataaaggagtgcatgtttctttgaagcacctctgccatgagagtacaggagacagagatcagaattactgacatgttaggaagactcaacaaccaaaacacctttttgtcatcccctaatagtcttgccctctcactggaccacagcagctaaaaaagaaaatgttctaattgatactttctgtattcaattttgttccatgggcaaggtgcagaggagaggcatggagtaataatggctggccttgaggctcttggactaaaacttgatatttgaacaagaccattcatataaaggagctgctttcatttaaaggaaacaatttctttagtaaccaacacaagtcctatgactgggaaaccccttacacctaacatgttaatgacacatgttttaagcacacataacttagaagttattattgtctcatcatacttactcacatctttagaatccccaatgagggaaaagctttagcatttcttggaactgtttcctaccacagtttccttaacactgtttttatactctttctctctacaccaccttctctctaacaccaagtcatccacagatagaagcccaggaaaaaggagcaaaaccctaaaaggattattaatagcaacatattatgagaagacagaaataatcagatggggagaaatttctttacttgggctaattctcaatgcattagattgagtggtgcatgtggattgttttcaacaatttctgaccccagcaaaaccaaatttctttgtttcaaccaaatagctctgcaagttacttaggctcagcctccagattcaagtgtcatatcttcaaggcacccggggtaagcagaggaaatgcaatgagaatttgaagcaatccagagagtccaggattaatcaaattctactctttgattttcttctcactctttccttattttggtctcttaatcatttcttccccattccccttctgctaaaagataactagtgtacttcttctagatataaaattgtgaattcaatttgaaaaggacacaatatttaagataggtcataaaccaacaacagtaataacatacaagttacatgtaagtacaggacggcgctgtcagaacccagactgttgtccacctgcacggtcacacggaaaatgcccacgttctgatagacgtgtttgatcccatcttccatggagctgagattgacgtaagacaccgcgataccatcgccaaagtccacttggatgagtgtccgctgaacatcaccctgaaaaacaacccaacatcagaggaaatgagttagtattcggctgctcctgcctaggggactggggactacggcttgtcctagtccctggctcaggcatgatggcagccctggctcactcctacagctaggagcatctgcctgcctttgacagaatccctgtgacattccctggcaggcaagagtttgctacgatggatacactccaaatctgaaggacaccaactactgtaagtttcaggggtttgaaaattaatagtgcttgattatcagctgcaatgtgatattcaattcctccaaaggctttggtaatagtcttagcatccacaaggataaaaggtgtacacacacaactttaaaaatttagcttacctgggtcaggcacagtggctcatgcctgtaatcccagcactttgggaggctgaggcaggcagatcacaaggtcaagagatcaagaccatcctggccaacatggtgaaaccccgtctctactaaaaatacaaaaattagctgggcgtggtggcgcacgcctatagtcccagctactcgggggggctgaggcgggagaattgcttgaatctggcaggcagaggttgcagtgtgccaagatcatgccactgcactccagcctgatgatggagtgagactccgtctcagaaacaaagaaacaaacaaacaaaaacccaaaaattttagcctacctgactgacatggtaatggaccactccacttcctgtgtcttcaagaccacccctcaacctgaatacccctcgttatttcttgttccctaattgtatcataggaaggacggaagacactttgcctgatatctgataggacactgtacgcagccctattattatctgagataataatggttaattcttttatgctttagcatttcaagctatcaaaatgatctcatgttattcttcacagattcttagtctagtctggagagaggagtaggcaatcttctcccactttacagaggaagaagatgaagtcaaaaaagatgtcatcacttgttcaaggttaacacagctagtaagtggcggtcctggtattctaactcacctttctgcacttccaggtcattcattatagagagaatatagcactgtaggtaatcaaggctcccctggcatgaattctcatgtgccattaacaagctggaagacttcatgcaagtcattcagtctcctgcagtctcagtgacaaatctatgaactgggtataataataccttcctgtcttaaagagttgtaaaaactatgcagtaaattaattacagattaattagtcatctgtaaaacgctacataaaaatgactataaatcaatgtagctataaaagacctacaattgtccctttaaagcttaattgaaattgtaggattccaaatttcccatgggtaggcagaagaagatacattctgcattataaaatcccagacctgtaaaaaaaaaaaagaaatggcctttggaacaacagtttagattcttaaggaaaaaaagttgctcagaccccattgacaaaaaccagcttccttcacacacagtccatcctttaacaaattttgttgttgttgttagcctttcccactttcaggaaagaaaaaaacaaaaacctttgaactagaaatgtattttcgattaagtaaggttcatatggtatcatattttttgaaaaggccaagtttaaaatgttgacatttaaaagattaattcacagggaaaaagaaaagcagttcaaatcctatgaatctgtgtgacctactcctctgctctatgcccagccaagcattgtgtgtggggctcacagcagcagactcaataagtacataggcacaaattctcccctagggtaaacagagaaattccattcaaaactacaaaataaatatccaaagcccagacattgtgcacttacttgaattcccttcactaataaatataaatgtcaactattcttgctgacgtgtccttcatttaaacaaccaaagtggactgatcaacttctcattctgtttccagttagtttccacccctagttttcaacagagttgctgggaagccagccctaggtgtgggcaaggggaaagagcccacttttgaagcaagtatctgagggaaatagcaagggtatctggggttatccatggaataaaacaaggaatgcagtttccactagagaggggggaggacatgacggaagagggagacagacaagtttaaagtactttgtggtgacagagtgagcatcaggcaggggccatcatttgctaaaggacagaggggagattcacaccttcagtcaactctacttcagcctccattgagagacagcagacactcacacagctgggaagaatacaactttggctgccattgcttgagtctaccttgccttgccctttctgtctggtcttcatcacttccattttgttgtcctggatcaagaccagttacataaaaaccctccaatttctatctctcttgatgtctactgtctgtcttgctgggttttgtttcatgataggattcttcattgtccattcatggaatgctctctgtgtatataatgggtgaaaggatggagctactcaatgtttggactagggcattagtaaggtttccatttcagagtcaggttattagggtgttaggtcaggtattttatatataattatataacagatcatactttacatgatagaatcaggtattaggtttaacatgcacctgacagcccctgaagacaaagacatggaatactccaatcaaatgtgaagtccccaggacctcctgatattgggataggcctcttggcttggactctgcactaggagataagaatgtcaaggggccatgtatgacagcagaaggcagctgattatattcctgctgtcgctttccactaaaggtgaacaaactggattccatgccttttccttcaggagctctcaggtaagtggtaaggctacggccactgtaacagcttcacgctggggctcatctgtcatcagattccggtgttcctgggctcaaatgaccactggaagcaaggatgtcagccactttcagagaataagaaaccgagcaaagggaaggcagcccaagtcctaataactattgagtagacatactcaccctaccggcgctctggtcattcactcattcacccaacagtcagatatttattgactgtctatctcatgtcagtcaccaaatgggaaaatgttattaagcaagcaatagccaaacaaacaaaataaatatggcctgggctttcatgagcttacagaccactagtgaaacacatgcactttaattaactaatcatgcaaaaaaaattattgcagggtgacatgaaggaaaggtacatggagttgtaagcttttgtaatatgcaggactggagagccgatctgattgggaacttcaaagaaggcttccaaaaggaagtgatatctgagctcagaagacctgaaagaagaaggtaaattaaccaaatggaggagatgaatgagtgaggcacaagtgagagagtgcaggccaggggaacagagggaacagatgtgcaaaggccctgtggtagagggagatagtacggttgaagaaattaaaaaagaaggaggaaaaagagagagagaacaagaacatgttaccaaatgaggttaaagcagagaaaaataccttctgggacttgtgggtcaaattcctgatttttatctttctcctaagagcaatgagaagccattaaagtgttttactttttaaatgtttttaaaattttaattgataataatcacacatatttatgggggtatatgtgatatttcaatacatatatataatatgtagtgataaaatcagggtaactgtgatatctataaccttgaatcttttttatttctttgtgttggagacattcaaattcctttcctctagctattttgaaatatataataaattattgttaacgaaagttaacactgtactgtgctatagaatattcgaatttattcctcctgtctaactgtgattttggacacattaaccaatctctccctgtccagcctcttgtagctaccattctactctcctattctgtaagatcaacttaatgattcaagtgttctaagtaggggtttaagggaagatggcatgatgatatttttaattcaaaatgatcactctggctatgatatggagatgaactggaagtgtgttggaaagccaatttggaggtattctaggatagatgatagtagattaaacaaacaaacaaacaaacaaaaaatctccagcagaaaattatatgcacctttctgtcaaaattaactctcatagtttattggttttgaaatcagtgattctgggcctttgatatcaacatcttttttaggagttttatttcttaatctggatgtccaactactacccaagacccagcactgttttgaggcctctgagaggatgcccagtcctgctgcagtctgaggtctgcagccgatgctaggctgtagcaaaggctgaggccctctcattctgattgttgaatattaggtcttcttgtggtcggatacatctgaagatgaacactatagcacaagcagatgctattcttatctgattttaatatgatgaaaaagctttaccaggaagctttaggactgtaagtactaagggtgtattaataaggctgggaatggaaagactaaattcattgtggactgaagcataatcacaaacaaaagtgtcatgatacacgcagccaagattagcaaacttcgctaggaaaatgagttgctgggtggtactagggtagactgtgtcaactccggcggggctaggaagtgtcttgttaatgtatcttcagtgccttaatgcaacacctgcgaatgatcctttttagttccatataatttgaaagttgcacatttctattgtgtgtttgtcaaaatgctttcttacatattatctcatgtggatgttaggacatctaggagatagaaaggacagatgttatttatgtttgatataacagaaaaactggagcacagaggggttaagatgcataaagtcacgcagctagttagacacctgcaaaagggtttaagatgatctgtgctttgacttgacctattcagttcagttctctttgagtttctttaattgaaattactcgcaatatttctttcagaccaagaggaaggtggtaacaaagataaagcattattttcttttcttgcttgactgtattcctggctttgactctcttttcctctctaacgatgataggttggcatttactcaatactctgcttctgtctacccactagtaagacagtatcatgtttaagccgtaaagaagatagagaatatgagaaacaattggtattcataatcagtagtcaggaaagtcttgtgtataattaattgaaaaatacttcaatctaataactcaaaagaaatcatttctgaaactaaatccaggctggcaaacatctagactattataaaattcttcagatctaatgctctttagtcacatgtcctaatacagacacagaattgagaagactagttcaaaagaagtgcctgagaaaggcacaaaacccacatgaaatccacgtgatgattctattctccaagggcattgctgacgtctagaatagaaaaacaaatttatcaaatggccaccaggaagccaatattaacctgagcaatgaaaggtgtgtgaacctatcagttcctgtaacacagattcagagaacactgggacaataaatgctatggaaactcctcacggacagcctcagtccagaagtgagactccaagatgtcccttaaggcatcagagacccattgcagatagacaccaggctcgtatatcagaacctggtccatgcaagcatgacagtggccctcactcaagcttcatcaacatttttcttggaagaaagcagaaaccacattgcagaaaaatcactagtataacccatttttaataaaaaaataagcaacaaataacacagtaaatataccataaatctgtatgtgtttgtgcgagtacagagaaaggtgaagcaaaaggtaacccagactgttaatattgattaccctgggagtggagtgaagtgaggggcaggaagggatcagctggattcaaagaaaggaggagtgaatgaggggaaataaatatttctccaaatttaaaagggggtagagtactgaataacacaagaaacattacaaaatacaacactatacctctactattactataaatatttaaatatgggttaagtacattggaaataatcaatgtaacaaagactttgttttgactgatgatggaatacaaccaactgaatttgttgttatttttgtgttattttgaccacaaagtaagatttttcacacatcattaagcggcactgagtgacagaaaggaaatcagatatttcagccatttctttgtatgactaaggatatttaggcagagtagggattatgaaataaaagtagctcaccattatcctgcataccctactctagggaggtagactcaggttagcaaggtctcgacaaggagtggaaaaggaaataacagttcaacgtaccctggcgtgcagagaagagatttcatcagccagtgtagtaaatgcatggcatgcgactttgtatacaaagtgagagtgcaagtaagattgatctagttgggtgcagtggctcatgactatagtctcagcacttcacgaggctgaagtgagaggaccacttgagcccgggaagtcaaggctgtagtgagccatgattgcaccactgcactccagcctggataacagagtgaaccactctctcactaaagaaaaaaaaaatagaaaaggaaaacaattgctctacaagatcccctgggtggtcactaagggagaagacagagaacattttttgaaagtttactgtgtcagaaatagcaactactttctatatattatcttatttaaactttgtatcagtctgttttcacactgctataaagaactgcctgagactgggtaatttataaagaaaagagatttaattgactcacagctccacatggctagggaaggcctcaggaaacttacaatcatagtggaagggaaagcaggcacgtcttgtaggaggaactgtcaaatacttataagaccatcagatctctgagaactcactcactattatgaaaacagcatgggggaaaccacccctatgatccaatcacctcccaccaggtccttccctcgacactggggattatagggattacattttaagatgagatttgggtggggacacagagccaaaccatatcaatcttcaaccctaaaagaactcagacctgttcaaatttgcctagagtcacaagactagtttgaatcaggctgttcttaactccgagtccagcactcttacaactcgttcacagaaaacactcaaactactctgtggtgctcattcccagatgggtgctaaagaatgaattcactgatgtgtgaaaccaaagaactttgtaagcttcgctaactacaaccctttagaggaatgccaaagtgatgtaagatgatcccagtgtaatatgccaggctctgtaaaataccccagaagctacaaaatgggtttgtgaggattcctggtagtgtgagtgtttgacaaagtctgagatgactaatcaggaaacaactgttgaaactgtgttggaccttcttgtgtgacattttataatagtaaactgagcttttctagaacagttaaaaaccagtctaggataaaaggcagctgcacatgccctatcttctgttcccaagcaagttctttgtcctctctggcttctcttccaagaggtgctggcactgctgaaagccaaaatttcctcaccaaagcagctaggacagagtgttcccaggatgtctggtttgaatcatgctgtataggtgtttcttcactttcaaaactgagctctggaagatgactctaaaatgtccaaatccatgcataattacggagtattgtcagtcttctccccttgcctattcaaagatggttttctaaagcacacgtctttctccaaatgtgcagacctcctgagcttctgtgcaagcaaaacctacagtgaacttagatgctctgacctgggggatgaagagtcgccagtgaagaggatagtgcagaaggttttacaatttttctagagaactcagatctgtcaagaccatgaatttcagagacagcacactttgaacacatcaaatcatctgcctagatttatgacatttcactttctctcagatgaaatgaagatggctgttttttcaggcccttctaagaggactcagatccttgggacttgcctaactaaatacccaaatacttctggatctaatgcccagatcaaggcattccaataggaacatcacaaagtggtttggtccttcctttagaaatggatgatagtaccatgtatttgactgaatcccaaatttcccttttatgtcttctgtacttggtgtctggtttaaaatgcaacagaatacataagacaggaggaatacttagcttgtgtaagcagataatgactatgagctggggcctctgtactccctctagatattatggtacagagaggttcagaaccttgacccattgcactttggaagcactttttagataataaaggacattgctatactgttaccactgcatgatgtggctgtaggaattacatcagcaggctctggctagaaaactagggggctgccaaatgacataaatcttaaaatgtttttgagtgacttttggaattcactcataaagtaaagacattcagctatgtaattagaacaaaactatatatactttaaaaatggtaggaagtttcctttaggaataaatctctatagaaccaggtttcctagtagtaaaatatgtaacagaaatatgttagctttattagaataaagaaaaaaaaaggcacggtacattcattgggaaaatacagaaatacataaaataatgacaaagaaaattaaaatcacccataattatatcacccacagattaccttgttggtgaatatcattttaatcaatgagaatgcacatggacacagataccacccctataacactggaatcactatactatttttagcattatgcagtcaatatgtttaaatagcttaaacttttatacctagtatcacttggtggtcttcaccaagtcataagacctcttctatgaaatggatatatgatttcttgccctggaagtcacttcatcccccttctaaattattaggttgttgtgtaatttattttaaagaggtgctgtatgtgaaagaggtgccctacaaaagtcaggtggcaacctgggaattagaagacctagttttgtgtccttcaaaaaacattgtttatttggacctcaatttctctacctgtaaattaaagatggtaggacctgatgatcctaattgtcacttccaagtcagataatctgtgatttttacaattctattattcttgttattggcattattgtgcatccacatatacatatatatattctaacgtcaatttgagctgctgagataagctcagatctcaggtaaagatgcagaactgattcaagtgctgctgtcataggtagagacttaccactgcacattaatggtagaccagcttgaggactgagcggctgagcagagggtcatggaataataaatggcaaagtgcaaagccagaagcctgaggaagttactcactcaggcgaggattgcatggtgtggtgaaaccctgattcaggggtagtgaccacccatgtggatgaagtgggacattagtattgttagggcctcaagtaggcagactaggagattgaaaatccaaactgaagactatttcatgaatctagcctctgggatgtttgccgaactggaactgtcagtaatgagccaggtatctaagtcagactaaagttcttagcaaacatcttttctttgagaccctaaagaacagcaatattccaatatatgtggattagttttgaggggagtgagaagtggagacttagaaagagttgctaaccaatccaacttgaacttcagacattaggcttccggctaaagacaacctatattgcctgcctcatttccttcaacaacaaaaagcaagaagaaatgaagtggctcaattaccttactagagtcaaagagaataatgctgaatggagtaaggaataacataggagaaagcctcaaatctctaaggctcatcgaaatcagcttccactcctttgtatggagggagaaaacagttgaggcatctacgtcagaactaagctggcttagaaactgatacctgcctcacgaggtcaggagatcgagaccatcctggccaacatggtgaaactccgtctctactaaatatacaaaaattacctgggtgtggtggcacgtgcctgttaccccagctactcgggaggctgagggaggagaattgcttgaacccaggaggtggaggtcgcagtgagccaagatcacgccaatgcactccagcctggcaacagggtgtgtctcaaaaaaaaaacaagaaagaaaaagaaactgatgcctgcctcaacataacactgtttattaaccctttgtgccaccactaaaggctccaaatagccttttctccagatgaaaaagcaggtcaaattgtgtcatgaattcagacaagtgagtatcttgaagaaatttttatcaacagccatcttctctaccatctgatggctgacagcatcctgcaatacttatgaagtgttattacactgtgggtactttagtgctcccataagtctttcaatgtatgtgaaattacggatcattgaaacctgtctaatgaggacacagtcctcatgttttggagttaaatctcacaaaagtgataatcatgaattttccttattaagtttcagtctttgtatgtaaattgaagtattaagacaatgagatacagatcaaagttttaattttcgtccctagcctcagatttaatttaaaagtcttaaattatgcagagaattgcatctctttattcttacagctgcttaaaacagatttaattatcttccttaatatgcagatactacttctgcctaccagttctctcaaacgaatgcctcccaaatcagttttgttgagttcttcagactgattggggcctttgccatttatcctgtgccttcaggttcttgcattggatttctctgggaagctgagttattgtgttgaaagtctataggctcattaggttctcattagtggtccagaggacatccatcttgagtgagtctccaagcacagagatgccacctctcactgcatgcttgggtctcagtgcaaaacaccttcaatcagctttctaaaagtcaggcatggtttgaaaatgtccggcatcttagactcaactttatggacttctctactcctcttccagttggttcttggattaattgttctttatttttaaggccataatgatgcataaatgcattgtgtgtgcttgtgtgcgcgtgcatgtgtgttcttcttgcatctgccacagtgagtctgggatggaagtacgactgctcctttgccttctgctgctaatgaaggttctgtcatgagagtacacttggagagaaccctaaaagcagcaggaaatgaggcaggtggtattgatgacattggaatttttcatcaacctcagaatagctatgtggctctctgagtaacatatcaggtgagctaagttgtgggattttggaggaattgtgttatggaggtatttctgtcatctaggttttgagggtgaccccatatgctatttgcaggaaagaatcccatttcttgcacatattaaatctgtaattttctggcttgagtacatactactgtatgtaaaattgcaaactagtatcagtgtacctagccttttattattttctgtcaataagaagtgctcctctttgctacggttttagccatgttttcattgatattcttatgctagaattaggacatgcattctaatgcatgtctaggaaaggattaaggaagagatttagatttcagatgaagactttaccatgttttgactgtttttcaaatgttaagagtcttttaagtttcagttttatctctatgcttcttggggaaggctatccaaatccacatacatttattgagtttctatcaatatgttaggcacattgtacagagatgtgggaactgcaatcaggagtgacatgattcttaccttaaagatatgtatagtttactggcggatgccaaaaatattattacaaaataatgcaataaattattgcattataatttattatatttagataatttattattaatcttttttatttccaatggatataaggtgttaggcactttctacttcatgtcattagatttttacttaaaactcaatataacagaggtcctagtcaaaccaaaacatatattcccacaaactaaagtaagtccattaatgaatgaaaagtacatgatataaaattggctcttggtaaaatatttgtcaaagaacaaataaataaatacaaacatctaactatttgctgagacagttgattcctcaggtctctaatggtttagatgaaatgcagaggagatggaaattacatggagaggtttgtatgcaagtaactgggacaaagaaaagaggcttagatcagtccgtaagccaacctagctccatcgaaggaagacaagactgtaggagaaagttgaaccatgagttaacatggatagaggcacaagctctggtactcacatgaaaaaaatattgttaacaacttggggaggtgaatcttttgccctctctgcattaatcacactgtgatgtcatataagaacctagcagggacctctaggtttctttggtacctagaggacttgctctttacaggcatcagaagcatgatcttttgacatcagaagatccctgtttttataaagaattgatatcagaaatggggcaagactcaggcactattttcaaagtaaattcagaaggatcaaattcaaataagaaatgcactcatatggattttgaggagaataaagacaccatgtattgctagtaggggcacatgccagggattttttgtctttgttttggatttaattaaaaaatattatggcttaatttatacccaagcctctgaagaaatacacgtattctaaattccttgggtgctgcattcatatcctatgtttttgcaatattctttagaatagataaacagtgtcaggcacactaggcattcaacaaaggcatcattttccaaagagggggaacccagagaggatttcgcatctctctttgctgaaatgtttttccacaaatggatcccaagccattagtattctcagagaagccaggaggaaaattttggtagatttattgattagtgtctaagaatataagagccacaggccaaactggctttggtcattgatgatttggccttttctttctactccttgatctttgtgactacttataatcccagccgtgggtttctacagaggcttaggagctacatgaagttcttcttagaaaatggttccttcaccatagagagaagcaacagaaagacaagataccatagatcctggattagaccctaggctctaatagttagcatttgtgtgatctcaggtaagttacttgcctttctgtgcctcatataaaatgacaacaaaatgacaataacacctatttgcatagagttgctgtaagatctacgtgagataattcatgaaaagcactcacaaactggaacagtggtgctcaataaatgttggataatcacattattatcattgtgtcaagtgtcaattctcctcagcttttcagagacactctgtgtctcttcattctgcattgccaatcacgtgcacctcccgtgcctacgtatataatccagagggtcatagagaaattgagggtctttttctgcaaggaggagtctgaatcattagcacagcatctcacaatcacatgtgaggtcctcagggcctcctgatataaagaagatgctcttggcttggtgctctgcaccaggagaacagagtgtcaagaaaccagatctgacagctggaggcagcagatttcatccctgctgttgaagctttgcccactcaagtggagtgaactgacttgttatcttttttccttcttgtgcccagaaggcatgaattcacatatcttcgaaccagattccccaatctgttcccacatcactcaacccagtgtgagatgcctgatgatgatctttattacatggaaagcagagttgaacagatgagaaccaggcctctgtccctgaagtgtgttctctatcatttgcacaaaggttggagctaatcagaagtgaaagttcttgtttcagatcttgctatattgtgttcttagaaacggaaaaactttctgaactctgctatagtataaacatctgctgcttcaaaagatgacagttctctgggtatcaggatcaggtgtctcatgtctctgggaagagaactttcacattcaccttgcaggtaaacacagggtggaaggtcggccctaagcataccagaaaggtttttcttatttttcctttttttgcccaaatacctagatataaagtactatattttatatggatttctgaaatgatttttaagtaagctttttgttgagtaaaatatacattaaaaatgtacaaatcactaaatatacaacttgatttttacaaagtgaatgcatccattagctgctgcccagatgaaccaactgaaaactgccagtacactcaaagttctccaatcactccgcctccaaagttaacaataatttttcccttctattaccatgaataataataataattattattattattgagacggagtctagctcttgtcacccaggctggggtgcagtagtgtgatctcagctcactgcaacctccgcctcccaggttcaagcaattctcctgcctcaacctcccaagtagctgggattacaggtgcccaccaccacgcccagctaatttctgtatttttagtagagacggggtttcactgtgatggctaggctggtctcaaactcctgaccttgtgttctgcccgccttggcctcccaaagtgccaggattacaagtgtgagccaccacacccggccaccatgaattattaacagctttgactatttttgcattttaattaaatggaataatgcaacatatattctttttagtctgacttctttagctcaataatggatatgacatttatccaagttttttgcatatagctttagtttgctctttttcattgctgtatgacattccattctgtaaatatactgtagtttatgtattctactattcatgaatgtttagattgtttccagtgagggctcttacgaatacttttgcaatgcatattatcttacatacattctggtgcatatgtgtatgcatttctgatgagtatatacttaaaagtggaaacgctgggacataggtggtatacatgttcagctagagcagttaatgtcaaacaagtcccaaatggcagtatgtatctacactccaaatagcattatatgaatgaccagatgctccacatactcaataacacctgatattattagcatttttttttttttgagagggtgtcttattattttttttttttttttgagagggagtctcactttgtcaaccaggctggagtgtagtagtgcaatctcagctcactgcaaccttcacctcctaggttcaggcgattctcctgcctcagcttcccaagtagctgggactacgggcacgtgccaccatgcccagctcattttgtttgtagctgttttttgtttgtttgtatttttagtagagatggggtttcgccatgttggccaggctggtcttgaactcctgacttcaagtgatctgcccaccttggcctcccaaagtgctgggattacaggtgtaagccactgcacccagcctattattagtcttttaaaatgtaaaccttctgatggtgcacagtgatatattattataaattaagttgcattacatagggatgttccgaattttttcatatgcttattggctatttggttattctgagtcatttgtgcattttctgttgagttaccagtgtttcccttattagtttgtagaatttatttatactcttctaattatgattccctcattaaaattatgtttattttgcataataaaaataataaaaaacataacaaaataattttattattttattactgtaataataccttttcaataaggtattattacaaatacttttttccctctagggcttaatttaataataatagcttattgaaaacgtattattatagatacctttctcccctctaggacttaattttttatttttgaaataatgccttaaataacagaaattcttaattttaatgtagtcctatttaaaattagtataattaggctgggcgtggtagctcacgcttgtaaatcccagcactttgagaggcttaggtgggcagatcacttgaggtcacgagttcaagaccagcctgaccaacatggtgaaaccttgtctctactaaaaatacaaaaattagctgggtgtggtagctggcacctgtaatcccagctactcaggagggtgaggcaggagaatcgcttaaacctgggaggcggccaagatcatgccacttgcacttcagtctgggtgacaaaggtagactccatctcaaaaaaataaaaataaaaataaaattagtataattataaagagatttgttggtataattcctttatactaaatgggttttctttgctgttttaaaaaagtctttgcataacacaaggtcatgaagatactcttctgtgctttcttttagaaatgttagtattgttgggcacggtggctcacgcttgttatcccagcactttgggaggccaaggtgggaggatcacttgagtttaggagttcgagacgagcctgaccaacatggtgagaccccgtctctactaaaaatacaaaaattagctgggtgtggtggcatgcccctgtagttccagctactcgggagactgaggcaggagaatcgcttgaccccaggaggcagaggttgcggttgagctgagatcttgccactgcactccagcctgggcgacagagtgagactcaaaaaaaataaataaatacataaatgttagtattagctttcaaattttgattgacaatccagttataattatgtttgtatattatgtgagataaagattcatgtattcccatatggatattcaaaattgtagcacccatgtattgaaaagattataatttctccactgtactgcagtgtctcatttgtcataaagtgggtgggtgtgtgtctatatatatataatatatgcatgtatatatgtttcttgactctccttgttcagcttgtttatgatatacatacatatatatgtatatatatgtgtgtttgtatgtgtatatatatatatatatatatatatatatatatatggtaatgtcagtcatccaaatttgtgagtcaccttcaaaagtatctttgctattcttcaggtcttgaaattttgtgtaaattttgtgatcttgtcaattttaatacacaaaacatgctggagatttttattcagattgcttttaattcaagtcaatatgaagaaaattgatgtctttttataatactgagtcttccaatccatgatcaggatgcatccctccattcattcaggtatttttcaaaatttatttccaaatttgtgttgttttctgggtagtgctattgaaaataagtttttagatttgagtataaatgtttgttgtattttgatgctattataaattttacacacacacacacacacacacacacaattttctacttgtgtagaggatttatatgtccaggtatcaagactcaccctaactctagtgaaaatatcatgtgtttgaaattagtaattaagataggttttaaattcacaagggaacagaatagagtgcctagaaatggaaccacaaatagtcaattgatttatgacaaaggctcatagcaattcagcgtgaaatgaacagtttttcaatggtattgggacaattggatatgcatgtggatgaaatatagaaacctgaaagagctttattcaagataaatcatacacattaatgtgaaacctaaagagaaatcttgtggtatgacttttttcacaatgttggtttagataaagacttcttaagcctgacaaaaagcactgaagtgacaaaaatcactaattttcaaaatataattactgatatttgagtatatatctaccgttttttaattttaattttaatgtgtttgagacagggtctcgctctgtcagccaggctggagtgctgtggcgcaattatggttgactgtagctttgaactcctgtgctcaagtgattctctcaccttagcctcccaagtagctgggaccacagacacacgacaccacgcctggctattttttttaattatttttatttttttggtagttgtccaagctggtctcaaactcctggactcaaatgatcctcccaccttggcctcccaaaatgttgggatccaccgcaccattcctatatctaccattttagtatttgttttctatttgtctcaactgtattatattcttttttttctcttttacttgtcttactttggattaatgaaacccttttaaagttactgtaattcccctgtcagtagcttgatgataagattctcttactacttcttcagttgttactctagatattgaagcacacattttggatacgttggagtctaatatatattagtatttttatctctttatagatatatcatgaaccttaaactactttaactccacttaattcgctccacatactgtgctattattctgatgtattttaatgctacatatattttaaatcccacagctgattatcattcttggtctgcacagttattattaatttcaatttaccccctttcttgctcttcattccttctattattttgtgtgtgtgtctctgtctgggtcattttctttatgtgtgaagaattatttttagcatttctttttatagacattggtttacatgacagatattgctatggaaggaagtgctggaaagggaagggaatggtccctttaaatgatacagaagtgggggaagggcgttggtccctggctagggctccacccctgggcccctgccctgggacctaggtgagaacaggccctcctgcctttgcacccaaatgttgtgtttcccaagaccaccctagcctgccctgcccccatcctgtgcctataaaaacccctgacaccctagcaagcagacacacaggcagatggacatggagaggaatgcaccgacaggcaccagcatgccagcaggccaccgaccaggagaactatcctatacggagtttagctggggcactgagtggccggactccagtggaaaaccttcccactccatccccttctggcttcctccatctgctgagagctacctccgctcaataaaaccttgcactcactctccaagcccaggtgtgatccgattcttccagtgcaccaaggtaagaacccgggatacagaaagccgtctgtccttgcgacaaggtagaaggtctaattgagctggttaagacaagctgtctacagaccgcaaaacagaaagagcacatggtagcaaacgcctactggggcttcaggagctgtaaacattcacccctagacactgctgtggggtcagagccctgcagcctgcccctgtatgctcccctagaggtttgagcagtgggacactgaagaagcgagcaacacccccatcacacgcctgttagggggacaagggaacatttcttgtttcaatatctctattattgtttatctaaaaaactatttgtgttttctgcagctcttcaaaggtgtcattccattttcttctggactttttaaacacctctgtttgattttagatttcagcagtttgaatgtaatagctcagtgatttttctttgcacatattcttcttgagtttgctgattctgttaaatctataggttaatatgttgatatctttcatcaggcttggaaaattctcagccctgatcttttcaaaaatgattcaggttccttatctctctcctctccttctgaggctacaattgcatctgtgttagacctttttatcattttccatttgtctcttactgttttttctctatattctatttctttcttttatgctctagatggcgtatttcctgctgtcctttcttccatttaacttctattcatatgggttcaatttcctgtaaacctaagttcttaatatcagttattatatctttatttttacaatttctatttggtatttcttattgattaccactctggggttcaattttccaccttttctcacattcatgaacataataatcattgttgttttacaggatatcttaaataaacactatatatcatccaactgttgttcttttctgtttttcccccctcttggtcctatatcttgatatacttggatatttctaaatgcccaacattttatatgaaaaatattaggtaaagctctggtttatgttattttccactaaagaaggtttactttggtttctaacaatcattttagagttgaagagagtcactctaatcgattcagagactgaagtgatttcagattggatttctgggtacagagggcttgttctaatttgggtttgccttcactcctaggatagagatttccagaagttccaagaaccaagtctcagatagttcaccagggccctcctccttgataggtcttgaattcaaatctttatctccccgaagggtgatacttctaaaacctttaacttctcagcctcttattgagtgctttctatgtttcctgtgttacttgggtattatgaaatacctcagggaggaaaaaggccctgtatgtgtgctgcttccctgtgctttccttctccctgggacatgacctcatcagtcctagctttggaatatcctcaaagtccaatttttatctcccaagccttgtgagtttattaacacctgtttagccaacactttctactcggccttttactggaaatctgaaatctgaacctcctctatagtgtggcatataaattgctaaagttctcgaaaggaaaatatagcataaaatgttggactcactgcagtcaatttcccatctcttaagaaaggaattttagcttctcaatcctcctgatagttctcttaactcctagtcctccttttcctcctcttcatttttcttcttcttctctctctctctgtccctcttgctctaaatatatacgcatatatttggtttactgcaggctaatctgtcatagtctcaagcagaaacctccagagtttatttatgtgaaatatgagcaactccaatttgcctaaattggcctgtgtttttctagttccaactgaagaatttttgggcatcttagtatttagaagattggatataattgagaggcacacatcaaggagataatcaggaaaggagtatggggttacacagtctgtaaatggcccttggaccagagatatgcacatcgtttgagctagatttcaaactcgttatttcacagttatttttcctatgagaatcaaaatactaaaaattttcatcaaacctgacaaagcaatcataattgcttcatctttccaccttcttgtcacactccagagcctccgacttctctataccccagccttgccactgttttgtttttcttgaagcacaatgcacaatgcacaacctgtgaacttgttagaaatgtatattcttgggccctactccaacctactgaatcagaatctttaaggatgtggccaagaaaactgtgtttccaaatgctctccaggtgattttcttatacatggtaaaaactgagggtccctggactatcagcagaggaagttggaagtcaatgttatgtattttaatcctgggtgtcattgttagcctttaaaattccttcatatttacagagctttacacaatgataaccataattaggtacccagaaaacgtgactgaggacaggactgtttggtttaataatcgagatgatttaatgtaagtacttatcctttggagaccatcttccccatttacaagatgacagaattcctgtgtatgttctaaaatatataagataaatttcatcttatccaccatataaatttcagacatttcagacaaccataatctggcaaataataatgtatgcttttaatgatatccctgaggtgctacacaatacaaactcttaactgccaaagaaattacactcaattatgtttacattggcctcagtgctatatgcatgaccatcgtgttgcccttggaaaagaaaaccctgcaggctgagaggggatgaaagtattagcatctcttaggttagtttagtatatgtacgtattaaattatttcaggaatgttatttatgtattctgagaaaatggattttgctaaaagtgccaataaggcaagattaaatccaacagatcctccaagagtaagagattaagtatgagtgaagaataacttgcagtgaaatgtaagtaattaaagaaatagatcagggaaggtgaagtgataataaaagaaaaacaaggaactaaaagtaaaataaaaatttttaaatagcatctaaaatggagaaagttgaaaaagatatggaaacaaaaccatggtttattaagaaaaatcactggccctagaaagtaggggggagataggaatcagtcctacctcttctaattgcaccatgagagtgacgttgtgtccttgttccgctgtcagctttccatcagccgtgactatccgcagcccccgcggggctttccctgggcacttctgcggtttggcagtgtactgttcccttacgccatcagtgcaattattggaaaccaccttcctgtacctaaatggaaaaaagctcaagtcgtaaaccagctcattataatgtgaatcattcccactttttaaaattagacatagtgcctagccctgaggaccatcagtaagcacctaaccatctttcatgctactatgaggagtagggttaattcatataaagcacccaacagagagataatcatggtcacacattgtatctattactagcattgtaactgagttttattcatctattaaattaatgaatcacttcattttgaagttgtgggaaatgcacagaaatagaagatatagcccctactctcactaagtttataagctagttggagagacatagatggctaatctaggagataattcaaaggctatataattaaggactagaatgagtaataaatatcgcaaaggaatttacaattcagagaaaaaatagattatgatagatatatgactcaacattcacagatctcatagagactgctacagtaatggtgtagcacagaaaacactggctaaactggatatttctactcagtctttcatgagaggttatactggctaaatgatcaaacctcacattaaagagacttcagtttttgcagattgatgctcttttgcttatttcttgttttagctttaacagggaaaattattctacagaattaacctatataatttatcagattcatagaaaattaaaatgtacaattttaggatgacaaacctttaagatttttgaggttcagcgttatctagccattatcgttttatactgttgggtctgcagcaaccactttatgtatgtatatatttgatttcccaagtttatttgcctagagttagtggtagagcccaaataagatgcaatcaaagcttactttccactcttctagaccagaggtcagcaaactttttatataaacagccagatagtgaatgtttcagttttgcaggttatgtagactttgtcacaactacttatctctgcacttactgtatgaaggtgaacacagacaacacataaaagaatgtatgcagctggattccagaaaacctttatttacaaaactggcatagttttccaatgcgtttaagtctagtgaatgtcctttcctctgtgagaaagtcaaaggagatactgtctggaaaagtactttgaacactatagatcactacaatgtcaattattaatgcttatctcatatgttaaatgtaagaattaaatgggttaatgtacacagagtacttaaaagtatcctaatactctgcaagtgctcataaaatattaccaattatttctatttaatattattactatttttcttctctgttcaaaaccttcatggacttcatatgaccttaggatagctgtaaattctgtaggcctgggcatgaagccctgcactagctaattttattctgctttcctggactctttctccctcataagcccatgtccattctctttttaatcttcttgagagtacttctgttttcctctctctctttctgcttcagtgtcctcctgcatgccctagcagctgcctaaaatttgcccaccctttaaggtacagcttacttcttgtcttctctaagacaatttccctgaatataagagtaaaatggcaggaatttcatatttagagagtgcttactatgtcctagttattgtgctaagttctttacataaattaactcatttatcttcagaagtatccataataaggaagatgtaattattcccaataaacagatggaagaattgagattcataggtgtcaactagttttctcaagatcaaatagccaggacctagacaatttgtctctagcacacatcccctctttactactgcactgctactttaaatggagtaagattatccctcctctaaacccttaaaagaatccttacgatttacttgataggaattctttataccttgtatgattttcttcctggtgtgactgtgtgaaattcaagctccttgagggcctccttgtgttccagatattcaaagctggtaatcaggaggtccataccagtaactgtaccagtttaaatgtggaaatatctgcataataattggttattaccacatccccaaaccctccaagcatctcacttaccaacccagctatgctgatccctgtccttagagtccttgcttctcacaattaggaaacttatgggttaacacctagcctatgagggggtcaccaaaactccgctccagacataagataactgcccatgctggttggtcattgttatgcctaagcaatttgaacatcattccatctgattttttttttttgtttgagacagtctcgctctgttgcccaggctttacttggctcactgcggctttattatggctcactgcagcttccacctcctgggttcaagcgattctctcgcctcagccatccaagtagctgggattacaggcatgtgccaccacgaatggctaatttttgtatttttagtagagatggcatttcaccatattggccaggctggtctcaaactcctggcttccagggatctgcccacctcagcctcccaaagtgctgactaaagacatgagccaccacgcctggcctcatctgatatttatttttttaaaaatcctttgtagttgcttttaagtatatgtaaaagagaaaataagggcaggtgagagagagaaggaaataaaacacaaaatgcagacactggtgtatgatagcatcctggtaccagcaatagtagcaaaaaaatgaccagtgatgtcacccaggttaattgtggcatctcagtgagtttcaccatgcatcagagactgtctacaggtttcagaggcaaggcactgtgcaaactgaagtcaggttatgatttttaatcactcaacatccaagcacacctgtgattctctcttggtgggcagctatagaaacactggttcaccatcaccactagcatcatcagctagagaatattcttttgtttgtcactgttctgatcaatcattaccttaggctttcctgaatcctgcaataacaggagttctgcttaaatccaaagcacgaatccatccccccgggactatgccacagaaaaggctgttggtaatttttttaaatgctcattaaaaaccattctgaaaccattttatttcctgtatgaaaatggcatcacattagccctaccagacctgtccctgaaatttagaagaaaattgtgccgtaatacagagttcatttactcaagtaagcacacacctgctttttgcattacagaatggttctattttcatcccagcagctgtccctgggtctgagttacataaatgaataatgcatttaatatgttattaaatggggctgctacctccgtaataacaaggcaacttatgattatgttggacctgcgctctgaatattactgggatgcatttagttggtaaagcattcttcaatctgccaagaagaaaagtgctttgtaatggcaagggagtctttgtacaattactgaaaaggaaacattctgcaaatgtgcctttgatattaccgatggctcaccagtagataggatcttactactccaacaaccccaatttttagctattctcttcctccctattttgatatgcttctgtcacattttcctttttgcccctaccctctttgactttgcttctttgctacctggaagtcttaaaaaagatgaaggcaataggctgggcatgatggctcatgcctgcaatcccaggactttgggaggccgaggtgagcagatcatgaggtcaggagatcgagaccatcctggctaacacagtgaaaccttgtctctactaaaaatacaaaaaaattagccgggcttgctggcgggcgcctgtagtcccagctactctactcgggaggctgaggcaggagaatggtgtgaacctgggaggcggagcttgcagtgagctgagattgcaccactgcactcccgagcgagattctttctcaaaaaaagaaaaaagaaaagaaaaaagatgaaggcaatatttttctttgtgaaagtaaaactggaaggaagcattaaaagtctttgtaatctgtgacttttctatttagtaggttttttttttttgacattttgaggtggtgatggcaagatacagatgtttttgagtattcagtgtatactaaggtgacagtagcttagtagcttagtagatctcaaccccgtctaccctttggaattagctgggggtacttttaaaatagatggatacccaggctctgcaaacagaaatgctgatttaattgagaattatggggatcagtttgtttttgtttttaggttcccctggtgatgctagtttgcagccaaggttaaagactacaaatttaagaagtcaaaaacaatagatgttggtgtggatgtgctgaaaagagaacgcttatatatggggtaggaatgtagattagtacaaattagtaccacgtctatggaaagcagaatggagatttcttaaataactaaaattagatctaccattcaatcccgcaatcccactactgggcatctaccaaaaggaaaagaagtcattatagcaaaaagacacctgtacatgtatgcttatcacagcacaattcacaattgcaaagatatggaaccaacttaagtgcctatcagctgatgagtggataaaggaaatgtggtgtacatacaccatggaatactactcagtcataaaaaaagaatgaaataatgtcttttgcagcaacttggatggagctggaggccattattctatatgaagtaactcaggaatggaaaatcaaataccacatgttgttacctataagtgggagctaagctatgggtacacaaaggcatagagagtggtataatgaactttggagagtcagaaagggtgagggaggaaggagggtgacagagaaaaaactacatattggatacaatgtatgctactcagatgacggatgcactaaaatctcaggcttcatcactacacaatccatccatgtaaccgaagaccacttgtactccaaaaggtattgaaataatatatataataaatatatattatatatctcaaaaatatataacactatatgtgtgtgtgtgtgtgtgtgtgtgtgtgtatttttttcaagaaaataaataaacactactgacctgaaggttaaaactagtgttgtagaaccaaattgtcggagtttaaattcattctcttactctatgaatttgggcaatttacccatcctctctcaaatctttgattctttgcctacaaattagggataattatggaatcttttcctaaagttcttgggaagattaaatgagacaatgcattgaaaagggcttagcatagatttcagcacatttagaacgttaataaatattaaaatataaaaagttagaaaaaagtatttaagtatcaaatattaacttgctatgatatttcaagttcccccaaaataaaagtgacgttcttattgccaaggtcgtcttaagatgaaatccaattatgtcaattcctttcttaaaatcattcaaaatttcccatgggcttattctaaagagtaaagttcaggtttaaagtaaagatccacgacctgacctcaatgcatttttctagcatcatccatggcctgacatgcgccctgaaccaagccattctgtatactaaatgccttcttttgcctgtgctgttcattctgcccgggatgctctttcctactggcaaacttctactcatccttaaaaaaaaaaaaatcagcttcaaaatcatgctttttgtgaaacctcctcttcccttttgtcacggtagttatcacatgcaaccaaggtgaaactggaactctaggtcttcttgtaccccagggggtgttactgtcattgagcaacggtggtcctcatttgcactcacaataaaaaaaaagcataaatagtttaatttcttggcttgtgctatgtgcatttgctttcaagggaaaatactgccttgttacaatgacactaggcttaatgaagcaggaaatgaaggaagccttggggatggagaagggggctaattcttgatagagtatgtggctaagacttaaaatcttccaaatccaccaccttagtaatgtaggtgtgcaatgacaaaacagctatatgtgttatgttcatgtgtgtaaattaaaagagctatgtaactatagatctctcacatgaagatacagggctacgatggcatggcttaacaattagggtagagagagattcttctacccctgcatccagagaaactgcttctgaaaaagcagtagtggtggcagcctagatttcctgatctcctattatatataccagaatagggattataccagacttccaggctgacagacctcattggtggctgtatattaaccattgtgactcttcatcaatagacacaggcagccccaaaatggtcatttattctttaactgggatcccatgtgacaaagtatgctcaggagtgacaatgtgtccacatatcaacaataatcttatgtagcagccatagcatcagcaatcaggaatagacttccatggctggctaagcaggctttccaagtttctctcttcaaggcaacagctctttggactattcccctcaatggagtaaacagacctagaaattagcggataggcataagacagaagaccaggtaaaaagaagaaagcttctcttgcattaagcaggatggaagcagacgtcatttaatttgaatagtaataggaatgtgacttcattttgaacatgagcttgatgaaatggtgaactgggacatatggccacacacacttcactaaatcacttaatatcgagaatcatactgattgagaatggctcacagaatccactatctgagcctaccagttgtacgactaagttaatatgaatttgttttctatcttttgagggcctacagtccaaggaattctaatattgaatcctttcaattggtcatggaaatgttaaagcttgaaggggtctctaagatcatccaacactatccttttgcttttcacataaggaaaaggaaacacagtttagagagttgcacctcacacaggggatgactggcacgtctgggactctggactaagtctggtgttctcttgccactgtaccatagcaccaggataagaattgttaatgccaaggccattgatgtgggcaagaatcgccatgtgagaaagcaagtctccatgtacagtgatattcaccttttccttcatttcccaaccccagtgtcatgcatgaaaagatggaaaacctcatttaagaaaggttttcttaagaaagttttcttcagaaagttgactctgtagcaaccaacaattattgagtgtgtgcagtgaggctgtatggttcttggctagaaaacagctacagaggcccctgcagtgatgagtctgtaaataatgcaagtgattgcctttttgtggactttaaacacatgcaccatttttagggccaattattctccttgacgcacactgaaaagtatccttgagaggagatcagaccaaacatcaaaacccccacaaggcaaccaaaacagaatcacctggaaaagaccaaagctccagagacactggaaatagcaaatccaggaagtggcaggttagcagaatctaagtgttttatggcttatgtagagaggaagttttcaagtttttatttttaattgacatattatacatatttataaggtacagtgtgatgttttgatacatatatacattgtgtaatgattaaatccatcatatccatcacctcaaacatttatcctttctttgtggtgagaatattcaaacttctctcttctggctattttgaaatccacaacatgctattattaactatagtcactctactgtgaaatgaaacaccaaaagttatttataaaaagcatcttttaaaacattccaaatgtatcttgatagtataaacataactattttgctagaatttatgtgtgtattttttcttggacccactgtatatttgtaaatagatacctaacttaaactttttaaaaatgtctttattgtataaatatccccattggaatctcttgaatccaggaggcagaggttgcagtgagctgagatcacgccactgcactccatcttgggcaatagagtgagactccgtctcaaaaaaaaaaaaaaaagtccccattgcatattgagaaactaaccctgaagagcagtaagaactgtctttgtaccttcttccatgaggaattaatggcccctataaagaaactctacagatagaaatttctaaacgtactttataaagcacctctagaaatatctccagcttaatagcaggaagaaatctttcccttgagaagattatcttggtttcttagaataaaccaacccactgcccactttattttatatttacagaatcttttaccactggcatgaaacaagtaacatgctagttaatttagcaacttaaattttgcagtatgctccccggttccaaaacagtataaacaagatttaaccatatataagtatcactgaatgagcttgtgcttgtggatgtgcatactgagatatttatagataccgaaagagaaacaaagaggaataaatttggggttatttcggcactaacatgaaataaaatacaaatgaatactgctttcattttatttgagcaaaaggaactcgttcagtaatcagctaaacacattatctggcctgagtggcataaagggacagacgtgctttggtgtacagtgctttcatcactttctaattatgtaactttatgagccgcataggttactatttttgttttacaaatgagaaaacagagacttacattaaatatgtctcagatattattactgcagtgacaattaaacatcaaatacatgtctggactgtggattcataataaaagtaagttttttcccttctttctttactctagaggagtcttcagacaataactattggtgatgacacacattttgtaaggtgatgactatgtgctaggcattgtgctacatgctttacatacagtgtgacatttaatcaaattctgaaggcaaatagcaaaatgttataggttaaggaactaaggtcaaggaaacaaagtcacttactaaacataacagtaaatggcagaggttagattgaacatccttaattgtttcattccaattactcactttttcaccgaacaaaacatccccaattgtatttcactctcaatccctaacaggctaaggccccagtaccagcctccttgctttccaccttcatgtcaaatgacatgtagaagctgtgaggacagaggctgaatagaggcagggagccaatcgtggagaacacagcaggctctactgttccactgtgtgggtatgagaaaccctgacgccactggaccaaggagcaggactggtggttacagccacctggagggacattctgcaccaagttcactttttattccatccatcctttctaagtcctagccagcaactaaaacaaaaattgtgcaaccattcacttctacatagtaaagatgataaatattttggcatctcatcaaaatagcattttattgggcacaataataaccgatgccaggatttccccatcatggagaagcaggtaaacctgagaacactgccatatacacagggtaataagctgacagtgaaagtaaccatagacatttataaagtgagttatttaagaactttttttttttaaaggaatgatttcctgcatgcttccaaataaactctcagaaaggtgatgctgggaggtttggtcattcaccccacttaattcattttcccactgcatgtctgtatcatgagctatgctgtaagaaaagtgtgagacaaatgaggtgcccagggagcaacatttatgaaggggctcactctctggccagccctacacttgcgattcctttgcacttcatcccagccctgaggctaatacagattctgcactgactgagcatgaggtgaccatggatggcttaaaatggcactggacacagggttcccagtggctgcttaactctataagcatgcaggcattggcatctgggcttgtccttgagaaaactactattgtggcccttccccaggatcatttcttgttctttttgcatgaaatgaccttcctcaccttattaatttggctaaatcctacttctccttcccctcagctttcctttacagaatccactggcatttgaattttaaaggaggacggcacttaatacaaatgaatctctaatttttgggactcacaggcagcccatgagcaggaagccagtgttttaacccttacaagggagagatgtggcaatgtctgatacccaggtctgagacgtacccagttggctgagtggaatttgcattatgagctaacagaaacacctccaattgccaaaagagacttaattatctttgtattatttgtataacaagttttatgggatgagaatattaactgcagcattatttatagtggcagaaaaaacaaaataacccaaacatccatggaagaaggataactgataatattataataatacttaatactatgaaattaaagaaatgagaaagtgcccttatatactctggcttagaaagatgtttaagacatatttttgaatgaaaaaggaaaatagaagaacaatgtatctagtaggaaatcacatataaaaacaacctcccaaattaatttgtgtattttctcttgggacaagtatttactagcaaatgcaaagacaagtatttagaagtatgcatatcaaacagatcacagttgtgtggggaaagggggccaggattgggatgatgatgtaaattggcttttaaacatataaaacatacacatttattttgtaactaaatattttttaagtaaaaatctaaatgtatagtgtcagcattattagtggctacaagattatatactgaatctgcttataaaataccactgaatcaacacatagccaaatgacatctgtggtgaggggctgaagtgacattaagggaggcagaaagttcttttccatcttttccaagttcaccaacattttacctcttgccaactcttgagttggctacagacactgctaatgtgaattcagtggtgtgaggccttctttgtagatgatttcaggcctttgtcccagctaagggtcttcgtgttcctaatgcaaaatgtgtagcttagacaacatgctgatcagtggggttattattgacaaccactcccgtgactttagtgtataagaccctatttgggtattcactcctccacctgtgagcatcttacttatgagagcaggacatttaccatacccgctgatggctggtatttatcatatgttctctttacactagcttgctcaccaatgctgatgcttttctgcaaaatctttaaacggaacagacgaaaccagtggacgtggcaacttaacaaaaatcatttggggtcagatgctatcgtgtaatacccacagaaatgaacaggcccctgagagttaaggtggagtcctagaaggtagtgttgtaatttcgtgactactaaacataacaactgcattgaccaacatttatatacctggatgcttattgctaagtcacattttaattgacattatgattttaattttatatggcatagatggtattctttttgaatataaaattacttaatcgtcactgatgttttatttgatgttagtcagaatttataagatctcagatgggccaggcgcggtggctcatgcctgtaatcccagcactttgggaggctgaggcaggtggatcacgaggtcaggagatcaagaccatcctggctactatggtgaaaccccatctctagtaaaaatacaaaacattagctgggcttggtggcgggtgcctgtagtcccagctactcgggaagctgaggcaggagaatggcgtgaacctgggaggcggaggttgcagtgagccgagatcgtgccactgcactccagcctgggtaacagagtgagactccatctcaaaaacaaagaggaaaaaaaagatctcaatgaactgaagagtgaggggtcacaggtatcattcagccttggtctatgattgagtagcatctggaacaatttgatccctctgtgtttcagcctcctatcatcaataccaaagacagactaatataacttccttgactgattgagctggttaaaaaaaaaaatcaattcttaaattagcttgaggggtttccaatgccctttacagtatctaaacatgctagtaccagcaagtaataaaactcctgtcttttgcattccttccccattaagtttagttattttattaaccttttcatttttttcctccatggtactatgctaagacctcactgacccattgctataaaagtgttatttatatttccttggatgtcgtgttatcattcaaaaaaatcatagcttattcctttattcaaaggttctaggaatccctaacatcagaaataggaatcattacaatccttttctatgtgttttccttccttgaaaagaatagtatctattattttgataatcttttataaaaattaaacacatttaaaatttcaaatacagagtacataaatggaagtctcaccccctcaagtggattctctgtactgtagctggctcaagaaaggagaaggggctttgtcaagtaaaactggctgattggtaaggttcctatctccttacttctcctttctccttcttccttccctttttttttctctctctctttttttttttttttaatagatgggggtttccctatgttgtccagggtggccttgaactcctggacccaaacgatccttccacttcagcctcctgagtagcagggactataggcatgtgctaccacaatagcttctttttaactttttattatcagaactttcaaatatgcatgaagaaaagtaatgtaataaattcccatgtactcattacccatctccaaaaattatcaatacttatctgctttttaacacattaaaacaaaactcacaaaaatatgtatctctaaaaaataagacttatttttttcttagcctaaccaaaatgactttatcatgcctaaatatataattctttaatatcacctatgatgggtaacttaatatgcgaacttgactgcgccatagtatgcccagatatttggtcaaatgttacacttctgtgggttttttgtttgtttgtttgttttgagacagagtctcactctgccgcccaggctggagtgcagtggcacgatttcagctcactgtaagctctgcctcccctgggttcacgccattctcctgcctcagcctcccaagtagctgggactacaggcacccaccaccacacctggctaattttttgtatttttagtagagacaggttttcaccatgttagccaggatggtctcgatctcctgaccttgtgatccgcccacctcaccctcccgaaatgctgagattacaggcgtgagccactgcacccggccacttctatgtatttttaaatgagattaacatttaagtcagtagactgagtaaagcagattgacttctctagtgagggtgggcctcatccaatcagctgaaggcctgaattcagcaggttgacagttcccaaagtaagagagaattccttctgcctgatggcattcatattggaacactggcctcttttcctgccttcggtcttgaaccgaaagataggctcttcctgggtctcaggtctgctggcctttggactagaactacaacattggttctatggtttcaggccttcagattcgaactacaactatactgtcagctctcctgggtctccagcttgctgacttaccctgcagatcttgggacccacctacctccataatcgaatgagccaattctttacaataaatctctctctttttttttttttttttcttgagacagagtcttactcggtcacccaggctggagtgcagtggtgcaatcccggctcactgcaacctctgcctcctgggttcaagtgattttcctgcctcagcctcctgagtgtctgagactacaggcgcacaccaccatgtgcagttaattttttttttttttgtatttttagtagagatggggtttcaccatgttggccaggctgctctcacactcctgacctcaagtgatccgcccaccttagcctcccaaagtgcagtgctgggactacaggcgtgagccactgctcctggccaataaatctctttctaaataaatatacatcctattggttttgtttctctggaaagccctaactaatacattacctgaattagtatatgttcaattttcctcaatggctcaaatgtgcctttttacagatcatttgtttgaatcagaatttaaataggttctacacactattttaaagtttatagatacctactacatttgagacaaatttatgattttttttccttattatggtatttcttaaataatattgcataagccccatgacacagaatattaaataccaaatttcagaatgtgattctggatttacaaaggtcagaatgcatgtttaaatgtgtcaagactgaacataaagagaaagcaaaatacattcgtattaacactagtatacttttgaaaagtcagtgagttccttttgtgattccaggttccacatctataaaacagaaaatgcaaatattaaatatctatttggccttcctcatcatggatacaatgacggtaaaaggtaacttcacaggattaaatagcttgaaaacaaagtgtcgagaaaatgaagacacttttaatatcatcattgtgatcttcaatcaagaaacatttctcttttttcaatttgcaactggaatcttattctcacatgaaacttgcactattagtgcaaagttgtgcttcattgttaaaatgaacaaaagcaattacattgtgctgtaaggaaatatgcttggtccttgatcagaagtaattctgtcagtataacacgtgctgaaaggcagcaaaggttggcctctcaaggtcactactccagacacttacccagtactattgaggtaactctgtcccaagctgcaatcctttgacagagaggatggattgaaccaaaatgccggcaggcactggccattgctgtgtcgctcataaccatagtcgctgttaggaaagagccgagaaaaacctttcactaggtggcaaaattactgaaaacaattctacatcagtccacagccaagttccacactaatcaattagtcataacaaacaaaaataaaaacaaaaaaaaaaaacacaagcattccctgaatcaatgacttctcaaaaatagaacttttttcatagaatatctatcaattaattattcaggaaaatatcctacacaactggtcattccatttaaacactctcaagctgagagagtagattgtgctctcattagaacgatacacaatacaggtggctgggcccagagaaagctgtaatgagaaaacgggtgtggtggaactcaacccttggtgagaaattcatcgcagagtttaacacggccacatgtggcacagtcctcattactggtgatgtctttgggatgctcttccaagacatctggatctaccaagagaactgagccaggtctctctgtgtacactccatatgcttcaaagttacagccaaaaaggaaatgtccttcaggagtgtctcgagcattcccctaaggaaatgtttcacactaggcagttagcgctgccacttgggactaactgttttaaatcctctctctacttcggaaatagccaaagacttccctctcagcctcctctcattcatgcttccaggagcctctgagttgcctgatattcttggcaactggcagatgaacctgggcacagagaatgacaacaaattgcacctccacatgcacagacaaattgcaggcagcaatcggcaagcattagtatgaactggcccatctgtgtaatggaggtgagatgctggcacacaagggtcagtaagggagaaataggctcagctcaggggcctgtcaccaggcagctggtacttagaattttgcacataccagcaggatttggtgctggttcaatgcagcatgggtaggaagacttcagaattgctgcctataggacaaccagtgtttgcttcaggaagttactttacgaatgctggagagggacaggcaaggtcatttgggggactgtccaggagagggccaaaccaaggagaaacactcagtgacaatcacctttcattacactacagccaggtgtaatcaccgaaactccagctaccggtagaaccccaacaaggttgtgatgagccttcccaaatattttcagaaatcatgcagtgacagaaatcccactggaccagaaaaccttacaatgaactccttcatgattcatttcccacttctcagaatgcatttcagctggtgggatgagtagccgattccaatcacaaatgaatgcagggattgggccaagactaaggggcacgagagacacgggagaggagaaatctaattgccttccttatctggtattcctttcattctggactagcttacaattgaaaaagaaaaacaacaacaacaacaacaacaacaaaagactggcttactttgaagcctgtagaaaagattcccagagaagcaaatgtttcaaggagaaatcaggacattgggacatctcatctcatctcatttttttttttctctttggttttctaccagagaataaatttgcctcctgctaaagaatggctgtttcttaaggcaaaagctaaaccactaatgtaagatgctaacttcctttgcaaatcttccttgaatacagtaaacgaagaagcagcagtggcttcagaaagagggatgcaatgaatgacttaaaatctcatggtagttttccctgtgaatgcatttcaggatgttagtcccaaagggtagtacagagataaaatatttttgtcattgtaataatattgcactgactaaaacagaagtcacactggggaggcccctgaagatttcgatgatttgagctccctgaagatttgagctccaatgtaactgaagctctgttgccctctggctgagcccaaagagatacttcattcgctcttggcttggcgtcctcaccaacaaggggatacagctgtgggttactggtctgacggctggctgccactcttgtcagaccttcttagtactatttattcagagaatatctccagatgtctaccataagagaaggcttaacttttctaagatatgtgatgtgtatgtacacagtatctcagttcagtcactgatattttaatgattcaatatgtaacctgaggttgctatacagctagaaataaattgttgaaaaatgactttagttcttatacgggtcaagtattaattttttaacacatatgtacatatttagcgattgtgttttctaaattaaaaacaaataaacgaatacatgaaaaccaaaaagaagagggaagaaaacaatggaaaatgagatggaaaatatcaagggagttaccacctacttgtcctcaatactttgtaagccttacctgaacaattaacattgacaacaagccaagggcttcacagtgcccacaagctagctttctgctgagcaaatgtctcaagaaggactttatggcactctgagtttagtttaacctctaaatgtctcagtacttctccagtttaaattagcttaatcctggtaaagcaaaaagtctcctttatcactacgttcaccgagttacagatttgcaatgccattgaatccatccttgctctgagttcagcaacatcttccatgaatctcataagctatggtcagctaactacgaatcgaaaacttgcagggacagaaaattttctgccttaaaaggctattattccactacaggaaatcctagattctagaaagctttcatcttgagcatagatgtttgtttgctccctaaaaagtccacttagtgtttccagtgttgctgtttgaagcagcacagaaagaatctgcccattttttttttttttttttgagatagtctcactctgacgccatgctggagtgcagtggcgcgatcgtggctcattgcaatctctacctcctgggttcaagcgattctcctgcttcagcctcccgagcagctgggattacaggtgtccgccactatgcccagctaatttttctatttttagtagggacggggttttaccatgtttcccaggctggtcccaaactcctgacctcaagtgatctgccccactcagcctcccaaagtgctggcattacaggcatgagccaccatgcccggccaaatctgccggtaatgaagataattaccagccatcttccgagtcctctttcagtctaaagaaactcttgattatcccacatacacatacacatagctagtaaactatgaggtaattttataagaatatgaagctggccacttagccctatgtatgttactattatttcaattctaagctttcattcaggcccatgtggatttgatacaccaaatggctccaggagataattgcacaagctcaccaatcaaaatcagcctcagtgcagacacagggttcagattccatagctcctgcatattttccttgcatacacttccgctctgattttcgcttcttatatatcctttttgctcccatgatacatgcttccccctgtaagcagagaaggatcacagatacttgggcacatagcttggactttctctgctccacatgagtgacatttagggagacatttgcacatcttagtgtaatgtaaactttggtagccctctttgtgctaacaacattttccttttgcggtctagagccctattatacaacctgactataaaggcaatcctaacaatcattgaagattattaaacaacatccttaattttgtgtgcacttatcaagcctttatttggcaaagtgttgggtgcagtgctatgaaggacacacagactcagcctgtacctagtgtattgccagtaaatctgcagtaattaagttcaattcccctataataaaagatgtatacagttggtcatttatgagggcatgaaagaggagcattgctaagaaatataaagatcaattttgcctcgatttattatgcctctgcccacacaactttacagcacagattttaatgttcctctaccagacaagcgagagagctaaattcagtgttttcccacaaaataaataaaagctttgaatatcacaatgcttgtgcatcccaaaggagaaaatatcagcaatgtaaatgaacgattctattgttaagcctctgaatagggtgggtgtttccagctaacgcagggcccactatcagacacactcctccttttgtgtttctgaaagatcagagtagaattttgctttatctactgtacaccgtctttcttgagcaaactcactttaactggcttcattatacatctacatttacatatattacttagtctaggtttgaggtatatgacgtttttctgcctgaatatggtgatggctttgcagcaggtacttctaccaaatcctttgagagatctgcggaacgacttgtaccttgggaaatcaagggagagacacttccatccaagcattttgatataagctggatatgtgagaggccaggacaaatgaaagtttcctattaataattctgcattctcataccagaagtaccttgcaaggaggcaaaaagtaccatatagttccaaggaatcaaggcaaaggggaagaaggatttctccggcaacactcacccagcataattttgttattttatgtctctgcttgcattgctagataaaattgaagatatcttcctcatccctgcccccaccatgcaaccatatgacattctcagatgaaatatgtttggatctgagtgctgaactggtatttcattttgatttgtaagcctaagccaagcacatttgaattttatctcattatatcctagcacaataaaaacagaaatgacttcacaacaagctattaatggtgagtttgttcactgctgtggaacacaaatgtgtaagaaaacagtagatggacattttggcctagagcatcctagttcctataccttagcaactagctttcccccaacaccactcatgcttcctgcccaggccttagtctcagttcttttcctcctacctggctgtgcagctgccaaggtctgtagtcctcttcggcacaccgtctatcaaaaatggacttgtaatctactttgaccagctgccattcagagcggtggctgaagtgtccaaacactctacagagttcatggtgataaaaataattacaatgataacaatgtaatgagtaataacaacagagagcatttgtggggcgttcaccctgagctaagcacattacatgaatcatatcatttaatcctcaaaacgcattcatgaagagggtacttttttttttttttgagacagagtctcgctctgtcaccaggctggagcgcagtggtgcgatctcggctcactacaacccctgactccctggttcaagcaattctcctgcctcagcctcccgactagctgggattacaggcacgagccaccacaccaagctaattttttctatttttagtagagatggggttccaccatgttggccaggatggtcttgatctcctgacctcatgatccgcccgccttggcctcccaaagtgctagattacaggtgtgagccaccgcacttggccgaggagggtactattactggatccacttcgcagatagataatatgagattcaatgagttttgttaacattgcaaaaacaaaatcaagtcataataacaggcagaaccagacccagagtatttaattcaagagcccacttgtacatattgtgccacaggattggttgagaaaatatggttgagaaaaacaatcataaatgctgtattctatgtggtccaagattagacttctaggttatcttgctaatgtacatagttcccatggtttccatgctattttactttcccaccagcccctagtgaaagtgatcagcagaaccaagtactaataatggtttcctacactgtacattctactctctttactcagagagacttaagtatttactgagatgtttgaattaccaaccataggtttgaagaaaagccatgaagtggcctgttgggtcagttttttaaaatctgttttgaaaatataaaaattgaagaaagacaaattatggaatgcattgctaatttagctacgtctctcattgagaaaagtgtagctattaggcatattagatttttattgttgttttctaccattaaaaagcagaagtggtaggccaggcgtggtggctcacacctgtaatcccagtactttgggaggccgaggcaggtggatcacaaggtcaggagatcgagaccatcctggctaacgtggtgaaactctgtctctactaaaaaaaaaaaaaaaattataaaaaaattacccgggcgtggtggcaggcacctgtagtcctagctactcaggaggctaaggcaggagaatggcatgaacccaggaggcagagcctgcaatgagccgagatcatgccactgcactccagcctgggcgacagagtaagactccgtctcaaaaaaaaaaaaaaaaaaaaaaaaaaaaagtagtagtggtaggggagagaattagcttaccaagtattgactttggcttgaaagttttcattgatgaccagatcaactactttataaccttccctttctactttccatgtccagttttccaaaggaaggaactctcacagtttcatacttgaaattcaaagtccatgtattgaaacccataggcagcgtcattaatctttcacaaattaatgatcatcacattccagacaaaaatgagtgtaaatgcaatttcacaataacagactgttctcatgattttcctaatatgcctcacaattgggttaggtaaagagccagggaaaaatacaatgctttgtggcattttgatgaaactatgctctgacttaaagcgaactcattcctatatacctgagattttctacatatccaggttctttattactgaagttttaaatgtacagctttatttcctattgaaatcatcacttctaatttctctaagcgcctcagtctgggtctcctaaaaactatcagagaaccaagaaaatagctgcccacatttttcttccctatttgctgtacactcttgcagtaagatgcaacaaccttgaacctaacagctgcaaatcaaacaggcttagctataaaacatttttgtggattactcttttctatgaaggctggaccacatcatacttttcaacttacgtcatgatgagagtctcttctccaggctcacccagaaccccatccacaaaaagtggaatagatgtgaaactgtatttgctccaagatctcccttcatcaaaactcaacctaatgatataaaaaatatcagtcatcagatctccaaaggaaaaaaaaatgtcatttcaaaggaaagatactctcaacccagagataatacattttaaaagtagctgagattttgtcaaaatgagcctttcatatgaataagtattcttaattatatcagaaagtagaaatacagttagccaagccaccgggacacagatgtattaaaacatcaataaaagcagagctacattaaatgagaataactataagtcttttataaaattgttgaaagtttggatattttattatatcttaggcctcaagctcttgaccctgtccaaaacctctctactgtctaacaagtcttacaggtgatcctgaagagcgatgaccttgtaagacttacttagatttcaaccaacccatctctaagtgaccaagtcctcagtgtgtccttcttacaaccataaatcctggttgaccttactgaatgaatgagtacaagataggctcttgaaagcaagagaagataattcttcagtcctgatggtcactggaatgctctaaatgcttgtgtcctctctaaaattcaaatgttgaatatctaatcgccaatatgatgattttagaaggtggagaccttgggaggtgattagatcctaagggtggaccacccatgaaaggaattagtgatcttttaaaagaggcctcagagaagtgccttgcccttccaccacgtgaggatacagcaaaatggtgctatctataaacccaaaagtggaaccctcatcagacactgaatctgccagcattttgatactggacatctcaacctccagaactacaagaaattaatttccgttgtttataagccacccagtttatggtattttgttatagcaggccaaatgaactaagatggccaccgaggaccttttctttgctctgcatttctttatgaatgcccttgcccaagcttagcctttcttttttctctcttttgcagctttcccttcagtcatcaaactgactaacagtagaaggaaaaccaggcttttgattttggacaaactcatatacggagagaaccactttcaaaaacacagttaaaagagcctattgataactcctctgggagttagtctttatacatccatctgtgggacacgcacaggcagaattgtggaatatcacctcaaaaaagaaaaataagaaagcaagatcaggagaaatgagactggagcagaactgtcatgcactgatcatctctgtgtggaatgcaaaaatggatatggatattaaactccaggagatgttatttgggaaaggtgactgcaagaagtcaagctattcagagactatacctgatcatgaacattgttctacctgtaatcgtgctgagagaataatatactggtgagggtgtgagggtgaaagtattatcacatttgcaaagtataatgcaatttctctctcatggagtaaaactctccctctctctctctctgtctgtgtctctctctctttcctacctccactgttctagtagaccttgacattctgaaactggcccaactgtcccatagaactgatgtttatggtttctttgaataaacacagaaattgatcctccttgtcttaaaacttgagaaagttacatttgtcttatctgagttcttctctcaggaaaccaaccatcaggcctcccaggtagtatcaaggagctgaaacttaccagataaagacatctggacaatgagaagccagactacttacccatcatgattgcctaattgacaacttgcttcctgttgaccacttcctcttcctcacctcctcttctttacccttccctaattcctgtttccttacacctggttacatttcttccctctatataaacccctacttttagtcatcagagagatggacttgggactgattgcccatatccttggctgcagcacccacttaaagctttcttcactggcaatatttgttgtctcagtggattggctttttgtgtggagagtaacaggacctgaaccaaacctcggcattttggtaacagatttactacagaaacagacacggtttgatagcctgactcctagactgatcttagcagttcaggaccatcaggtgcagatttcacaggcagcatgtgcccttaccaaagatgtcgaattgggagagatgtgtgtttcatagcaaccaggactccaccttgatccaggtacaaaacactgtgctcttcttcaaagatctggatgaggaaaacacatacatggacacacatccacatccacacatacccaggcttcagagaatcagtcttcacatgagaacaaaaatccttcccatgataaaaataggtttccctaaatctttgcgaaaataaagctatagaacagttcttcccaacatgggctattataccattggtgttgtacaaaataattttaggtgtgtataaaataaatttgaacaatgaatatttatgggttcatgcttagattccttcattttcatgataatttctattgattcccagttatgatgatgtcagaatattggttaactgtcatatattatacatctctagacagagggaaccttagaaatcatttactccaatagtctcattttcataaataagaaatctaaggtttagagagatgtggtaacttgcctgagatcatgcatacagtaatggatagagcttggacttgctgcattacagtgccctttccagatcttattattttgaagtttccaactgttatcaaagaaaactgttcttgtttaattaatagatgttccaccaaaatcatggtgagttctgttgtcatctttgggtacatgtgtcatttggtctttctccaaatgtagagaaagaaatttgaagtcaaatggagacacaatggaaacaatctctagatcctttctgtataagatgcatgctgttttctcgtcagattattagtgtagccttgcctggagttacattacagacaatcttcttccaatttgtttatttcttatacccaagatgcaacccaagactatagaagtaaagacttctttgccttgcttgcggtgttggaaagaagaaaatgggatcctggctctctattctccagaggaagtttacttagaatagtccaggtttctacatacctccaagatcaattgctatggagtttcttatgcaaatttcttcccttcctcctccgctcaaaatatcagaatcccactgaggatctatagagggtctgaagctaagaaatggcatttggaatataatgtggacacctctgactaaaatttaaaggagagtgctctcatcactaagtgtgattacctgtgcattagatttcaatttacagtgctagttattgtatgataattaaacgtcagtaggttattaaaacatattgattgaagtataacaaccaagcattaggtgcatatcttgttaagattgctaaacctcattaaatgcctgttttgtaagctatgggtatctaattttcattcagaagaaaggcaggaagcacttaagctaaacacactggtttaaagtattccatttctactttctctaacatatgcatcctgatggttattactctgtcttttgcacatgagatttaaacatctcagaacaccacctgggtaatggccatttctatatctgcattccttcctattctgacttcaaggcaaggggaatttatggagccaactcagcattagatatgtaatctacccttaaggctgcatattccctatatgataaacccttaggaattctggttttcatctgtgggaaaaatttagtcagacttaatttggtttcattgtgacttataaacacccttacatacaagctctgagtaaggaacatctttattaaatgataaaaaatcaaattccataaatatttgctacactccaacatttaagacttttatataaaaaggaaaaataaacatattcacagtcattaggatttatgtgtagcaccgctgaaaaaagttcccagatttgaaccaagctgggcaatttttatgttacttaaacttcagcgatttgacccagggtattttcttacctgtctccaggtgttccctgcatctgaagagacaaacatgctgatgtcagtgtctgacaattcagaacctatattacctagaaagagaaaggtgccattagtgaaaagaactttctgcaaaagcaacaatggactatattggcaggtgcactgcctgagaaagattttgactgcaagcattctgtctgtgcaggggttttctgcagacttgcttcaggtccaatggtttaggtgcctttcaaaattatttttagcttgctcattaagttccaagtacagatatctagcttcttaaaataaacttccaagtacagatatctagcttcttaaaataaacactatttaccacagccagcaaaccaggtaagcttcttacctgatgccactatgatgcttggagctgtgtctttgctggcaatgatccctgatgtgtagggattctcagagaccttcaggtgaaggtgtagtgagcaatagggctgaaaagagaaataataagtgccacaaaatcacataatcaaaatggtcatttgaagctcagaatcagatcatccatccatctaaccaaccatcccatttaccatacatccatgcaccactccaaccacccattgtatctatacctacccaacatcttccatcccccaaatatctagtgtccactaagtgtaaaacagccttcaagttagtaaagaccaccttcattttaggtataatctaatttggtctttgtcattacagagcttacaatttatatagagggcatgagatccttccattaattaccataaaaagagaatcttttaacagccataaaaaatgaagagacaaaatagtatgagattctagaaggtggagagactatgctgaactttgaatcatgaatgactccaaaaagaaaacagtgcctgaagcaaagatggataggctatgaacagtaggtagatgttcaagacgttaaagaatatttcaagcctgagtaacagcaataacaaagaaaaagaagcagaaaagctgagcagcacagtatgtcatcagaaaagactgaagaggagaaatgggatatgaagccaggagagaaggtcaagtcaagctgggaggattttgaaaaagtaggttggcatctcttagtcattctccatttgagaccttggtctcagttgtatagaaaaagtatgtgaaattatccaaatacccgccagacaactgacccagtatctctaccaggatattatcagaatcagaaatattcaatataaaagtcacacttgtagacaaaatgcactagtagtaaaaatttaactgaaaatgtaagggacttgtttgtgcagaaacctcattcaaattatctgattgaaatatcaacagttttcaagaaaaaaggataataaatcttatatgaattttgtttaaaatagttcttgtactgagttgtcaaaaaatataagtttgtgtttgagcccacatttcttttcatatctcaggaagattactttctaatcttatcaacttgagtttctggaatcaccagtgtatctctgttattacttttattctgctctgtaagtttcagccagcagacattcagacacctacagatacaatgattaaatttatataggatggagtaaatgacaaagtgaaaatgaaactcaggaataaaaacagccagaacgctggtgaaataaaacagcagatcacaatgggatattttctttactgccaacaaagtaaaactctcaaggtgcactaatagtaacaaatgattggttttgcataaaaatttcatgtaaagctttcaaaaaaaggagttttgactttataatgttctataggactaaagaagacagcccctattagaagaaatatcaggcctagactcttggcttttatttgtccaagaggaagactagaacagatataattaaatgctgtggatgttccagaacagcatagtacaacactcagatgatgtaagacagggtaaaccaggagtgcaaaaccagttttccatgaaagtcttcccgataactgcagcctatcaggctctcctctcctctaatccacaacaatttgtttcactatgcacaatcttgtattatctatttcaggtacatacaattatatctctctaagaatacactctataaataaagataactgattaagtactgtttcgcatcttttgtgaaacctagcatagaatctaaacaagataataaatagaagcttgcaatatcaagtaatgcttttttgttgggacatgaaagatatcactttactattttactcagagcaatgccaggagtatgtgggctggattatcaaccacataatctgaataatgttgtgagcatctgtatggcattccaagaagtagactactgcttgcggattatccctagacatatgagcttaacagaggactttctgcaccaccaaacagaggaggacatccctagccaggagagcacccaactttcaatcttaagccagttgcttgccactgctggaagattttgagttatttgccacctgacctaaggattatttggtaaggggcagttgccattacaaaagaaagatgtcaggccgggcatggtggctcacgcctgtaatcccagcacttcgggaggccaaggtgggtggatcacttgaggtcaggagttcgagaccaacctggccaacatggtgaaaccctgtctctactaaaaatacaaaaattagccaggcatggtggtgggcacctgtagtcccagctactcgggaggctgaggcaggagaatcactcaaacccgggaggtggaggttgcagttagccaagatcacaccactgcactccaccctgggtgacagagtgagactccatctctaatacaaaaccaaaacaaaaacaaacaaaaaacaaacaaacaaacaaaacaaaaaacaagaacaaagaaaagatgtcatttttccattggctacctcagcatgcctctgttgctatggctttcagagggctgggatacattaatctgaggaaaaaagacaccagttcactcagtaacagcaacattagaaatgatcttttggtgtacttttttctccactctcacatttgtagtactggattgcccccagctggtataaggaaaatattctgtggcttttttctttcattttcttcaaggaagtaacatagtctacacaaatatttaaggaaaaaacagtgtgaagtgattcatcttcacttttttaacttaagctgttgtactgaccagttttggacatttgtccaagttaagtcataaataattaatatagtttatattagtatattttattataatgcttatcaaacccctccaagtttctgaaggacacaggacaaagctctccagtccttatgcacattttgcccaggctgggggcacatcataggcccctctcttcatttctcttgtcttctgccttcttttctctcattagcaaatatgtgctgagtacctacatatgctaatagtcacaatagttatctccaagtcaatagagtcaaagcacagcctgttccaaaggcagttctctattttcctgacctttccacattaagaaaatgtagaaatgtacacccaaaccaccaatgccagcagctgacctacagaggacagaatgaccagcacacatgcttggaagctgccctttgcatcctcacacatagtcacaggccatggcatatcatcaattggtaaattctaggagcaactagactgttagtctgtaatcttttctgggtcaggtacaaagtttggggatctgatgcaaatgaaagaccaagaaaaagtgcacagacacaaccatacagagtttttcacttaatttcagggagtctgcaaaccccgaaacccataagtggacctctagttactagttacctttctttgcctgattcttttaaccaataaaatactttggctattccaagtgttcaataaatgtctgctgaatttaactgatccattattattgtttacttcaaatatttatcatttattcctcttgtctaactgaaacattgtaccctttgaccaatatctccctatttcccccaacttctagcctccagtgactaccattctgtctctgcttccatgagtttgattgttttaggttccacatagaagacagaaatgcagacttggtctttttgtacctggcttatttcacttagcataatgttctccagctgatccattaattatctactgtgtttctagcattgtggatcccactggggaattaccataaaatggaagacatttccccaccatgtaataaatcaactttaaaagctgttatattacttaagggtcaaccagcttcaaatcccaattctttctcctcagcctctgtatcaactgcctttagatgctatcttcatggtacctttatctccatggtatctaatctgaatattgtactgaaaggacagatcagagcttttgtaaagaacaagctcccaaatagtatccccaacactctccctcccgaaatacatactcatttgtataatttctttctttgagttggaactcaaatttattacatcttcaataaagagtcaacggcaaagaggaaggaggcccctggaacaactggctgggtatggggaattcagctccagcccaaatcagcaaaatatatagagtcacagacaatggaagaaaggtgaaaaacagattctccaatggaagaaaggtgaaaaacagattctcctggggcagctgtctgctcagctccagtagcaaactgccagataggccgggcacggtggctcatgcctgtaatcccagcactttgggaagccaaggtaggtggatcatgaggtcaagagatcaagaccatcctggccaaccaacatggtgaaaccctgtctctactaaaaatacaaaaattagctgggcatagtggcacacacctgtaatcccatctactcgggaggccaaggcaggagaatcacttgaatccaggaggcagaggttgcagtgagccgagatcgcaccactgcactccagcctgggtgacaaagtgagactcagtctcaaaaaaacagaaaagaaaagaaaactgccagatgaatccacaaagtcagcgcctctttccattaaacactgtgctttccctaagggcccaaggatttgtcacaggctcagttcagctcacatcttgccccttgggagcccaatcctgaggcattggacgcaggtggaccatgacctgtaatattctatctaattgtacaatgcagtcttcagaggaaagaaatcccagctgggccctccaggcaatcagtctaaaagtcctaaaaatatagcccaaattaccctagatgttttatttctatagcatagatttttaccaggaacactgcattcgggctgcaattctgaacttattccacatctgtaacagccctgctgaaaaaatctcttttctaatcactaggctgtgctttcagtgacactgtcactttccaagtactcacaatcgaaatcactttttatctcatctctgccaccagctcccaagcctaaagaaggtttttaacagtcttcgtctcctgtagctcaaagattttctttcctatttagtgcctttggcagatttttgtaaagtgattttggtctctcctccctgcttccctttgtcattttccccttctcacctgcagcctgctttctgaagctcaggttgaaactacattaaacaacagggttaactaagaaggaaggctggaaaactcccgagttccatacatctgtgtcccaataatccctctttcttccatcttaatgagcttcctgcttttgttaactttgggttccacttgagcccacgagcttcagaaggtagaaaatgtgacaaatcctccagtggactctcagagggaatgaacagcttccattaaaatccaaacgcgaaactgtcacaacacctttcgatggagtgcacactcccaacgtggcacccctaatgttgagcccctaccacatgggttgagcccctaccacatggcaggtatgattcctggagttgattctttggagtggtcaaaaacacaggcaccgtccctaggttcatgaagcccacacttcagcaggcaagatggacaagaaaattaagtagtacacctgctcatttcagataacaataaggaccatgaagaaaaaaagagttaagacaaatacaactttaggggatgctcaagaaagttctctaaaattaagataatgaagcaatgatctgaaggccaagaacaagccagacaaagagaagggcattttaagagaaattataacaaatgcaaagaccctaagagatacatgaacatggtgagttcacagtatgcaaagaaacaccccctcctccactctggcttacatataaggaagaaggggaggagggagaggctggagaccagggaggagaactacacaggggccagatcacatggggcctcatcggtcatgataaagtatttttatttattctacatgtattagaagccattagaaggtttaaggaaagaagggatacgatctgatttttcaaaagttcaagttgataacatttacacacaattttaaaaaacagcaatctgatatatagtaaaataaagtggatcattggttgtgctgggctgagagtgtgggttctaactgcaaagaggcacaaaggtatttttcagggcaatggaaatgttgtcttgattgtagcaatggttatatcggtatatacatctgtcaaaattcattgaactatactcttaaaatcggtatgtaagtatattttacctcaaaataaagttgattttttaaaaaaaatggtcccattggctgctgtctagagaagtgattgccaagtaaaagtgggaggaccagttagaagcctgccactgtggatcaggtgagcaacaatgctggcttggattagggcagtcccagtggtgatggggaagtaagctgatattacatttatattttggaagtacaacaataagagtttctgacactgcgttgggggtgaagcagggaataccttgctaagtgcttaaaagccatttttaatggttcatttatgatgccagagtccccaggcaagcccatttaggtgacatggttaattatctctcataggcatttaatctccaaagtgcagagtagagaccagcttaaggaactggcatatcccatgcatctttggttaagcagcactacgctccaacttgctatagctgaactaggaaggtggccctgttttttaaaatgccaccaaactgtgccttgcgtagagtaggtattcaataaatagctgctacatttacttactctgtcactggcattgtgcacttactataacaactggctttttcctcctcttaagttgccagtaataaggatagaagctgagtgggaggctgaattttagactgcttccctgatgcacagtgacaactgtgatatcctctgcaactaataaggtcaagctatggctgctggcatcttctcaactagaagggtgacccgcctacagctgtaagagatgaacctgcaaagtgactgtccagactttatgggatggaaggaagcaagctgagtgcggataacatcaaagtcagaaccgcatgaagagtgtgaacaactatatatgtgtagttcatacacacacaaccccctcccctacaagcccttcttactcaaatgaagtggtcctccctctaggcttacacaatcagctgtcctttttctaaatgtagacacaacttctgaagtgttttacagacattgatagtattaataatgtttgcaatttgcaatttgcctcttcctcgcctccttctgcattcactcattacttatctgtgtgtcaaaattggggcaggcatcagagctactaagaggaataagacgtgaccctgcaatcttccatttattaatctagacacattcaagtagacaagtagactgcaaactccttgaaagcaagattcatctttgatcctccttttggatgccatcatatatcaaatatataaataaattcatactaatctatatactgcccaaatgtaaggcaactaaaagaaagccatactttaaagtaggggtcagcaaacctttgtaaagggccagataataaatatcaggctttttttgtgatacagataataaataccttggcctttgttcaccaaacaaagtctctctcgtgactactcaattctgcctttgtagagtgaaagcagccgtcaacaatacatgaatgaataagcatgactgtgttccaataaaaccctatttagaaaaacaagtggtgggccatatttttcccacaggctatagtttgccaacttcagttttacggagtaagacataaatgaacagaatatattgtaaagaataccaataagggtataaatcagtggttcttaccttttttgagtcataaactcctctgaaaatatgattaaacatctccacaagaaaatacacctacacgactctgcattcagttcatcaactctacagctgaatttatgtatcattagttctgcaacaggttactcatgagaaaataggttgttcagtgtgtatcctcaccagggatagaaactgtcatattctccctcaaactaccatttgaggccctcatcagaacttgggcgggaaacaaggatcctggaagggcacaagaaatatgcccatgttctcccatctctttggcacatcacactaggcagtgctgtgagttttctacaccctttgccttcacgcccttccccactcccttttgttcatcaactgagcaaaagtcccagaactatcctcaccctctgttaaatatccatttccatccctctactgtgtgaggcattctgcttcaataggaagactcaccagcaagcagtgcacggggtccccccttagatccgtgtccggcgcctgcagcaaacgccagtctctgcctttgttatatgtgatgaaagtcttcacttggttgtcaatcttcttgttagccaagaacattccctttatccctgctacctgggaaaaattgacatggctgaaaaatacatcaatttgagaagggatatatttgtttactttttaaaaaaagaaggctgtcaaagtcagctgagagcacttgccttggaggaaagaaaggttgacgatgggggaaggaggtggctcaaggtataatgacttcctaggctactggacaaacaacaacagattggtgatccttatcatatgggggtcacaacaggagtttgataggggtttcttattacccctaacataggctgacaggagcccgcagttgccaagagataaattctcatggtttcagctctgttgcttggtaagtaataataaataaataggggctacttctattgtatgctagtgtagcacccagatctcacttaatccttaaaacactcctctttggtatcgtttattctatttcacagatgaagaaagctcaggctcatccaaacaaagtgacttgcctaaggtcacactgcccaagggcacacagtaagtatcagactcaggattattaacccacaactctgcggcttcacagctcatgctcttaatgcctacctcaattatcaagctatctgcaggcttgggcagttgaaagaggcagttaaagctcctgaaccaattactgttgctttatttctatgtaagatctctctgttaagccaccagaatacacggaacataagaggacagcttttaaatttaaataaatggtgatttccctaaatcatcaaatactccctactttgtttttataacatggttgttctcagcctaaacagatgctattaattatttggctctgaaaatatgattgtctcctcccttctatatgttaggtaagaagtagtaattagtaatttgtcaaactattacaaaagcaaataattgtgcattacatttttcttgtgttttggagtttatcaaacacattcatgcatattttaccctgcttgcaactgtaacagctcaggaaaactggagggcagtgaggaaaaggactgaaacatgttgagtaatgcattccaatgctgcatgtacattacctcatttaatactcagaataaccatggaataattatcattagccacattttgaggatgaggaaatagatactttgacttggtggctttctggaacacacctagggagtaagtgagcaggctagcaagcctatttgaacctacttaacttgggccctttataacacgaaaaatttttaagcagaatagtgaagcaattagctgtcacctctccagacctcgccaaacgccaagcactatgtccagcattttatttacaaaacctccaatactcactacaaacctgcacctgcagcttttaccccaattctacagataaagaaactgagatcacagaaagttgagattcacacccaaatctgcctgacttccaagattgtttcaacaaatacagcttgaatttgtcaattctaagaggttgggtttcaatcgatagaagacacacattttgcctttgcttttgacagtcagacctcattagtgtgtacctgctgatctggcatctgggataatttatagttgggccaaatttgtactcttttgaaacaacaagcatgttaaacaactaaatggtataaatgagctgcagagaggaatactttgaactatcatactcaggaaacaaggtgcattctgtgcaatcagtagcagccagaccaacttcttgtgcattgtctaaactcaacaaatgtggaaggcataaactccaggagcactctacctcacaacagcagtgtgttaattacaaataatatttagtaatttactacaccagctccgcaagggcttcccaccagggaattccatattggttttgtatatgttcaagaagctgttacatactcaaatatgaataaactgccagttctttaaaaaattaaattacgtaaatcagaatttcacaaagtcatactggtccttcctctataccattcccagaaatgacaaatgaccatgtcttagccattcaacactctaaagggtgacaataactgcagaaggaataaaaatgttacctattccagtagtttcattgcccattttccttcctgccctctccctcttctggcaagggtgccagcgcagggttatacatgtttgggagctggttcatttgattcgcagaagtggcgactttattggcccccgactgcttggcattatcaaatgccacttgagcaaagagctgtgctttgtaattcatctctggcagcttggccttcaggtttatcttgaggaataaaaacttggcaaagtaaagggaatgtgtatcgacaggggatagagctggagagggtctgcttattgcttattttcctcttgcagccaaggcactttgtccatttaaggtagggttttttattttgttgttttcttttgttgctttggcctggtctgcaaatgtagtcagccctagtcttaggtttttgtgctattcactgttcctttcactctgagcttgagaaatccgtctttctgtgtgtctcacggaaacccctaggcacgcacaagccaccttcttccagtactctattctaaggtctcatcctacgtttcttggaacctctaccctctcactgtaggactttggctatcaaggggactaataccaagcattagtgccccaaatgtggaatgtgtgtgggtgtacatgggtgtacctgtctatgcatgtagtatatgtctctctttgtgtgagtgtaaggtctgaggttccactgaggatgagggagcatgtttatgtttctagataacctctctgtatccatactgcatgcatatttatggaatagagtggagctaagggatggggtagggtggggtaaagtaatatttcctacggaagccatgtcttcccatagacacagaatttctgatgacaaacctcccatgggaatggtacatcccactgttggaagtctgtcctcctttgggaaaagaattgttgcctttaatgcccttctgaattctgcataaagatctttaagaattctaagtgtgctggaatgctactttagtccctttgcttctcctacagagaaatttgctaccagacatctcaaaagtaattaatagttatttcttattatttaatatcatataagtcaagatatcattttaattagactaaatatgaagtgttatagctcaaaccttaagcctaacacaaagtacatcggtgcatttcctgttgccaacgtgatggtctcagaacacttccttcccttctcttatctgactctctttgttcacaaaggccacccccaactccctgagaaagcctcctgatgtgcctctacctattcatccttaaagattcagctcataaaccttttccaaaaaccaggatctcttttcatcctgattatcccaacacttctctgttctttaatttgtctctcatacagatggtatctgtatcttgactgtcaagaactgtgggatcttcctaggggactcaatattcctgtaaacatctctagtactccttatgctctttatcataaattaattccaatttggtcatcccctgtgtgacctctcacattatggtctcctactctaatacaaccttcggattgtcattcactccaccaacctgctctttaaaattaataacagtaaagtaactttatacaaagaaccctgtttgtttgtttgtttgaaacagggtctctctctctctggcacctaagctggagagcagtggtgtgaccacagctcactgcagccacgacctcctgggctcaagcgatcctcccacctcagccttccaagtagctgagactacagttgcacaccactatgcccagctaattttgggttcttttgtttgtttgttttgttttgtttttggtagagacagggttttgtcacattgcccaggctggtctcaaactcctgggctcaagcaagccacctgccttggcctcccaaagtgctgggattccaggtgtgagccacagcgccagcccctgttttttttcctactgaaataggtagtaagagttctgcattagaaggtacaacacccaagcctctggtaaccacgactggggagaagatgcgaggaggagaaatggggaatgactactaatggttgtggagcttctgtactggacaatgaaaatgacctaaaattgtggtggtggctgtgcagctctgtgaacacactagaaaccactggattttacattttaagtgggcaaactgtatgatatgtgacttacatcttaataaagctgttttaaaggaaagatataacaatccaaatttattgattattaaatttcaggtaccagaggttgaacatccctaatccagaaatccaaaatgctccaaaacttggaatgttttaagcactgacatgatgctataagtgtaacattctacacctaatcatatgtgatgggtcacagtcaaaacacaatcaaaactctaaagaaaagaaaaatatttaaggtgatgaataatctcaagtatactaatatgttatttactaattatataaatgtattaaattattatatataccctgaaaatgtgtgcctattatgtaccaataaaaaataaaaaataaatttctagaatacaaaaaaactgtttaatgcacaaaattattaaacatattgtttaaaattaccttcaggctatgtgataaggtatatatgaaacataaattaaccctgtgtgtacacttgggtcccagttccaatatatctcattatatatatgcaaatattgcaaaatccaaaaatgtctaaaatctgaaaccctactggtcccaagcatttcagataaggtatactcaacctgtacatgaaaggctttgcaaacatgaacttgtgaatctttgcatgctttagaattcatattatccttattttacagaagagaaaactgaaattcagatgtggctaatcacttgcctaaggtcatcccattggagaatcttagatctggactccaagtcagtctgtctaactacagagtctacacccttaggcctgtggctgtactgtctcttcgaacttctctctcatcctagagtggcctgagagaaatatcgtatcagaatgttctactcaaagaaattgtattttattcagtcgttagtacatttactctagccattcaataaatattttctgagcatctactacgtatcatatgatcttctaggcacttggcagatataatatgtagaagatctcaacaactatcttttttgagagttagaatgtgctaggtgctgagaattcctatttctttggtgacttaaagaaaaaaacacaggtatctcccttgctttttaggtttactttctggatggttctgtcctgttcttatgggaatcagtcttcccataaatatctctagtacttcttatgctctttattataaatcaattcaaaggaacttacatatttgtgtaagaaaaccttttgtaagttccatgcagaggctaagttgggaagactcctgtgcaagagtttttgcttatttctgcctttaatgctgactaaaagatgaatactacctaccaccctctcagtctcagacttaaattacaaatcctaagtgccaaaatttcaaaaaaaaattaaaaagatgaaacaacgactgtggcaagaaagagaacatattcatggccacaatttctttgggctttgtggatgggatatttttctcgagaggacaacaggaaggataaacatgaggccggggtgccttcacaatcagggaacccactggccaagaaaaacctaaatgttctttccttctctgttgcctcaaccaaagagcactctcctcctcaaacagcactctcctcctctagagacagtagcctgaaataatagtacattcttttattattattatttttccttttttgaggaggagtcttgctctgtcgcccaggctggcaccatctcggctcactgcaacctccacctcatgggtgcaagtgattctcctgcctcagcctcccaagtagctgggacttcaccacacccagctaatttctgtatttttagtagagatggtttcgccatgttggccaggctggtcataaacacttaccctctggtgattcttctgcctctgcctcctaaagtgctgggattacaagcatgagccactgcacctggccaatagtacattcaatatcctgtaataaatgtatcttcaataggacagcatttttcttccctacctcctaaactagattgtaagaggcagtcttgctccaaaaaatcaagatgtatgctatattatcataaccgttgagttttctcttttaaagagagggtactcataacgtacagaagacactgtgtgtaacagaacatgccctggtcactggctgtccttcatgacacccaccagggctcactcatgtatgcacacattcttgtgtattctgaatttgtcagccaggtggcttcactcccaacacaaccctttgcactcagctggggtgaactgtcattgtctattaagccaaagtgctcttcatcatcattaattaatattcacttcccaaaggagagaaggtaccatccaaacctgtcaggctccctctcatcatccacactacacaaaaccatcaggcatcactcttctcacagacactcagcacattttttttttgctctggccaccatcagacatgcagcctgatgcactgcatgatgcacacgatgcaccggaccattcattctattcaggtgtgatggagttttaggacacttgtttccaggcttttcttacacaaatacatccacccgacaagactgtgagccatgtgtaaatatagcctgaacttagctgtaactaaggacttggtactaaaggtgctgcatagataggtctcgggcaatcaaacttctgattctctttacattgacttttccccagatcattttcttcttccagtcttctgttttcactggtatgcaaagtctaaccctatttaccctgcccttctacgttcttcagtcttaatgctgtcactcttccacaaccaaatacaagcccagatgctgatccttcaggaaaaatgtgacagtctatagttgagagtttgcacactctagggtttaggtcctaactctgccacttaccatctttgcggtcttgcaaaagttgctgtattccctctgcctccatttacttatatttgaagtgaaagtgacaacagtccctacctcataatgtatgtactgaatgggagagttatggaaggttctttacaccatgcctggcataaagtggcccaaaatattagccattattaatgatatcaattaatgatattaatgataacaaaattcatttctagtatttttgctctgtggccaactttcctggctctcatttcttggctctcttgaatggagtccaattgacactgatggaaaattctgatatttcaataactaaaccatacaagctgtaccctcaacactttgtctccagcatttctctctctcattccacacacacacatagttctagggtagagaacacagaatctgtagccaggttccaatgtatttgcaaacaaaatgcttaattttaatgagcacagtgcttccttctgcattttttagaaagacccgtcagcaatgcacatccttgatacacagatccatctacatgtttatacattatacagttcacctctgctaaaatagcctgaagagctcacaaaggcaggaatagcacataattggcatgaagaagcaaacaaagaacaaaggccatcctcttcagtcaccccaaatgtgagcagacatgcactccatgtatgctatctctgtaacccccacctcatgtgttgctcatctttgctccttagtaattcatttatggattttcttacttctcatttatctctaaactctcatcattcattgcaattctactgggaaattcatgctggatggctttcagcttcctgctagccagaacaatcagatttaagggaacatttgtgccaggctctgtgtcagccaatattctttctatctaggtaatcagcagatacggcactgccgttctgatcacatcaatttcaattcaagttgctgtgaactgtcaggctaataaaacaaagactcctctctcccagccccaggatgcagagcacctttacataatacagtcacatcactgctcaaaatgatgataataagagccagcagtttccctacagatagtcaactgcaagagaggcacaaaggggaaacacaagattaacaaagcaatgtttggcatgtccagaggtcgccttgtttcctcttttcatttcatacctgttaccgatgtttgaattcagaaaactagtcatgaaaatagctgcaaacaacaagacattgcaaagtcattcctgtctaaatttgtcattttttcatcatcaagggaccaattaaaatggtttttatttctggcagtaaacaaaatttatccagagaatcaattccatgttgacacaaaaagagggaagaggataatcaggaaggggaaaatggaacctgaaagtcagaatatgtttttgggagactaaggatagaacgagggctaggaaagaaaactggggattaagcttgggcagttgctttgacttcatgccagtggatgctcagagcaagaatccttccatttcaagtgttcagtcaaggcaagaaaatgcatggcatttcaacaaaacatacttcaagttaaaatgtttataatctatttacaaatgaaaagagaaatgttgcaatttacacttatttataagaagacagctacttggtataggccataatcccagcactttgggaggccgaggcgggcagatcacaaggtcaggagttcgagatcagcctggccaatatggtgaaactccgtctctactaaaaatacagaaattagccgggcatggtagtgggagtcccagctactcgggaggctgaggaaggagaatagcttcaacccaggaggcggagattgcagtgaaccaagatcacgccactgcactccagcctgggtgacagagtgagactccatctcaaaataaataaataaataaataaaagacaactacttggtataaagaatgtcacgtggctgcactaatttcagtatgggaagatgtaggaatccaaaataatataaatgttttgggcatttacacaatgcagggagatgttaaggctatgagagtagaagaacactgtagtggtgcttgaacacattggaaaataatattaaagccctgtgctccgtgctttgaaaggattaactcatttaatcctcagaaaaatcacatctagtaggtttcatgtttatctccatattttaagcaacgaaactgtggctcagaaattactggatttgtctcaagaatacatacaagtggcatcgctaggatttaagcacaagcaacctaaatccaaaatctgtactctaaattaaattttattcaacatgaagatgaaactaaatcatcacaatatgtaaatttcttctagaatacagtctgaggctgtcatacatgatattgtatttatctgaaacatgggcaggagaagaagtggaaaaacttatgaaagtatgaaaaagtttgcaatgcatttttctaaacatatacacataaactagaccctatgctagtctgccataatttctattacaaatacctgggctctaaatttggcatacagtttactaacatgcttttatacatacacagaagtttagatactagaagaaaatcactaagaacctctgaacgagaaggaagatagaacacatcattgaaaggaattacaatgataggttaaaatttcttaagtgaaattagtttctttcatactggatatacccttacttcttagacaaacaatctcttgactcactgctcttgttctcaactaaatgacagtgtcattatgactgtacatatctgaatccattttagatttttttcagctagaatataggtatattgttacacttcccaaattctgactgttttcaaatggcttattataacctattataaatctttcatagcgcatgataagagtaacgaatggctaaaatccatgccaaagcagcagttttctttctagctaactgtgccttcaatggcaattaaagcattggtatttatcatgaaagccaaccaatccaacatacatgattttcttttgaatcttggccattttgagaaataaagactctgctaagctctgttcttgatgttgtagttgtttattttatttttctggatttaggagacaagcacctgttaatcttatctcattctctggccctgtgagaaaaaggccattagccaagggagcttatttaaccagaaaggtcttcaagtccaaatggagtgtcttctgctggatgcaggagaccttatccccttcattctttcttctgagagacaagggagtgcatccaccatccctttactcacagccctgtctgcctttcagaactatgtccaaacatcacaagcagaccactctcatcaaaccctgtaattgactgcctccccagacattccgcaagtccacaaagccttcatgtcctatggagtttgtcaaaaaagaatccctcccagaatcccccagagatcttctgtggattgcaaattaactaataaaaatgttctgcaaatctttccatctcccaagagaaatgaggccacataaggaactgtattaaaatgaccaggaaaagagtccatgcggggcttccatcagccagctgggcactgctgtggcttaggaccacatatgcctcgtgacatacctcatagaggtcgatcatgatgttgccctcagggcctctgctgctctggacattctccaaggccagggtgaagtagacaccacgtgtgtctgagatgtagaggttgtacgtgtcattctggttccattcttggaccgctgcgaacacctgattctcatcggtgctgataacatgcatgtcctgtgaaaagacacaaggtcgtgaagagggaaaaagagttttatacattaacctggcaggcatccaaagagtgtggaatcaaatgaggaataccagaatgagcactttaatggaagatagcttccttttgcatatataagaaataatagttaagcattaatcatatatttcctttgtcacttgtggggttaggcaataaggtcatgagaaaataggatgaagggatgtttgatagaccagttttaattgcctcattacataattcgaaaaatgctttcttaaatatgtatgattcggagaatcaagcatcctgatatttttgccaagcacaaatatgatacttgctcagaaggcatatatggggtagatatgaggaaaagctggaggaacagagagaaaatagacaaaccctgcatgtctcagcatggctcatggaccagcagcaaggacatcacctggaagcttattaaacatatagaaccttgggcctcacctggtgaatcaaaatgtgcatttaataagattgctaaataattaccatgcatattaaagtttgaaaagcactgcccaaaggttcagcaacccctagccagtctcctctaccctcagccctaagaaaacattcaccagagaaacccaaagtactaaccctcatgttagtgtgttcaaagacttagctgcttatcaaaatctaaactgagaggttctgcaggaatcctccagtgaaaaagggtaaaagatagcctgcataactgatgatgttttcagagcctgtttgtcctggaagatagaattaaagcaaaggtagcgcggaggcagtaacaagtgcccctggggtgggaatttcaaattctttttcccccattcataactctagagaagtacaatggaagctaccacagtccaaagcttgctgactcagaccaaggcctgctttcttctttatgggatgtctgttcatatgctctagcctgcattttaccctttgcccaagatagtagtcataaaacaacttccaaaaaccaaaaaaattaaagctaagtaaccaaaacaaacaaacgaaaacaaagattgcatataaccacaaaggtagaagaacaacgtagaacaattcttgttttcggcatcacttagtgctctaatctttccagatgcaccatactctatttttgaaaagctttaggaaatctgacaatcttcctgttaacaattccagtgcggggaaattccacctaactactaacctaaatttcttattgtcatatatgcccatgttctcaatcaagcagcatttcagctctgactctcctctagacgtgtaggaacaagactccctatcctctttaccgtttatcacagtaaactcgtgatcccagagggagaagtccatatccaaagggctttatattcctcacctctactcaggttccatatgacatactcaagtttggtaacatttttgtagaaagaaccccaagtggataggtcaaaaaatgaatcctgcccattaatttaatgtgtgcttctatctgttgaatgtctatttacatttctcctggtaattattgctctctctaggtatctgcagggggattggttccacaattgccctcagataccaaaatccacagaagctcaagttccttatataaagtggtgtaatatttgcatgtaacctatgcacatcctcctgtacacttcagatcatctctggattacttacaatacctaatacaatgtaaaggctatgtaaatagttgtatcatttatttaatttgtattactttgtattttttttaatattttcaatctgatgcagaacctgaggagacacaggtccaagtgtatggattgatgttttttgaaaaacagcctcatccctctcagatatatttctatattaaatctaaactttttcctactttcttctaccagcagcacaagaaatgagcttttagaaccggctttcagaatattccatttctctggcaacagcaactgaataggtgatgggcaggtggcccacataaggtcaatatgacatgtttctggaatgactgcggagttattagggagagacaaaattagtatctcactattggtttttaagcagtaagaataaaaaagaaaactccagatctgctggagatatatcttggaggtaaaggatgaaaccaatcctgatgaaaacaggctcagcggatggagagagatggcccaatcctgtgacatttttttggtccctaaatgtggacatttaagaagctcatcccaccgccagacttttcagttaaagaagacagtctagtaaagtggctgaagaatggactttggagtaaaactagttgagttcaaatcttggctctataacttagccatgtgaatgaaactctgtgtctcataatttcaatctacaaaatagagacaaggataataggtcccccatggagtggtgaggatgaaatcagttaatcagtgttaagcactcctaatagtgcctggcacttagcatatgctctaggtatgttagctactctcagttaagtgagcccttacatcccttttgttgattaatctaggttcatgtgacctttctgtttatcgcaaatactcaagtcctaactatatacacgataagaaagtggttcacccaagtgtttttgttgttattgtttaaaataaaatttaaaattctttgaaccaggagaagctatacccaagtgtttggtttctttctaatggagagacttgtctgtggaaattagctccagagctgttcctgccttgacaaccaaacctcccatggctccccatcctatagggtaaagacctaaatccttaccttggccttgagaaacatcaaacaactattcccaattcatcttcccttctttgtcagtaagatgcagcatcatccctgaagccaagttaaaatatctcaacaataacctgacccccgcatagctaattcccacttctgtgatttacaatgaatctctgcactggtgaacctctgagtttctcacaatagacatttgattaaataatcctaggctggaagagtaaagtgcatcacctataccggccacttctcccaagactttattttgtagatttggataggaaaacacagatgtatcaaatattgtggtctaggtcacttagagaactaatcacacaatgataacagattaaaatggccatctctagatatgagctgagttccaatccttcctttgtttcatgtaattatgttgtacagccattttcaaatgatattggtcttaaatagtttaattgaaaagtttaaaatatttatatattatccttcttttttctccttccctaaatcctgtttctattgggagaaatgcgctttttctcccaatgtggcactttatgttgaatgctttaaccgaatcacagaatttgagagcaaggtgtgatcttacagattttgtattgaagcattttctaaagtctgctccataggacgacaatgttgttaggattttagtagacttgaaaaggaggaagggatcctttggtaaaacatattaattaatggtgaattaaagagctttcttgcttattggatgttctaaaccttcaacacaccagtgagctactgttactctctaggcaagaaacacagaatgaagtttattccttttttcagacatatttgaccacacaaccaaattctcaggaaggattactaaggacattttattctaagtaacacatatgagaaaatattgttgtgaatctaagctccttatttaaaaaaaaaaaaaataaagaaaagagacattgacaaaccagcccaaggtttcaaagcaagttagtgacagatctgggtccctaatccaggtctcctgctgcaaatcaagcagccttcacatcacctgcatcctggtccacatcgatcttccaccacggagacaactagatccatactaataataatattaccttgcttttatagagtatctgtcctccaaaatgctcaaagcactttcgtatgtattgcctcatttatctcacttgagtagctcagaatgggttcccagcaagttaaaagaaggaaaactcattactttcccctgtctggagggccacatgctcttaatggcaatggcaatattaaaatctccctacccactgtcattctttactattagtaaatatttttttgagcacagctcagggtgactatgatctttcaggagttgatacaatggtagtgggtgattaaagaaaattgagcataaaagtgctggtttgtctcaattcctttggtcggcatgaagctttgttcatttccagttgcaccagccctgacaggccatgaaatatatgcacctttgttgcagatcattccacccaagctggggtttctttttgaaggtataatgggattgtaataaagaatctcattgccttaaataataaacatccacccggactaaataatacattcatctgctgtactagcccctattttttctgggaacaagctaaattaatcactgcattctaccctcagaacccagataagactgagtaatggaacatgctcttctgggagaacaggaggaagaagacagatgcaaatttgggttcaaagtaaaactttttccttccatattggctagatgccactgcgggcaactgtcagcagtgatctgtgtgatggctatgaacaagcaatgcaaagtatctgtttcccaaacctccagcaatgagtctacaaacatttctttgattttaaactatgatttctggggctccttaagtcaatgggattttcttcttaatgcccctgacagtatatggaattttgatggggtgatgatgctatgttttaataacagaagctattaatttactaagaaagtataatataaaaaagtactaccttgagagtcaggagacttgagttctagcctcaattatgctacaaatagcatttgatttccaccaaaacttatgtcacttaacgagtttattaccggccaggctcagtggctcacacctgtaatcccaccactttgggaggccaaggcaggcggatcacgaggtcaggagttcaagaccagcctgaccaatatggtgaaagtctgtctccgctaaaaatacaaaaattagccaggcttggtggcacgctcctgtagtcccagctactcgggaggctgaggcaggagaatcgcttgaacccgggaggtggaggttgcagtgagccaagactgcgccactgcactccagcctgggtgacagagcgagattgtgtctcaaaaacaaaacaaaacaaaaacaaaaacaaaaacaaaaaacagtttattcccaagagtgcgcataagatgaggatatggtctccatttccacatcccccttgaacaacagcagcatgtcattacattgaggataattctttttttaaggtgcaaatcctgcaagtcaactacttcatttattagtcaatcaaagaaacaacaatttatttcaatgctcaagaggaaaaaaacaaaacaaaacctggctctgttgtatttattgagttaacatgttcatttctctgacagaccttcctaagagattatcagaggtaatttgaacaacactcagttttccttttacatagtgatgttatccaattctcatctaaggcacaacttaagtgttgtaaattcttgtcttactggagaaaaaaaaaacaaacacttaagccaaatcaagaacaacaagaacttaaatgtatccatacacagacatacatacagttctggataattaccacagtcattaatctctcagcagctgaaaataacaaccacgaacatagctatagttctttcaagttaatagtgcaactcagtgtgtgttattacctctaatgggctgaggcttacatcccacctttcactacgttagggtgagggaagggtggtagccaagaaagagaattcatcctggagaaaccagaacaatctgttaccactggctctcccgggagaggaggcgtgctgtgtccttgtgttatgtctattatatgacttcctgggcagctatctggtgttggttcaagacaacatacgacaaagtgatggatgaaaatataagagaaagaggcatggcaactcaattaaaaaaagttaggtatgttctttgtgcaacccaaaggcttcaaagttgagctataactctctttaaacctgcatagtccctttcttatagccacatgcatctcccttgctctaagattaaggcacagtacatttacagttcctagtcacttcaaatacatcacgatggcagcaagatcgcaaatacacagctctgagctcccgagtcagtttgacctccactaggtggcgctccatattaacgcagttcttcagcacttctggaaagacagcctggggatgtcaacagttgagggtctttaacttttgtttgcctctgttttccaaaggatatgcctttggggaagtctaaaaaattagctgcgactcagaactctaaagacaaccagtctcataagtttacagggagctgactggctgagaaagcaaaggctggtgccacgtcacggcatcactgctcagtaaacaactgataatcaaatgggacagaaatggacggcagctgttgcactgatacataacacatccaaaaaatattttctgtcttgttagaaaaccaatacatatggcttgaaaatctttactattgaaaagcaaatcaattattaaaattcatatgaatgttcctatagcaacaatctcagagacagagaagaaagaaagaaagaaaaaagaaagaaagagaaaaagagaaagtaagatgaaagaaagaaaaagagaaagagaaaaaaagaaagtaagatgaaggagaaagagaaagaaagaaagaaggaaagaaagaaaggaagagagagagagaaaggaagggagggagggaggaaacaagaggagggtaataggactgaccaaagagacagtaaggcagagcaaacttgggaaacagagatgagagatgtaaagaaaacatgactatgagaggctgaaagagtccttgggaaagggatggaggctggcttctgtgaatgagagtcaagagtgaaatgaagaaagtgatttaggccataccttgggcaaagcatatttcggaagcttcatttgggcaaatgcattccttcggtaggacacgtagtaatgtggccgccctcctgatgtcagctggatcataaaaacaagactgtaagaagctcgagctactgtaacaggcacaggtcacagaacagtcacctgaatggaaggaggaagcttccaacacaacaaatggcattaatgtctattgcggacaagtgtaaagaattggccttcagttcaaacacaacttataaagacatatgagctggtcagcggcccaaactgaacctactggacaaaaatacaattcttaagtttgcactgtgactcagatgccagaaaacattttgagttatttttttcaaatggggtacattggctgattgccatcaccagcccaggtctctagacccaagtctatgaccctacaagtaggtccctgtgccatatcagaatgaaatggcccaacccaaacagtggcagagctggaggctcacatctctgggcactgaattccagtttgatggtgttacactgatgattatgggcacatggcacagacaggagtgctggcatattagatggaaaaccaggctaggattggtgtccaaattcaatctaggtctcttctatttaatttaattttttttttttttttgagatgaagtttcactgctgttacccaggctggagtacaatggcactatctcggctcactgcaacctccgcctcccaggttcaagtgattctcctgccttagcctccagagtatctaggattacaagcccttgccaccacacctggctatgttttgtattcttttagtagagatggtgggggggagggtttcaccatgttgcccaagctggtctcgaactcctgacctcaggtgatctgcccgcctcggcctcccaaaatgctgggattacaggcatgacccactgtgcccagcctttttgaaaaaatttttaaagctaaatctcactctattgcccagggctagagtgcagtggcacaatcatagctcatgcacccttcaactcctgggctcaagtgatcctccccaggagctgagactacaagcaggtgccaccacagccagttcccctccaatcttgtccaaagcatgcagcccaaagaatcctggtgggtgtgagagagggcaggaaggtacagagggcaggtagagagggcaggtgtggtctccagccagcacatgagcaacctgcaggcacagtgtcaagggcaccaccacgtctctctctctctctcctacacagccactcttaacccctctaaatgcctggagtttcaatgacagctggagtctgcatactcagaatgtcaacaaatgcgcatgttcatcacattaggaatgtgacttggaaagttatcatcttcaccgtcatgtggccagatgacctcttaggtctagtgaggggttacaggatgttcatggtggcatgggtaaagactgtgtgaaattccaaatgcagaattgattctcatttgtaagtcatagatgtggatcacaaagtgttattagaaaccagaaaaggttcctgggagcagcactgatacagaaatgaattattatagacagaaccaatacatgtaactattcgaatgtccattgacaacttgatgctgaaattgtcagagtattaattactaatttccctgaagaataaagaaatggtgtgtgtgtgtgtgtgtgtgtgtatgtgtgtgatcatatgtgaaacattttataagtacacagggtggtaggcatttaaacaaattgcatcctcaaagcatgtaattaaatattccaaatcacaatttcttgtcgaaataaatgtaatactgtctagaatgggtctttatatatatatatgtatacttttatatatacgtataagctatttagtaattgtacctttgtcatttttaacatggaaggtggtaactgagttttaaaatgcattgtccaaacaagcttaaatttttccttgaatgctgaaaagcagtgcagcgtatttgcttcttgtctctactaacaactcaggaaacgtcagcttcttaaactgttctccactctcttgggggtgaaaaacctggctgaatacatctgctctgaagtgtctttattctaatcacagttggtgcatgacaataaaagctgattactctccccctggcctctgcctcccactatctccagccaccccacagcttcccttcccattcctgcttctccacttttaaggtgggtattggggagggggctgattggctgaccctttcccagatagaaagagactgacatatttgttcagtccctttgataactgggagcttctttggaatgcaggtgtgggggacagatcgtactgtgcatcatcctagagacaatctcactactctgtgcgatgccttcatgaccccatgttgataagatcctctggacacagcccaaagaaattcatgactagtctgttagtatagaagattccacactcactaattatccttttattgaaaagatagtgattttcccctctctccctacctccttccctccctcccatcctctctttttgactcttaatggagtgtaaagcaggcaaaagggacagaaacaaggaaaagaaaggtttctgagacaatcaacagaagtggatttttcctacctgaacaaacacataatgatcctgaacaatcaaagagtctgggtcaatgtagcctggaaaaggctgattcctgttggcctctgtacagttctgcattcggcaagttagataatgtgaatctgaaaaacaaaaacaaaaacaaaaacatggggttgagggggatatacagacagagatttacagtcagggtggacgtttgatatttcccttaccatttccaatttttttttttttttttttttttgagatggagtctcgctctgtcgcccaggctggagtgcagtggtgcgatctcggctcactgcaagctccgcctcccgggttcacgccattctcctgcctcagcctcctgagtagccgggactacaggcatccaccacaatgcccggctaattttttgtatttttagtagagacggggtttcaccgtgttagccaggatggtctcgatctcctgacctcatgatctgcctgccctggcctcccaaagtgctgggattacaggcgtgagccaccgcgcccagccaccatttccagttctttaaacaagcctcacagtctttgttaaatacgttattgtcattgttattattatttaaattattatcattattattttactcacttgctctcaataccacctacatcatctcctggtgcttccaccaagtcttgatatcctagaatactaaattcttgctaattatttttttccctcccaaacccaaatgaaaatattttcaaaaactggcaataatacttgggatttcatggtcaattttttctcattagtaggtttcaccttcacactttgatctttgacaaagaggaaaacacacatacatctaatcattcatcatctaatgataaaaatgatgtggttataagattctaggttaagtaagataagggtttttctttcataattcattagaagtaaaacagagccgggagctgtggctcatgcctgtaatcccagcactttgggaggccaaagcaggtggatcacgaggtctggagttcacaaccagcctggccaagatggtgaaaccccgtctctactaaaaatacaaaaatgagctgggcgcagtggcaggcacgtaaaatcacagctactcaggaggctgaggcaacagaatcacttgaacccagcggggcggaggttgcagtgggccaagatcacgccactgcactccaacctgggtgacaggaaaaaaaaaaaaaaaaagcaaaaccgaattgggaggagttccttgagttaagactttgcttttactttacaattgaatcagttgagaccctggatctcacctggtgataaatacaacatcagtaatgacaactcttacgtcagtttggtcgctattgctggaaatacattttatcagggaggctattcctgttttttgagcacactatcctggcctctatctaatcagattatgttactcccttacttaaaactccttttgcctcattgtattgagaataaattcaaactctccaccacccaccatgccaaccctccaacctcccccacttctcaccatgctaatctcttctactctctctgtgattcttctaatccaccctactttatgttcaggaagttggccaaactttctaccactttaaagactcttcatttgcattccctctgcctaaaatgcttctccccaggctgttctcaaagcacgttctagatttcagctagctcactgttacatctgaggatcttccatagttattctttatcacacaccatcctattaattctttctatggaatttatcacaatataaaattaccttgttatttctttcttactgagccgtgctcccattagaatgtaatctctataaagacaaatgccttttttgtttttgttgttgttgctgttattcactgttgtgtccaccagatcctaatactgttcctggcacacagtaggcaataaatgaatatttgttggaacatgccacttattgaaatatatccttttgagtataaaaaaggagttattttacttgtttttgatgcttaatgagtaggtgggtttgattttaagatatcagagacttatgcagaattctatttttccaaatgaaaatatcagaagatgattatttacaggaaatagaggtggggaatagtatgtagagatagataagctagatataaggattcactaaagatttctcttaagaaaactaggaaggcggaattgtccaggaccacctttacttaaggaacttatgtgtacctacctgtattctgcagagtgccactagggggcggcatgcactcttgctccctctgaccaatgactgatggggtttctgataacctctcagtagacaatggtggagagccttacacaccatcttccttcaccccactgccatttccgaagatggggatagctctcaagtgctttaacctgtctagtcctggtgaagccacctccaaaattaaattagagtcctctattcttccttcctcatctcctttttcaggcattcctgtaatttcacgttagagcagaacacaggatctttttccttaaagacagtttctgggactatcccttcccagaacgatcctccgtctagcacacaaaatctttacctcacaattttacactccaccagactgttttacagcttttaagtgacttctgttttccaaaatgtagcttgggggtcatagaaacaatggagatttatgacgataagaactgggcttgaattctggtgtggtttatttattagctgtgtagttcataagaaatcctttcatcttcctgagtcttgctgttactgcaatgctaaccaatgttccatcttggtttttctgttcatggtactgaaagcgaatcactgagacaatgagtattgctaaggaagaagacttgaatcagatgccacagctgaggaaatggaagatcagtctcaaatctatctccctggcaaactaaaattaggagtttatatagcagggaagaaatgtaacaatgtgtgggaaaataggaattagggggtgtaaggaagaagagctggtcaacagaaagcaagttgtcagttaggcaatcaggatgagtgaggggtctggtatctcattgtctagatgcagtgatctggtaagcttaagttccttgatgatacctgggaggcctgatggttggtttcctgagaaaggaacttggataagaactcggataaaacaaatgtaactttctcaagtttgaagactggaaggatcaatttctgtgtttattcaaaagaaagcataaacatcatgttctatgggacaactgggccaatttcactgcctccttcatctattaaaggaggatgccaatatcaactatcttgtactttagctgtaagaattaaaataacatatatgctaaatgttttgaaactcaaattcatacaaatgttagttgttatgattaagaatgataatatttctgttttctgttttgccacctttcataatgatgagaaattttgggaacacacttaaaaagactagttaagccaaatttaaatattccagttatatttctgaatcaggttctttggcgagctactgaacacccattgttctctggctttttgctgaaaaatccaatatcggatctgtcagctcatcttttctccatgtgactcagaagttcccatatgcaaggaggaatgttgtcactctaaacctactcaagccttccttctccacttgccattggttgttttagaagagggtatttaaacctagtactggtacatgagaagtgaggagagagcttttaaggggaatctgagagatatcaggagatacagcagaagatcttctgcctctgtaaacactgtgtctcaatgtgaatggctctaggtttctggttgcccaaaggagccagtcttacagtcaagcttatataacgagtatgacaactagatggaaagtacccatttcctaatgacatcattgagctgttgatggtactgagcctcaagctgccccaacctctgtgcttcttgttatgtgagataatgaacaaaaacaatggctaaacacaatgagagtttgattaggaggtcttgaccttcaaattacaaatacaatttccaactagaatttttaagactgacacctaatgaggacttgatgcatacacaattcttgttttatttgtattagtgtctgatggctcttttcttttccttaagaccctgtacaaacataagatggaaaataataacatacccttttcatgtttctaattcacctatatagaaattattaatctaaggaatttagggagaaaacaaagatggaatttaacatttgttgttcatctgtgagccaggcagtctgaagcatgttcacatagctatagcacgtttagtcttcacaacactgcagagtataccaactgactttgcagataaagagaatgaagctaaaaaatagtgatgtgtagaaacggcagtatgtggttgcaacgtggttagactgactccaactttggtttatttctagtatactgtgttgcatgaaaaatcccagtaagtttggggccaatttttgttaagtatattttggcttctatctaaggttcaaacagataccccaagatacaaaataagaacaccttaatatttttgtgtggtaatttggcaatatgaatcaagatacttaaaaatgcaggaccagcctgaccaacatagtgaaactccatctctactaaaaacacaataattagccaggcatggtggcacgtgcctgtaatcccagctacttggctgggagtctgagacagcagaatcactttaactcaggaggtggagattgcagtaagctgggatcacggcactgcactccagcctggcaacaacagtgaaactctgcctcaaaaaaaaaaaaaaaaaaaaaaaaaaaagataccctttgacctagggtttatttctgagaattctatctaaggaaaaaaatcaaggatcaatgcaaagattcaacaacaaagatatttatcagtgttatttataataaaaaattttggagaaaacataatggccaacaatagaaaaagaacttaataaactatggaacatttagagtttgctattaaaatcttgcttttatgaggaaatgcttaatatattttatattatagaagtaggttaccaattagtaatattattccaatgttaatttcctagttttgaaaaatataccatggttacataaaatgttaacattagaggaagctgggtataaagtacatgtattctgtactatcttgggtgacttttctgtgtatctaaaattattccaaaataaaagtttttaaaaagtaggttaccaaaatacgtgcattatggacctgagtttttttgcaagtcgtatatatatctataaatgtatgtttgcacaggaaaaataaataaaagatatatatgagatgtcaacaacagcggagagccactaatgtgaaagagttggcaatctttacaacaaatccctagtccagcccttctacagccgggcaagtaggggagcggggagtcaagatggacttgtgagatcaactgtctctaatctctctgcttgttctttctctacttcccatgcctcatattgctgttgagctgtgcaataagcctatctttggtctgagaattaccaagtttaaaatagggacacaagaaaagccccggaagaggtcttcaaaccacttcttgctctgagtggctcaaagtgaaatttgcaagctgaaggggaaatgaaccatcttgaacagtctgcccgtggtaaagtgttcctggtttgttccctttctcctcctaatggaaaacagaaagaaactggctgcacttcataataagggaccaagcactcatcccccttggggcttgctgtaatagtattaagtatgatgaactctttccatattcaattctggtgagtgtatgatgtgattccataggaagtatcttgtaatttggcattaattaatgtcaattaatgcatgcaactgctagacattagaattaatttcattacttttcctacacagatgttttccttgccataggtaattaggacactgtgctgttcttttcaagcatcttcactctctgcaacagctgctgcttagaataatgcaatccccatccacccaaaacctgtgctgttctagagaagggaagctgcttttaaaaaggtaggctttgaacagaggatcagaggtttaaatgcaggctcaaggcctgctagcttagtaaatcactccacgtctccaaacgctgatctagaaaatgggaacaaacaatatccatctagccagaagttatgacatttgatgaccttagtcttgaaatgtgttgagtctagcgccagattagactgtactcacataatgatagctgtagttggtatttaagtcctctctctgtaatcaccaatactgctcactgtgtctcaagctaaccacctgtaaagtgctaaggatatttctacctgaggcagcttctttctttttcttttttttgaggacagagtctcactctgtcacccaggctggagtacagtggcagcgatctcaggtcactgcaacctcccgagttcaaacaattctcctgccccagcctcccgagtagctgggaccacaggcgcatgccaccacgcctggctaatttttgtatttttagtagagacagggtttcaccatgtcggtcaggctggtctcgaactcctgacctcgtgattcgtctgcctcagcctcccaaagtgctgtgattacaggagtgagccaccacacccggccacttctttctttttatattcaatttttgtttgggttaaagattttttaagtacgtttttaaaaacaccatgaaaaaatattctccttatataataattaatacaaatacagatcttctgcataggcagcagacagcactgccaaataagtagggctacaaggagaatgtggaagtcatctctgcacccaacacacagggccaatcagcaggtgtggcaggtgttccgtcttcctgttggagctatcttctaggtcctagttccatctccagcatggcgtgtgactctgagaaggtcatcaaccaagctcagttttagactatttctttacataatgagagttattagaagcttagaaacaaaacggatgttaaaaatcagactatgactttaagatccaacaaatctttaccataaattatccactgaaacctgtttccttcccactgctgccaaaacaaaacaaagctctgtgatgttgctggcaagtctgtgtcttgagggcttctgctatttctaaacagcatgcttaactcctggctgattccctatgttcattcagagttctgctggcttgaacagccttttcctttcctgttactcagtccaaatacttcctggaccttcttctgtgaactttttcctggggcttagacaaacctttccatccccagaatgtcttcattgataacagcagcagcagcactaacctccaaaataaccagagcaacctttcctcggggtcaggaactgtgctaagtggatcacatgtttttttctctcttaaattttgcttaaaatccaggccgggctcggtgattcacacttgtaatccccaaactttgggatgccgaggcgggtggatcacttgaggtcaggagtttgcgaccagcctgaccaacacagcaaaaaaatatattacaggtctctgggactctatccatccattctatcattcaacaagtgtttatttagcaccaaatactttaattttccctaatattgtagacgtttaattataaacaaagctagaaacgatgcaggcaagcataagcactttgaaactcacctattcctcattgtttccacttggaaacaatttaaatcagcaatttaagcaatctgtttaaaagcagaacagattttaaagcccatacaagcgcatataacttttccttttgttctactgctctattacttattttgaaacttctgtattaaatgttctcactcatcacgcacgcacacacgtgtcaacacgctgctgttcatatacacttaattcctatcaggattctagtgccctctgtcacatgtaccagctagaaattgagaatgtcaaaagtgagattctagtcttggttccagaaagtctacacagaggacaagatacttctgtgaaaattatagacttacatcaaatgttctagcttggcatgatgagtgtgatttagcattgctttcttctgtgaaatttcttgatttgggaccagtgtaattgactaaatattgtattttattgttggccttcaggcattcaggagaccatgactactacagggaaaattctgggatcataaaatttagccaagcatgaaactaaaaactgggaacatgagagagaaaacaaaagcacactattaggttggtgcaaaaagtaactgcagtaattgccaaaaaccgcaattacctttgcaccaatctaataatataaatacagaaagttcactgtccaattacaatgcagcatggtgagcgcattctaggatgaatggaagtgctatgggcttgccggtgaaatatttaatcctcatacctctgcacagatgttttactctgtgctagaaacttttcctgtgactctgaatttatttcactttgtatcacacagagctgtggacttgttattctttcatggcctatttagtcctctttaggctagagactattttactattcagactatgttatagagtgaattactttcgtcagggatggggacatgatggaaaagctgagggaaagcctagaaggctgcctggaatgatgacaaggataactcattattccagaaagaaggagcactgggcaggagcagagaggcaagagagaatgtgagatgtgtttggggaacactggctgtgtgttttgcgagaaagtcctactggaaacccacactagaacctagtttagttgggtaaagacagaaaatcatatacaaagtcacactcaatcatggagaactgagaagcacatcacataactttctgtgtccgcaattggttccttctggtgggttcttggtcttgctgacttcatgaatgaagctgcagaccctcacggtgagtgttacagttcttaaagatggtgtgcccggagtttattccttcagatgttcagatgtgtccagagtttcttccttctggtgggttcgtggtctttctgacttcaggagtgaagccgcaaaccttcgcgctgttacagctcataaaggtaatgcagacccaaagagtgagcagcagcaagatttattgcaaagagcaaaagaacaaagctgccacagcatggaagggaacccgagtgggttgccactgctggctggggtggccagcttttattcccttatttggccctgcccacgtcctgctgattggtccattttacagagtgctgattggtccgtttttacagagtgctgattggtgcacttacaaacctttggctagacacagagtgctgactggtgtgtttttacagagtgctgattggtggatttacaaacctttagctagacacagaccgctgatgggtgcgtttttacagagtgctgattggtgcgtttacaaacctttagctagacacagaccgctgatgggtgcgtttttacagagtgctgattggtgcgtttacaaacctttagctagacacaaagcactgattagtgcgtttacaaacctttagctagacacaaaagttctccaagtccccacccaatccagaagcccacccagcttcacctctcatgtccaaattaagtttacaaagacagtagggagtaggggaaggagttaaagagcgacagagacagagagagaaggataaaaagtaggaagaaaagaagaaagcaagcaagaatgaaaagtggaaagtggggaggaagaaatgaaaccatttagctcatgaaggagaaagcatacagtttccagtttcttctccaggtgttttatttttatttttggaagggggagtgaggggagaaggtgtgcacatttacttagatgtgtctacacgctataagattaatttcagaacagagagacactgcctctaagacatgtggatatattcaatgaacagtttctttctttctttttttttttttttgatggagtctcgctctgtcgccaggctggaatgcagtggcaccatcttggctcactgcaacctccgtctcccaggttcaagcgattctcctgcctcagcctcccaagtagctgggactatagacaagtaacacagtgcccagctactttttgtatttttagtagagacggggtttcaccatgttggccaggatggtctcgatctcttgatgttgtgatccacctgcctcggccttccaaagtgctggcgttacaggcatgagccactgcgcccggcctcaatgaataacttcttgattatttttatcaccctccataccagctatcatacctgaaacataagagatgctcaacaaagaacagtatggcacagtccttgtctcagataatggaataaagacagatgacacgtttgcccgcccctctctctattccagccacctggccttctgttatgcctcagccatgctaagcatcctcatatccatatcctttgcatgtactcttccatttgtctggaatgctcttccaccaggcagacacacaagtctctcccatatttccatacagacttggcttaaataccaaatgccaccttatccgagatttcttccttgatggccctctttctctgatcactctctattctccctactctgtttttctcacacatttgtagctccacttctcatacaaatacttcatgcattttttataacatctcccctaactagaaggtaaactttatgagagcagagcctttgcatcaattcctaatcatccctcattcatgcctagaagagcatctgatgtggcgtagatgtccaacaatattttttgaatgaatgaataataggtccagagtgaaacagacctggctttaaatcctaactctgaaacaatggaaaaaacacttaatctttgtaagccccacttccccatcattaaaatgaggaaaataagaatagtgtctacctccaaggattgttataagtaaggcagctgaaaagtatctagtgtgctcacaccagataaataataggaatataatgcatgatcctagcatcactgtcacttgagaatttagaggacaaaggaagaaaatatgtgagtaaatgccgatgctactttttttttaagtacgatgctactttttttttaagccggagccagaaacattagaaatttttcacttggggattaccacacctgcatgttatatggagtgctgctattgtattctgagggataccaaggacccaaagcctagatctttgtcctaaagttaaggcctgtgagtgaaaagttttctgtgcacctttgttctctcagcctcagcatggaagataagggcacagagcttcatgcaggtgggtgggcacctgggaagcagaggaagtggcatataatggctacaaagaacccaatttgaaagctgcccagctgagcctgttgttgtactgtcactatcaggcttttcaatgctgtgctaggaggcccgtgttatcttatttcatgcttttctgggtggttgttagggctgtcttcaggctactaaatcagagaggtcaagtggatatcactagtcattgaaatcaagagccttttgcaatacgaaatatggggtcagaataacactgctagaaaaaaaaaaagcatagtactagattctggctatactagctaaaccttgatgctttatttggggatagaagagaggtgagaatgtgcattttctcagcatgtcaggaagtggtaaggatctgttagaatctgaagctgaccagaaatggaaacgtctaacctcttccaaggtctaccttggaagttattaataaattgactaaaaaaaagataaaggaagactatgaaatgcggggtctaataatggcaactgttgtgctagtgttggaactttggccaaagtgggggtagcaatctgatatttttaaatgtgtgtatcaatgccaaaggtttcatcttttctattcaaaagatttgattttttaaagttcactgaagaagaaataaaggtagtgacgaaaaacaaataaaaattctcaacctcactcctaattaaataaatacagattaaaacaataaggatatgcctttttaaaatttgctctcagatgggttatatttgaaaagtctttgataatgtccaagattgctgagggcttgcaaacacaggcattatgatactgatagactatttattgttgcaaatatttcagaaggcaatctgacaatgtttacaaaaatttgaaatgtatataatctctgacccaggaattttccttcataaattctctttccgtagtgtttgctgcttacgcgagcttgaatgcggactaaccaaataaataatatgtgtgtatgtgtatatattcgcattgtttgaaataaccagaggtctgtatatctacaaaggtctctataatttagtaattactaaatatagttgactttataatggagttctatgtatcaattaaccatgaagttgctaaatttatatgtgctgatatgaaaagatttttaacttatatttgtatgcacaaacactaaatttgccacaacaatttttcaacaagaacatgcgtgtaagtatacgtgtctatacatatacatactcatctgtataagcctaaacaatttctggagaaatatagcaaatatataaatacacacacacacacacacacacacacacatatatatataacaataaaaagataagagtttatatatatatatacctttttattgttatcattgctatttttgttggtataaaagtaatctatattcatagtaaacacactctgtagctgagatattgaagactttgagaactgagatctctattacctccccaaagcatttcagcagcgcttaccttatccagattttgacatacttactgttcaatacggaaactaggttggaaagctggtggataggaagtagaaaatgagatttccagttcttacccaagaccagaattagtgggatgcatagttatataaagttgtgagtttcttttatttctgcttgttaaaatgctagtttgaggttcatttcacagagttctcaggcagtcattttcacagttggttaaagggccaaggtttgttgttccccggtgaatgagattagtccttgggaaacttgttatgaggttacttattcatgaaaataaacactgggaccagtaattgtcccctgtcccctgttcctgctggcacagatcaccaccagtacagaaacattcaggttgcgggttgggccttttatttcagaagtaaaagggagaagcaataatggccaaaggtggtactgcaggttctcttacagatgaccataatatacaactatatatccatgtgtaattgccatgtgaaaaattctgataaaagttatgttattttcctccaaaatcaaatatgcataaaatgtggcacccagtttcagggaggtagtaagtctcttgcattcatctgttagtgctccaggactccacagacccagtggttaaagatccttctttcagtagatatacctaaacagtgacacattaatatatttattcaacaaatattaaatgtttcatctgggtgtggtggctcatgcctatcccagcacttggtcaaggcaggaggatcgcttgagcccaggagtttaagaccagcctgggcaacatggtgagaccttatctctactaaaaacgtaaaataaaataaaaaagaatgttttgggctctaagttatcttttggacatagaacggagattaaataagatacaacttttcacacagctttcaatccaacagtttggtcaacgttttctctttaactatatgcattacacacacacatacacaaatgcacctatgttaggtaaatcaatagaatgtaggtttcctttttagtattttaatgtactgggctcctacgatgcacacacacacacacacacacacagaatatttaaacaataaaagatctgcttcatggatgaggacctgtcaatttgtcttctttgaactcaggggccaataataaatgccacatccaataaatatgttcaaaaatttccagtaatacctcccgtgattgattgtagttgagcctgctcttttcagctcacctcccaaggcagaaagtaatacaataaagaataacatccttgtcacagatgtaaactacaagatatctacatattagaggatagttggtaagaaacatcagtgccaaccatagactctcacagaacaaaagctttctaaaggatctaagataaagtactagtttatataaataaccacacattcctatgcagacacttgttgctttgggagcaaaggttcagaatctgtgccatggaccccatcagcaatctgagaaagcctgtggacccattttttcagaatgtttttaatgcataaaataaattacccagaatagaccaaaaaaaactaattcaattaaatttaaataaagttattaaaagattaaaaaacaaatatttaatacccttgtatgtactttttaaattaatatattatatatcaagatctactggcaggtctgataactactacaattttgaggaaagaatgagcataaataatattttcagatgtaatgactgtattatgatataaaaatttctgtgatttctattgcaacaaagtcgcttatattgctaatactactcgagttaatttccaacccttacaattgaaagtaatcttgtaagttataaggtttataaaaataaagatataaggccgggcatggtggctcacgcctgtaatcccagcactttgggaggccgaggcgggcggatctcaaggtcaggggttcaagaccagtctgaccaacatggtgaaaccccatctctactaaaaataccaaaattagctgggcgtggtggtgtgcacctgtaatcccagctactcaggaggctgaggcgaatcacttgaacccaggaggtggaggttgcagtaaactgagattgcaccattgcactccagcctaggagacagagtgagactccatctcaagaaaaaaaaacaaaataaaataaaataaaaataaaaaaataaaaataaagatataattcttttttctcatgtaaaaaactaaagctttccagagctcacctcccctgaaatatgggaacttcaatggaaacagaaattaagtataacatgtaatctagggacatctgaaatagaccaaaactaaattttgaataacaaacccagataagaattcacaacacactccatggggaagagccaaactggcaagtgggggatttttcctgtgtcaaatgtctcagtatcttgactacaaaatatgtgaacacactaaaatcagaaaataatttctggttcaaagtcaaaaacatgatggccaggtgtggtggctcatgcctgtaatctcagccctttaggaggccagcgtgggtggatcacttgaggtcaggagtttgagatcagtctgaccaacatggcaaaacctcatctctactaaaaatacaaaaatcagccaggtgtggtggtaggtgcctgtaatcctagctactggggaggctgaggcaggagaatcccttgaatccaggaggcagaggttgcagtgagctgagagtgcaccactgcactccgggctgggcaacagagagagacttcatctcaaaacaaaacaaaacaaaacaaaataaaaacattatattattgtaaagtatatttggcatatactctacaggatgtacaacctagaataaaaaccatgggttccatatacataaacaataatgaatggggtcgggcgcagtggctcatgtctgtaatcacagcactttgaaaggccgaggcaggtggatcacctgagatcaggagttccataccagctcggccaacatagtgaaaccccatctctgctaaaaatgcaaaaaaccagctgggtgtggtggcgggcacctataatcccagctactcaggaggctgaggcaggagaatcacttgaacccaggaggcggaggttgcagtgagctgagatcgcgccattacactccagcctaggcaacaagagcaaaactccatcacatacacaaaaataaataaataaataaataaataaataataacagtaatgaatggatggagaaaaaaacagaggatctcaattaggaaatgagaaagaggccagccatggtggctcacgcttgtaatcccagtactttgagaggcagaggcaggcggatcacttgaggtcaggagttcgagagcagcctagccaacacggcaaaaccccatctctaccaaaaatacaaaaattagcctggtgtggtggtgcacgcctggagtcccagctccttgggaggctgaggcaggaggatggcttgaacccagggggcagaggttgcagtgagccgagatggtgccagtgcactccagactgggtgacagagtgagactctgtctcaggaaaaaaaaaaaaaaaaaataggaaatgagaaagagataacacagagatatgaaattcgtagtgcagctgatgagactgtaacctgattttgataaatacactgtcaaactttgcccactacatttgctgacaccttgctaccctgacctctctgtgctatttacttccaacctcctcctctctgtttattttgttgttgttgttgttgttttaactggagccttggttattgagacaatctctttccctctcttttttttttttttttttttttacactgtgacaggtcaggtgttatgcttggaccctttaaaacaattggtagattttttttttcctgttttgtttcgacagggctaacttttcaaattaaatccttttattgaattttcacccttggatagtttctgaagatgctgccttcgcaaaaaaaaaaaaaaaaaaaaaaaaaaaaagtaaaataaataaaattagaactgatacatttcatgctttgtgaaagctaagcctgagatgacagtttggcattatcaaccgccatgccttcagggagcacaggaataatgctgggtgtaagaaaatgtgcagatcacagagagtgatggcctcattgtttttaggataaagcgtcatgtgcattggatgccacaagccagaaaacagcagcatatgcccaaaagcttgaaaatgaaagcaacccgggatgctaccaattccatccagagcttcctaaactaggggtgcaatcatgggaaacagaccctcaagctctttcactaattttctgttgtggaactttgctactcaaagcatgtttcacagacccgcagcatggatatcatctaggagcttgttagaaatgcagactctcggccgggtgcggtggctcacgcctataatcccagcactttgggaggccgagacgggcggatcacgaggtgaggagatcgagaccatcctggctaacacggtgaaaccccgtctctactaaaaatacaaaaaattagccgggcgtggtagcgggtgcctgtagtcccagctactcaggaggctgaggcaggagaatggcctgaacctgggaggcggagcttgcagtgagccgagatagtgccactgcactccagcctgcgtgacagagcgagactctgtctcaaaaaaaaaaaaaaagaaaaaagaaatgcagactgtcaggcccctactgaattacaatgcagatcttaacaaggtccctaggtgggtagcatacatgctaaggtttaagatgtgaggctctagcattttcagacaacctggtaagtgaggtgagatagccactggtagccctgacaactggtcagccgggtatgccatcattcaacatatgcttagtgagatctctctacatgtagatgccatggcatgtgctggagacataatgtttttgttttgacatgggatctcactatattgcccaggctggagtaaagttgctattcacagttgtgttcacagtgcactacagtcttgaactcctgggctcaaatgatccccctgcctcagccttctgactagctgggactacagatgtgtgctaccattcctggctctggagacacaatactgaatatgatatacatggtccctgctctcataaaacttacagactggtggcgagaaacggttgtgatcgaataaacacgtaaaaagaaagtataatttcaaacagagaagaacatgataaagaaaaaaaatagttgtataaaagcaatcaaaataagaaactcatttagactgagagtttacgagaggcttttctaagaaataggcgattaacctgaggtctcaaccatccacagtaatcaattatgctcgattggtcagggtatgggcaagaaagaagggtattccagatagagaaaacagcatgtaccaaggctttatggcaagacacatacccctgtatgttccaagaattgaaaacccgcctaaaggcctgcaggcaacgagtgaggagagggcagactaagattaggctgagggaatgggcagacacaagttatgctggagctataggtcaagatgagaatttagctctttatcatcaaagcaatgggaagtaagcaagactttttttttttgagacggagtctggctctgtcgccaggctggagagcagtggtgcgatctcagctcactgcaacctccgcctcctgggttcaagtgattatcctgcctccacctcccaagtcgctgggacaacaggcacgcaccaccacactcagctaatttttgtatttttagtagagatggggtctcaccatgttggccaggatggtctctatctccagtaagcaagacttttaaacaatgatgtgtttacttttgcattaagaaaatattgatctgttatgtagcaagaactggaccttggaatccaagataacatcatctgctccagggaaatggagacgtcaccaccagagcgagccccctgaggaggtgggaaagctgctctgacctgttgagctcattctgtgtcaggcacagtgctgggcatgttacatgtggcagctttgcctgggttacagaggatgatggtcagccttgatccctaacctgtgccccaactgactctgtcaaaaaatatattcactcccccaaaagggaaacaaacctttagagatgagaaatctcatggtacatgcatagtaatgaaaaatgtgtggtttctggggagtttgggttatagggttgacctgctttgtttggctgtaagctggtaaagtgcaggaccttctgcctttgtgttcagaagagccaaggactggtaggcacaaacggcagtgattagggtgcttttgaattgtgagggatattttagaaactgggaaggtcttggaaatgagatggtcactctctgggccagcgctgggtagcctacaacagcctcattgctctgtggtaattgtggatagtccattctcttcctctcctctacatctgagacctcttcctttctccctgtcttttctcccctcaccctcttctatatacagtttcccccttttctcattttcttttaccccctcacctggagtgctctatcctaggcctagcggtacccctgcaaatgcttagcccttctgaggatcctctgtaccagagaaggggaaggaaacattcattgctggtgttagtaggtcaggcactgtgtgaagtattgtatatgcatgggtttcttgaattctcacctgaataggctctgtgagatagacatcactgtcctctacttatttaccatattagcttagctatattattacttaagctttctatgcctttgcttcttcatatgtgaaatgagaaaaacaacctacaacattgtcatgaggctacaaagtgtagtcctgtccttcactgcagcataaccacccggagttgataagaactactgacaggtgagcaattcactcaactgactctcctcctgctgcctctcatggggacacacagaaaaattctctctctctctttttttttttttaattctttccaagtgttttgtgaatctccaaacaagacagtgaggcatggcctggatggtatctgacaaaataaggagactgaagaaacaattcaacacaaaagagtagcagcagcaacaacaatgaaacactttaggaatcaagagtttggaagtattctctttacctggaaagacactttgattggatgagagggctgtgctggtatcaccactatcaaaatatgcatatttctggataacctatatatttatatttacaaatatatgtgaaaatatatatttatgaaaaattattaagactattttgtattactgaagacaggaaatgtcttcatgcctaaatcacacgattattgccactgtgccactgtgcctgcctacctatccttagctcttccgaacagaagatacctgcactttactagcttagagtcaaaagaagcaggtcacccctgcaaccccaaatcctcagaaaccacacatccactattactctgcatacaccatgagattattacacagactcagttcatgacagagtcatagaactaatattactatgagtattgcggcaaagttgatttacttacgaccatccacagttctggcctcaagatgcacaaggtctggttctttatttgaccccatcacagacctaaaaaatggagaaacatgaaaagaaacatccatattaatgacttcacatgtgccttagtggaactcggcagagcccccagactattaatatccacaggcatctaaacccacaatccttagaatatatctactctatgtatttatacagcctgacagtaaaatttccacttaaaataaaaatgataatgaaaactacatttgatgaaaggcaggctgcattctagcaaggatgttgcatgttattagctgggacttgcatacaggtcctacgcatgttgggtgtgtactcttgcaacaaccccagtgacagtgtattaaactttcaaaacttattaggcaggcatgctgcttcagctgggtgacttgatcagcgattcccatagcacactgatctaattaattttttcactgaaatttgccaaaccacctacgactgccctatgaacaaaccctgtgactcaaccaatacagcagcagttacagcagagtgatgattctctgtattgtcgaacccgtgtgaagagaaatagatgcacctcactttctgatacgtgcctgaaaccatatgtgtaagcaaaataaaagcctatttaaaatgccttggagacacatattattttgtgtaatcctgcagtaagctatattaaatagaaaataattattattctggaacataaataatatgggcaatcacgctttatctctaggatttttatacaatgagattaattaaacttgggaacatctgcactttttgaaaaaatcaggctttgcagaactttaatttattccatttctacacagaaaacagcgaaatgcctccaaactggtccctctgcctgcccccagccactcagcccagccactcaatcaaggctagaaaatgcagatgttaaaactacttatccctgggccgggcgtggtggctcacgcctgtaatcccagcactttgggaggctgaggtgggcggatcacaaggtcaggagattgagaccatcctggctaacacggtgaaaccccatctctactaaaaatacaaaaaattagccgggcgtggtggtggggtgcctgtagccccagctgctccagaggcatgaacccgggaggtagagcttgcagtgagccgagatcgcaccactgcactccagcctgggtgacggagtgagactccgtctcaaaaaaaaaaaaaaaaaaaaaaaaaaaaagtacttatctctccagagcctagtgcggtatccacgaccctgcacagactgggtccatctcacttttgctgcctcatctcctgccacactgaaagatgttgccattgtctgaaagtgccacactcatttcctcgcccctctgtgagtctctaagcttctgccttcaggttgagatgctcttctccagcttcacctaacccctgaatcatagtttaagacacaagtgaaaagtcacttcctctgttaaatatgtctcatttacgacagggaaaggcttttcctccgatcagcaagtgtttgttataaatcctgtaaggtccttatcagagtttgttataaagaattatttttgtgtttttccaatatgaaggcatcctcttcccccaacagacacacacacaacacacaaatacaaaagatacacacacagagatacccaataaagctactggaaggtcttctctttacacactttatattcatagatatagttcctggtatataacagacagtcaaatgtgaaatgaaagaaggaaggaatgaaggaaagactaaagaaaaggaaagaagttaggaggaaaggcagggaggacaagaggaaggaggtaaagagaaagaaagcgaaggggctataaaggtctgcgggttttctgaagtaagtacattaatcattgtcctagggttattcccagaactctacttacttaaactcatttttccaactcaaagaagctgagtggctagctggcttaatcactcttcatctggagaaaagaagtctccttaaagccctgttatcgctgtcaataagttttctctgattgatacatggcctgcaattcagagcctatgcttgaaacattaaatcctactttgttcttcccctaggaagcagatatttcctaataagggtctcataatttccctcatatagacatgggacatgcatttgcacattttaatcactggaatctgcttgaatccaggcagaaagtgaccctttcatcagaatttcagttaagtactgcagcgactactaggctttgggtggtgactctcctcacactgaagcattaactggatccgcaggtgaccttttctgacaagactgcaagtcatgagcattaaaaaagaaaatgagctgcttgacaagcctcaatccagaaagctcagcagttaactgttttatttcaaaatgggcagttacatgttgttcaactgtccaccttgccttaagtttcatccttgaaatgactaccaccacttattcccaggagaaacgcagtaccccagaaacacaaggttaaaactagcatgcaagcctatctacttggcttacggctagtgtcaacgggaggcaaaataattacgctggattcagtgtagctttccatgtgcgtatagtctcaaataaataatagcagtagtttttaaaaatcttgtattatctttaatggcaaagctgttgtttccagtgacatctcccactgccttatcaacaaacaaaaaacaggcaaggccaggtgcagtggctcacgcctgtaatcccagcactgtgggaggctaaggcaggcggataatgaggtcaagagattgagaccatcctggccaacatggtgaaaccccgtatctactaaaactacagaaattagctgggtgtggtggtgtgtacctgtttcgggaggctgagtcaggaaaatcccttgaacctgggaggtggaggttgcagtgagccaagatcacactgctgtactctagcatgggcgacaaagtgatactccatttcaaaaaaaagaaaagaaaagaaaagaaaagaaaagaaaaagaaaaaaaagaggcaagagcaaaacagagttctctgttctccccaaatctactgtggctaacaaacctccttattctgcctaaatgttttctcatctatagtaaaacaattacaactacaaaacaaagctttacatatgaaagtcaaaccacagtgtttccaatgatttttatttgatgatgcctcacccctagacctgtggtccaagagtatctctagcagttacagatgataaagaattattgctgcttttactttatggcctagtgagttcttaattgctgaggccaatcaatgctgaatgtctgtataagtgctgattttaacggtcctgtcattgaccagataccttagaaaagcatatcattgcagttgacccaaatgatatcattactctagcctatatatgctgctaaattttagctggagctacagagttaggtagcattctgtgtgttttaagaccaactatgtgtttcatcctcatcctcatcattaaacatcactgtcatcatcattataatcatcaaagaaaaacagcatcaacatagaatttaatacaaaatgaactcttcatggtcttacttgcagaatgagatcttgagactgatattcaagcatctctatccaaagacgttggtaaatctgacttctggtattaagtataagggattgggcacctttgttttatgcctctagattatccgacacatatcactgtcatagttcataatgatttgctacatgtctgcataaatgactctcttaatacaccggactcccaaaggcaagtgttctgtcttttatcactgaactctctctgcttgcctaagtacagagaagcaagttttctcagtaaatacatatacaacatttttgcaccagtcaatatttactaacatccaatacagcatgttattctttctgggactcagaacctctctgtaaatatatgataaaaattttgtctaggatattttaattatttaaaaaaaggcaataggtagatgtatcttgtgtacctttacactgcctttatgttgaactaggaaaatgaactcccttcttgaagtgaattttatggaagggaaagggagtctttctgtgtacatcctggtgtctgcctgggatctcctctcatccttcttctgccttcataactcttattgctgtggctcagctgcagatgactgaagttgaaaacaggcttctcagtgggggtgccacttaagccaagttggttatcctttctgagactttcagaatgatgaacatacttttgcacagaaaaaattaggccatgttataattggtgactcatttgtcaatctcctttattgacagacagactcaaacctttctgtacctctgtgccaggcacctgcatgccacagatagattagcaaaaagcattaactgaatggcttttgagaaaagagaagtacacaaaccagccatatcagcatgtattaatttatctgtatatgtaacttttgttaagttagttaacatctctgtgccgtcacttttttagtctttaaaataagttaacataattttttctatatttttcctataatatacatctttaagtacctagaagactcctggcacagagctagggctcaggaaatacagttaatttatttcttctctttttccccctttttatttcaagaaatgggtgggggaatattaatacctaagaaattaaaatgtatgctggtattaaaaaactcttgaccaggcgtggtggctcacacctataatccgaggatcacctgaggtcaggagtttgagaccagactggccaacatggcaaaaccccgtctctactaaaagtacaaaaattagccgggcatggtggcgggcagctgtaatcccagctactcaggaggctgaggcaggaaaatcgcttgaacccgggaggtggaggttgcagtgagccgagatcaagccagtgcactccaggctgggcgacaagagcgagactccatctcaaaaaaaaaaaaaaaattcttgacatatcatggatgccttgctaacagaaatgatctatcaaaattattgattgtcataagtcaatagacaaaaaatgagtcaatggctcagagatcaattatatgaataaatacaattcaattatttattcatttatttagtcagtgaaacattccaaacccctactatgaaataagaatgagggctacataattactgcacttaagagctttagaactacagaagaggcagtaacccaatgaagaaagggttctaacattcaaggtgctatttgaagacacaggaggaatgacctttcacctgcagatggaaacctggaggaaaagcaaggtccaggaaccctttggagtaaatgaatcaaatcttcaagtatatgcagcaataggatcaatggacagaaggagtgaagagcattccatttacagacaaatagcaggtactggggccctagctcaaagaaaggatgacccatatatgtatctattgtaagtcaataggatggatccagtgtttccaaagtagattagcaaaagagaactgaaaagacaccaggggcccaatcaaaaagcaccttttgtgtaatgctcaggttttgtatttgatcctaaaagccatgagatggtgctaaagaaaggtaagcgtatacatttataagcaggtgaaaagacttcagtcctggtctatgtgtggtcctcgctattgagggagtatgaggcgaagttgcacaggtcatctagatgagctttgttgatgaaaacaagacaaagcccattgcagcctcctacatctatacttccagtatcttaagtaggttttcacatttaagagctattttgaaataaaacctaaagatcactaaagacaagaatatgaataaaaacaaatcacactctgaaatagtataccagtgacatagcagcgcaacatcagccttctgaaatacaatcagccaaatgcagcctttgtagacattttctacagagaaactcagaaatgtcactagtttatcattcgcctggcattttgtctgagtttataccagcttaatatagtgcccaataaatgctgcagagccacaaaatgtcctgatgtagataaccgcagagcaagtattacaaaataaatatcatgatgggatagcacctatttattcagattcagaattgcagttaatggcatatgggaagaaacgaggagggacctgcagaggaacagaggctggaaggttggagacccctgccttcctcttcatgttcccacagcccctcttcataaacaaagtccatgagggcaacaggtcctgtctgctaccaaagtgcctggcaggtattggcagtgacataccttggtttcctctcctacagtcaagggtttccccttcacctgccactataattaggccctcagaaaaacatcatcaagataaccctggttaaaaaaaaaaaaaaaaaaagataaccctggttaaggccacagtttttgtttttgaatagatcatcttagcctgaggtctcgtctgcgtccaacacgggcaaatgggccagataatctacaaagcagccgaaggtgccatttaacctctccctttagcctaagaaacatgtctgctttctgcttttattcctctggcccccgacactgtcagtcacattggttctccagaaccaaaggtgcctactaaaaataacaaataaatagatcaatagataaacagacagataaaaacaatgcttaatctcctcaatgcacaatggcctactgagaatcagcattgccagcaacctgaggccctccacgtgctgcattttgtcatccttactccccaagccagaagcccaagtgtttatttctatgatgtctgcagcaaagtgtgtgtgtgtgtgtgcatgtgagtgtgtgtgtatgtgtaggtgtcagggagcaaagtgaggcacgcaagtctgacctggaatgaagaaatacataaagctcaggagagcagtgaggagatgaagatgtttattgagcaaagggcttggtaaataggactaaaagtttaaacaacaatgtttagaaacaagcaacctgtctctaaagacatcacaatgaccagacctaaaccagccaagaagaagctttctgcagcagctctccccttcctttccccactttcccttttctaatttaatgactttgctttttccatcagtgtttgcatttttctgtttccttcttatttccccacttttatgccccctctttgtctttgttgtttcttaaataaatattttttttaaagaggggggtggtgcaggcatggtggctcacacactttgggaggccgaggtgggtggatcacttgaggttggaagttcgagacgagcctggccaacataatgaaaccccatctctactaaaaatacaaaaattagccaggcgtggtggcacacatctgtaatcccagctactcaggaggctgaggcaggcgaattgcttgaactcaggaggcaggggttgcagtgagccgaaatcatgccactgcactcccctacccacccccaccaaaaaaggataaaagtatgtggggggtctagagagataccagggaccatgctcaaatcagtgctcctgatccccaaacaaaaatcacagtgccaatgagatacagagaaatgcacttcaactgatcaaaaagagcatgagattaaggtaaaggaaaagcttaaaatatttttaataaggtttctttttatctttttaaactttagtggtatcataccctgcatatttttagcaacttgttaaatgtactcaataatatatcttggagatggttccataccagaacaaaaaattaatgagataaatctctaactattttattgcaacctattaaatgaaaatatccgattttttcagtcgttgtctattgatggacgcaaagaaaaaatatacataaatggggaagaaaaaactggagatacacattaaaaattcataattgtagtcacttttggtagagtttgggggttgtgggtaatagtcaaagggatccttatctttatcagtaatttaagaacttttataaggaagatgtatatatgcgattgtctaataattaatacagctgtactattaataaaaagaaaatattctccatctggaaaataaaatctaagtgggtagtaaatgtgagcaaatcacaaagggagagaaaaaaggatgagtgacatttctgtagggaggagacctgggattttctcaaatcttgaatacttataagtcagacaccatcttagtgagagggccaggaaggtgaaagcctagaagagttgtggtcagagaagcagtgctaaggacttcctggaggggtgtgcttgtgttgatgttaaaatcagtgtgagaggaaggaggctggagatcctgcgtggggccagaggggccacagtgacagaagacagggagaagagagaacctctccacttctcctctctttatccatttctgttaaggacaaagaacttcagactagagggtagaacaaatataagtttaaaggaattgctcagcgcagtggctcacacctgtaatcccagtattttgggaggctgagatgggaggatcgcttgactccaggagtttgagaccagcctgggcaacaaagccagaccccatctctattaaaaatttttaaaaaggccaggcacagtggctcacgtctgtaatcccagggtctcactatactgccccggctggtcttgaactcctggactcaagcaatctgtccactttggcctcccaaagttctgagatgacaggcgtgagccgctgtggccagccagggattgttttaaaaggcaaggttagtggactaggtatttgaactacagactcactatggatgatcagaaaggttgggtaaatattaaaagtaataagagaccaagcaaagaaataaaagaatcatgaggccaaaaactgagagaagatggaaattcagagaagaaagtccagagtttggcccactcttcccctggggaaaactgtcattgtcttggctgggcatggtggctcatgcctgtaatcctagcactttgggagttcaaggtaggtggatcactttaggtcaggagtttgagaccagcctggccaacatggtgaaacctcatctcactaaaaatacaaaaattatcctggcgtggtggcacatacctgcaatcccagctactcaagaggctgaggcaggagaatcacttgaacccaggaggcagaggccgcagtgagccaagattgcaccactgcactccagtctgggtgacagagagagagagactgtctcaaaaagaaaaaaaaaaaaaaggaattgaaaatttaaaccaggccgggcgtggtggctcatgcctgtaatcccagcactttgggaggccgaggcaggtggatcacgaggtcagaagatcgagaccatctggctaacacgatgaaaccccgtctctactaaaaatacaaaaaaaatatatatatatagctgggtgtggtggcgagcgccgtaatcccagcactttgggaggccgagtcgggcagatcacgaggtcaggagatcaagataatcctggctaatgtggtgaaaccccgtctctactaaaaaacacaaaaaattagctggatgtggtggtgggcacctgtagtcccagctacttgggaggctgaggcaggacaatggcgtcaacccggaggcagagcttgcaatgagctgagatcacgccattgagctccagcctgggcgacagagtgagactctgtctcaaaaaaaaaaaaaaaaagaaaatttaaacctgagcattttgctgctggagataacctgaccccatggaaatgatattctataagagaattccagaacagctatctccacatgttttgtttgaacacatcaagcaagggggggaaattaggcacccccaatacatgatggtttattagatataagttgtggaaatgcagtacagtacttacatactaactttagaaaatatacacaaaatagaaactaaaatcggagcaaagaataatcagaaagtatcttcttcccacacctcagtgaatcaccaattacccccctagggtgtgggtgcaggtaagtcaccatggagactgttgctctaaactgaggattcctgggatatccttaatatttaacaccaggcatggcagatggttgattctgaattaattttttaatgaataaataaataaatttttgaatatgtttactgagtaactacaaatgctaggtgtagttctagacattaggggtttaaaattgaataaaaaagaaaaatccctgtaccttgtgaagcttacaattcaatatggaacacagagaaattaaaaataaacatgtcaggtgatgctcataacatttcttgaaagctgtgtgaggaaaaatatataaaatacaaggcatttagctccatcagaaaaaaaaacccattgttccccggtgtcaatcaatggctggtttccatctattaagtgtgagattgatgtcatatagggccacaaggctgtgctcttgttggtgtcctgctcatcaattgtcaacaacttgggtgaaaatacatgttgtgtgcctagaaaattcatacatgacacaaattcaggaaaaataatgaaaagataagagaaagacagtgttatctctgaaagcaatttacttgcctaagggcatagagctaataaaagatacaatcagactggaacctaggcattctaatttctctagggctctatacaccacctgtaaaaaagagtagagataatagtaccgaataatacgattgttgtgaaaggtaaaagacgaaatacgtgtagctactactactgtcaagagtatgaatcaaggaatcctttagggacagaaagtctgttagagattaactagttcaaatacctcctgttacaattaagaaagcccaggcttccagagagcaaataccatgtccaaagtcataccactcagagtgtatcaaggttggaattactaacccaggtccttaactcatgtcaataattcttttcatagaaaaaaaaattaccccttagtgtctgaggcaagacagtgttaactaggaagataatgtgtgtcttacacactaaaaagataaggagaagccagacgtgatgactcacacctgtaattctagcagtttgagaggctaaggcaggtggattgtttgaagccaggaggtgaagaccagcctagccaacatggtgaaaccccgtttctactaaaaatacaaaaattagctggcgtggtggcatgcacctgtaatcccagctacctgggagggtgaggcaggagaatcacctgaacccaggaagcagagtttgcagtgagccaagattgcgtcactgcaatccggcctgggtgacagagtgagactctttgtctcaaaaaataataataattatatatagagagagagagagtgagagagagagagaatggaaaatcctgacatttcaacatcctgcaagcgttaagtgtattggcatacatgagcctagacatatatgaggggtcccatgtcccagagattggaaacagactagatattaatttcttcagcttagaccttaaatagcagggtttctaagtttgaaggtggcttttttgcagtcacttgcaaaatgactaatacattctctcccttctcagaaaacacagtgtcagtttttacacggacagctcagtgcctggcctgtaggtaaggctggtttagctatccttgtagtcgcttttccatacttcgtcagattattatgacacaaagtcttctcttgctttatggttgggtattggtacttctgcaaaaatacactaagaggctattgccctcaaatacttcaactgagaaggaaaagagatccagtcagtaaagcttggaagggagtaagaatagaattgggttagatataggaggaaattagattgatcttcattggagaggcaattcctggggtgcgaaatggcaactgctctccttagcagaggttgagtatcccttatctgaagtacttgggaccagaaggtttcagattttggattttatttttcagattttagaatgtctacatatacatactgagatatcttagggatggaacgcaagtctaaacacaaaatccatttatgttttataacaccttgtacatatagccagaagataattttacacaattttttttttgagatggagtctagctctgttgcccaggctggagtacagtggcacaatctcagctcactgcagcctctgtcttctgggttcaagtgattctcatgcctcagcctcccaagtggctgggactataggcgcatgccaccacacccggctaatttttgtatttttagtggaaatgaggtttcactatgttggccaggttggtctcaaactcttgacctcaagtgatccacctgcctcggcctcccaaagtgctgggattacaggtgtgagtcaccacgcctggccaatttcatacaatacgtttattagttctgtgcataaaaccaagttgtgactgcatttcgaccagaacccatggcacgaagtatggtatgaaatttcccacttgtgacatcatgttgtcactcaaaaagtttcagattttggagcatttatggttggggattttcaaattagggctgtactacctgtactttgtttgttgatgaaaaatttctggagttctgagtataaggtgtgaagggatttgaaactgggcaaagacagggaagctattttgtgaaaataatttaaaggctgtgccagtttgcttttgaactcatgtaaactccttggccaaggaaactagtgtgatgacaaaaaaagaaaaacacacctcttaatttatctcattttggggtctgtttttaaatcagtagtccactatggatgtgaattcctaaagttggttttgaaaatatctcaatgtgacaaagaaaagagagaagtggaggagggaaagggaaagagagggagtaaaagagaacatgggaaagagaggataggagaatgagaagggcaaatgaaggcattggagacagaatgaggatagaaagggaggaaagagaagccagagagaggagactttcttcgctatgactattccacaggggtcaccatgccctcctgctgcctggctgccaccagtcccaccacaccaccatccatctggaaatatgtttgactgctttattattatcattatttgtatattttattttattgagaaggagtctcattctgccacccaggctggagtgcagagcaatggtgcgatctcagctcactgcaacctccgcctcccaggttcaagtgattctcctgcctcagcctcctgagtagctggaactacaggtgcataccaccgtgcctggctaatttttgtatgtttagtggagacggggtttcaccatgttggtcaggctggtctctaactcctgacctcaagtgatccacccaccttggcctcctaaagtgctgggattataggtgtgagccaccgcacccggcctgtataatttatttaaatagcatgctttaaaaataacaccgctgtgaaaaatctgactgcaaaaggagtatgtattcattgaaaatataatactaagtatacagaagtaaaaaaaaggaaactaaaacattcttacaatccctccatctagaattaaccacctttaatattttgctgttaatccttcagtactttttcagtgttcgtgtaggcactcctttttctttttaagacttttgcatcatatcacgaacacagcgtaacacacgatgtaatattagaacacactgttttgccagccgtacaatattctatagttgacttaactagttttctgatcacagagtattggtaatatctatcgttttacttttatttatttatttatttatttacttgacatagagtctcgctctgtcacccaggctggagtgcagtggcgcgatctcagctcactgcaagctccacctcctgggttcacgccattctcctgcctcagtctcccaagtagctgggactacaggcgcccgccaccaggcccagctaatttttttgtagttttagtagagacggggtttcaccgtgttagccaggatggtctcaatctcctgacctcgtgatccgcccacctcggcctctcaaagtcctggtatttcaggcttgagccaccgtgcccggccatcatgttacttttagacatgatgctgcactgatgatctttgtaggtaaatatctgtatgtgtctctaatctctctagtttttcaataggaacaactgttataagaggagatattgtagtcttcccttacccacaaagtttaagtccataaggtataagagtgcttacaatgtttagaatatttaccttatgactataccatatttttcatgtattttttaattggtgaatttagaaccttcattctttgttttgggaattaaaatgacttaaacacagaggttagtagcctgcttacaggtctgttttgtttttgggagcagccaggcttgcttttttccttggttaagacagaggagagacaggaaaaggtaaaacagagtgtgagtgtgagtgtgtgcatgtgtgtgtatgtgtataacatcttccttttggaaaagatgtgtgagttgcccaactgaacaaagaggaaagctcagaactactgggtgagaaccccacctccatggtcaaccaagaaaatcagtcacagagaaagtgcatttgcttctgacgtctccattccaggtcagactctaaaatgctccttaaaaaaagaccaacaaaaagtttattagccaaaaagtcttgcccttaattagtaggtcaacagggatcctcttgacaatagctcagagccagggcagagggacacctaaagtgagaaagagatattagtaaagaaacaataagggccaggtgcggtggttcacacctgtaatcccagcactttgggaggccgggcagaccaagaggtcaggagatcaagaccatcctggctaacatggtgaaaccccatctctactaaaaatacaaaaattagctgggcatggtggcaggtgcctgtagtcccagctactcgggaggctgaggcaggagaatgggtgaacctgggaggtggagcttgcaataagcggagattgtgccaccacactccagcctgggcgacagagtgagacaacgtctaaaaaaaaaaaaagaaaagaaaaagaaaaagaaaaaaagaaacaacaaaacacaatctagaattgagcttattcaccttcattagcacactacagtaataattgctgtaggcaagattggctatgaatactatagtaggcaaaacgcatgttctcaacgtatctctccaaaatcttgatcaattttctggttatattaacatatgttcacacactttttgatacttatcctgccaggagttagagcttaattctccttcctttgagtgtgggctgaacttagttacttgcttccaacaaacagagtatgggacaagaaaaagagtaacttttcaatggagaaatctgggagcttccaacaaatagagtacgggacaagaaaaaaagtaactttgcaatggagaaacctgggagacgcccccttcaccaagtgatcaaagttaacatcatcagtaataagacatattgatatcttgtactccttgatatgaggtgatgagaagggtacatcatttctttgatattcttcccaacaatctataaccctgtaatcatgagaaaatatcagactaactaacccaatttgaggggcactctacaaaatacctgactagtactcttcaaaactgtccaggtcatcagagacaaggaaagacggaggaactcctatggatttgaagagactaaaaagacatgaaaaataaatgcaatttgggattctggattgtaccctgggtcaggaaaaaaaaaagcgggggatattagtagaaaatctggagaaaaccagacagtctctattttagttcactgttttttaccaatgttaattttttattggtaaacattgcaccatggtaatgtaagatgttaacattaggtaaagctgggtgaataggatatgggaactctctgtattatctttgtaattgttctgcaattctaaaattatttttaaataaaagaggaaaaaaatcctatgcccaaatcttattaaggacatgaattagagcaaagccacaatttcctacaaagaggaaagtaatctattcagtaagtcagcctcatcacatggaatggactggttatactgtcattaaagaaggtaaacaactgtatcacttcagctgtcttatatttatgattcaggcatttcgacaatcacaaaataattaagctacttcatttttcaaaaaagtgttaaggttgttttagtggctcttatttctgggatgtttttatttttgatttattcataagtagaaaacaatgctgacagccagcgttcttatttattcttgggcttccctggttaccacagacagaacctgatagcagatgacaacataaagatgttgggtccaggagctgctgaaatgtgaggtcaaatgtgaggcttgtgcctgatgtggttgtctgctatgtctcttttggattcctctctcttaggcatctcgctttccttgactactcaattactcaggaaggccaactgatcatagaaggcaatggaagagctggtttgttccctgggatggtgaagcagaagctatcccaagtgcataaatattctaacaggtttcatcctgtcacaatagagtcataaaattgctctgttcagcacatgataatggctttgtaattcaattattggtagtatttgtcttctgggatttagctgccttaaacttcagcactcatgtaaaaccctttaccataaatctcataaacgcaggttctgtccctcaccccagggcacatcttgccatgcctgtgaaaaccttgacagctttctctaaattatagaattgtcctgtttagaggtgttgatgttttaagtgccagagtcaacaataaaaaatagtgggacagctccatttcctctagttattctctttagaggaagacagatcctgacagacagaccaagttccattcccaaaccaaaatgatgtttccatccatttctctagcattttttagaagagattcctgcaagtcatagggggtcagatgagatgtcttctaagttatctttgatcctgagattccgatgcataaatacatcagggctcatcacctacatagattcactagtcttacagttggttttagaattttcctctatctactctgcctttcttttgtgctcagtcaaataagtcaaccttcagtttttgggtcttctctactcttctgtcttgaatttagcattctgcatctcggtagttatctactatgacaaccctatttaaccttcaatttgaaaatgtacttaaagatacaacatgacagatagataggaagcataagtgctcgtgttctatagcacaacagggtgactacagttaacaataatctattatatattttccaatagcaagaggagaggatatagaatgatcccagcccaaagaaataaatgtttgagaagatggatatgctaattactctgatccgataactatatatatatgtatcccataaatatgtactattacgtgtcaattgaaatattaaaataaataaaatgaataaataatgccacctcattcccatcatctgtcctacatttttcactcactcagaaaatatttattgagcacctcttccatccattccaaaatgcaaattttttctcattttaacatcttgtacatcagtaggtatcttatgattgttcaaatgttatacaggcatactttgattgcacttctttttattgctcttcatagatactgagtttttttgttttgttttgtttgttttttacaaatagaaggtttgtggcagcccttcatgcagcaattctatcagtgccatttttccaaaagcacgtgctcacttcatgtctccgtgccacattttgctaatttttgcaatatttcaaactttttcatgattataacatctgttacggcgatgtgtggtcagtgatctttgatgtgactattgtgattgtttttgagtgccacaaacaacaaccatataagactgcaaacttaattgatgcaaacttaattgcaaacttaatggcatgtgtgttctgatggctccacagaccagcgattcccccatctctctccctctcctcaggcctccctattccccgagatgcaagaatattgcaacattcacttattcgtgctagtctggaacgaaacccacaatatatcttagatatacctgtagtttaattggcagcatttttttttgctgatacataaaataataatgcacctccatttgatgaaaatttagactttatgataacattacatgccaccaactgttctaggcactttgctgtctctgctctgtggtcaatttcttcttacacctgtgtgtgagtgtgtgtaacaatcctttccttttgtcttcttctcccacatttacctatgttttctgcagaaaatatgtcaatattgattatattgactaatcctacatctcagcattttgctttcaggatatagaaaggggaagcatgactcaaccagaggaggaatattacctaaatatacataatgtggcatacacaaatgatttcattttggggaaagttatttatcacatttaagttatggaggaacagaaatgccatcatgctaggtagaagcataattttgcttttgcttttatttgggagttatacatggtttcaaaatacctgcacaggtgacaagttttcaaaggatagactgtgatttacttctgcctgaactatatttctcagagtctctgtaaggtttcatattacaattcaccaataggaaatatgagatttggaaggcaggaaaggggcgcagtcaattccttccaagactcattttagttagaggtagtgagaggcagatgcagatgtcccgacaggttctagtttgtccttgttcttctcttcccaattccatgcccagttttacttgagactgcccgccttgtgacctcaggccccaaacctgcttggctgcaaactcactgagcagtagctatgcagggaaaatatccttccatatgcttccttaggcattctctttgcagtcctacctaagcagctgcaagcccctttatggaaggaactgtgtttcctacatctttgtggccagaatttggcctgtaaaatcactccattgaaactaattaaatgagttgaataatataaaattgagaagctacaaataaaaccttcagctgattttctatccactgttcctgattctggacaacaaagaagtaaaatacatgcacacattaaaaattcccattgaaaatataaattattcaatcgaatcaaaatgagattgccacatttcagaaacacattaatatccaactcttccctattcctccttttagcagcagttaacatttactcatcacatatgtaaccaacctgaatgatctcattttaatccttacaatgagtatacgaggaagatactcttatgaggaccattttactgatgaatactgtaaggcttaaagaagttaattaaagagctcaatgtcacaccccttgaaaacaggattctggcaaaggtattctgactccagaactccaatttttacacattaaacaccatctcctattgactaaaggcaacattcaaaatcgatgattgaatgaacaaggataagcatacaaagacgtgaagcaaacttagaggcccttaatttgaaagctaagtgaggtgtgatcactagggccaagtaaactcctcctaataaaattataaattaagaagacacaattatgaggattttttttccctcttaccctcactcatggtaatcacttgcattctgccatcataggaattcttagtgaagtctcgagaagtgactgaatattgttcaaagatagagaagctgcagcctatggggacaggcatcatcaagataaggatcacaggaatcagtgatggccattagtgaatgaaggtcgcatgaaaagtgatgggctcacactgcagaaggggaaatttaacttaatttgaaggtaaaacttgctaatcacaggaaaagattaagaagtggaggaggggccgggcgcagtggttcaggcctgcaataccagcactttgggaggccgaggcgggcggattacgagataggagatcgagacgatcctggctaacacggtgaaaccccgtctctattaaaaatacaaaaaattagccaggcttggtggcggatgcctgtagtcccagctactcgggaggctgaggcaggagaatggcgtgaacctgggagacggaacttgcagtgagccgagatcgcaccactgcactccagactgggcgacagggtgagactccctctcaaaaaaaaaaaaaaaaaaaaaaaaaaaaaaaaagaaaagaaaaagaaaaggccgggcgctgtggctcatgcctgtaatcccagcactttgggaggccgaggcgggcggatcacgaggtcaagagatggagaccatcctggctaacacggtgaaaccccctctctactaaaaatataaaaaaatcagctgggcgtggtggcgggcgccgtagtcccagctactagggaggctgaggcgggagaatggcgtgaaactgtgaggcagaggttgcagtgagccgagatagtgccactgcactccagcctgggcgacagggtgagactccgtctcaaaaaaaaaaaaaaaaaaaaaaaaaaaaaaaaaaaatgcggaggaggtgcaaaagcgttagcaagcagcattcatgtggagatcattaacaataaaaaaagaagaagaaataccacgcctctcaaggtaataaaaattttcttatctagcactcctagtgcaggcactagaaacgcctcagtagaccttgggaagggatctctgggaagattctctgccacttctccctgctccttatccaaaccatacaggattctactcagagggcaggggctcagaattagaagagactgcctcagagaattagggaaagtgtaaaagaagagcgaacaaagtccattctcaaagaaaagggctttctgagttcttctcctgaactccatattctgaaatgtatcaagacctgtcaaaatcagcagtaaaggacaggctcgcactgtgagagcagtctaggatgagtctttctgtttttgcttgaatttctctggttacagggatctcattactccttaggacagcctaaggagttaataaatagcctagtgcatggaaaagtgtgcctttcatggatctaaaattttcattccttcaatatatatactccagtgatttagaattctggcattttcatgctagagggaaatacagaggttacctactatagctctctaatttaactaatgaggtctactcaagatatttcagtctctgcgttgatggatttacatgtgtacatgtacaagcatgtgtaaatctgatgaattttagtaccctgtgtgtgtgtatgcacaagtttctgctgctctatttactgtagtacacaagatagaaatatgttaaaggcagagccttgaaccttaaaaaacttatcttctagaaggaaatgaaaagaagacaataaagaaatatatatggagaacatactaagtgctaagttacttaatggtaataatgataatatgtcatttttaatgctaaaaataagactttgtagcaggaaattgaagcttgggcaggtgaaattgtttcttggaatcacctagttagttaatagtaaagctagaaatttacacctgaatatgttcatcctaaatccatgcttttcctaccaatcacatatatagagctgcaatctggtacatggtatgatatattacattttatctgtgacatcatcacatttaaattcagagaagaaagagatttcttttgtccccaaaagcaggaagaactaaagaaggctccatggcacaggtgggctttcgtatacggccagaaagatccactgtgatcctaataaatgacaaaaatcctcacacagcatctttgtattcaaagactaaaactgtcctggctcataataggtgctaaaaattaatcattgctaaaataaataaggacagatataagaagtattgacagatccatagacttactagtgcttactattacttacctggactcctggaatttagcatacagaattagagtgggtagtaggtcagaaaaagtacattcaaccccacaatggcaagaacctagttagattcttcctcttcaatttatgttgcaaacaatgaggaatgagacaaatatttgattggggagacacaagagtccttgggcagtgatataggaagatgaatggagaggctttttcattatttctcattggggtgttggtggtggagctaaaccagggtaatgctaaggagaatgggggaggaagtgggcagggataatactatgagggaagaactgacacaacttggaaatccacatatttaagaagaggtaagacagcagagataaatatgacccaagagtattcacactgggatatgaggaatcaggaaatatggaagcctatttttaaaaagctgattctaaatggtaagatattccactgccaccgcaacataaattgaaagtgagtgatggtattcattttgaagttttttgcagacagtgacctgcttcatagctttgagtaagagatgaggcagagtatcttggaaaaaaaaaaagccatacccccttcctaatatattatcggtatatctggtcatttttatctaatagagttttatgctctttctctcctttttttgtaacctttttagacttcatcctatttccagtttgcagaacctggagaaggaaaaatgcagaggctcagtctcttgttactgaatccactaaattcaccagggggcaggaagaggaaagagttacagccatctcgcgccacattctctaagtctctttggtgtgggtggcttagagaagtcttaggggtactgtgctgaatagctggtatatctgaaggaggaagaggaatggccatggtgacctcgtgtgtatataacaaactatcaaacaataataagagggataaaaacctgaagttggctcggcagcaatattcaacaaggccttgagaatgaatggtaatgatacgagtcagaatcagagagagagagaggctattttatattctggagtgttttctgatcatggacaggtatgttagcaaaagtttatgaagctgcctctttcgtgtcagccttgatactcaaggttagaggagaaaatttggggcagcgataataggccaggtatattaaaaaaaaaaaaaagtcacttcaaggactagcggtgaggcccagtggatatggataaagtatctgccagtgtaggagttttacgtaagaagagaactcaagctcaaaagccagactttattggtccatagcacagtgggcgccatgaagatacactggaggtagattatagcatagtgtgcagataacacaggctctctagccagacatacctgggtttaaatttcattactattgtctactagtgggaaacattaggcaaaattatataagattgtgtttatttatttaccttatttatttctcctctgaaaaagaggactgaaacatctctggataatgggtacctcttgttgatgccttcgcattatcttccccacgtcttttggtaaaagcaccttagtctctcctggggcatcatattccttactttctgtccatgtggtttagtaaagttgattctagcccgaggtctatctatgggcattttacctaatcagagcccataagatttaatgctaggagtttttctggaacaagcaagaagtccttttctttaacattggagtgaattgggaagatagaagcttctagaggccactgcaaagagatattttgcccaagtgaagctaaaacagaggaaaggagagtggaatgatggggagagatcaagctcttatgcctttaagaagcctatggatacagtggagtctaataaagttccttctgactttccagacccataagccaatatctctttaaaatttttttcttcttaaaacaggatgcatttttctatcacatatcttgaaagagtcttgatcaataaactatttcacatcaattatttgaggattgatttaaacgatatatgcaaaatacttagcacaaggcttggcacacagtaaatgctcaacaaatgggacttgttgaaaaagatggggaatgggaagtcattcacattgactggcattgaactgtggggaagaatgagaatgtgtatacatgctgaaatgcactgagtatagcataaggataaacatttatccttctgctatataatacagatgtcatataactcccggagggacatccttgaaacatagctggcattccaaaataacaaaggttcattgctgagtcagctcttgattttccatgtgtgaattagtcacagaaaatatgtatcaccattcagctgtccctatttcaagccagctgtctgtatgtcagagcaacataatcaataaggtaaggctgaacctatttttaattaagtgaaacagccccaagattgcattgtcttttgcataattaataggttgctgaagagtttctaatgagaaatgccttccattgctttatactaaacttgactcagatcctaacaaaccacactcaccatcctccagtagagaatttggcttttggcaggaggtttccttatttaaggcatttggataccactgatcgtccaccaccatgttctttgttcagtgtcaaatgcggcaccttagcttttacctactgaagtgctaaactaaaatacaatttcaaaatttaaagttttttctcctgtcttttattggaggatgagaagggagtaagtcttgaatttgaactgatctttcaaaacctggctgttacaaattatgtgttatgttggataaacaacatcacttcacttttctgtttcatcagaatggggataataaccgctaccatataatcttgttaagaggatcaaatagcatgattatcatgtggctagctagaccaatgtagttactcaacaaatataaatcccctgatggaattatatccttatgacactcagttctcccatctctatattttttccctaagaagaaaacccatcttcccttacagtaacataatctttgtgtgtgtgtgtgtgtgtgtgtctttttttccctttttaggaattacatttcctccaaccttgaaccatgcagtttgattaggtctcaaccccagactgtatttcaattcttggggtagatatgtgtctgacctacatgagtaatgaattatcttgtatgtccttgatccaagccaggcctctcagattcaatccctggaaatagagaaaaagagacagactggcttgatggggcttctaagctgttaaaatgtaagcctaggctgggcatggcggcccacacctgtaatcctagcactttgggaggctgaggcaggcggattgcctgagctcaggagttcaagaccagcctggccaacacggtgaaattccgtctctactaaaatacaaaaaattagccaggcatggtggcctgtgcctgtagtctcaactactcaggaggctgaggcaggagaatctcttgaacccgggaggcagaggtggcaatgagctgagattgcaccactgcactccagcctgggtgacagagcaagacaatgtctcaaaaaaaaaaataaataaaataagtaagcctaaagctgctagtgtccactgctgtcacaaaatggggaaagcaaacctgatcataagacaacacaaagaaaaacaaaactaatagagatagaaatagatatgaataatattaacactggtagccagtgggcattcaatatggttcttaggcacaaggcatgtaaccaactcacaagaagcatctcatttgatgaagtaggtattaattattttacaggggaaaaaactgagtcacacagaagttatgtaacttccccatgatttttttacttagtaaatggcaatgctagaaagtaaacctcagtgtccttgaaccccttgacctgcaagttgtactgcctcccaatataattgatttccagcacaggaaagaacaagaccactgttgctgtcagttaaattaaaaggacacctattctattaatggtaatattatgctgtctcttacatgatgtcctatatatgtaagtcagttttagaaacaatctgaactccttggaggaaagttcttatttatggttgctatggtagtattaataaaaccagctcaatactcccatacactgttcttttagataaacatagaaattgacccttctgctgttaaagcttgaaacttgtatttgttttatctgagttccttcctcaggaaaggatcttcaagcctctcaaaaaaaaagtattaaagaactgaaactcaccagatcatgaaccagatgcctccttgcccctccctagttcctgttttacaccctgttacattgatttcctgctatataaacccatacttttagccagggagatggatttgagactgagcccccgtctccttggctgcagcacctgattaaagccttcttctttggcaatacttgctgtctcagtgactggctttgtgtgcagtagggtcttgaccaaacctccagtgctttggtaacattatcagaaaccactgtgataacgtaagaataagctgttgcatgccataattatttcacaattgctatttattacttccaggggtggcatgaccattgctaccagaaataaaaataattatcaatatgttaggtgatgaggaaaaaatatgaatttgccttcatttcttctctagggaaattctatgttattacccatggtaacttaacaatttgatttaacactagagaaatctccctcagtcccatacacacccccaatagccaggttccaagcagaaatgattaaaggaggtttcttttaactacgcttgctgaattatcctagatagccccatagttcctacataatttgaagtaactggtttccagaagtgagtctaataaatattgctttgattgacaacttttctgtcagcttaaggtagttgctcagagttagaaaatacagaccatgtgggcagagaccgagattttcatcaacagtcatggtactatgcaatttacgagttcccatgccttctctagaaaaatcatccaagcttaaggaacccttgtgagccatttgacaagcacagttggcactgtggtcaaaagaactttgggctctcaccactgatatgcctgagtgggctagatttccagggctcacagtcccagccaagaacgtaaggctaagaggcagagacaagagcatttgttgatttagtagagcacagactgtggtgacagacagccttcattcaaattctggctctggcactttccagctgggtaactttagccaaattacttaccttctctatgccataggttccctatctgttaatgatgataatgagaagcttacttcagaaggttgttatgaggattaaatagcttaagtttaagtagtgcttgttgcactactaagacgtgaatgggcaagatatgtctgtattcaaaaacaaaagaaggaggttttatttattttacttaacacatcaatcagaattcacatacaataatgtgtaatggcttttataaaaataattttatggcttttgattagaagagctttgctgatcaagctttcacatagaagattccttcttcaaggaataggaaagaaaatattgcaattagcactggcggaagcagtggtgaggtctgttcaggttataataatgcataaataagacctctggtgacatagaaaacactgtatatatgtaccatttacatgggaagtgttctcatctcagttcctttctcttgcccatcctttcaatatttttcattgtttctattggtaggaaccaacttctgccaagccctacttcctaccctctagttctgggcaccatgtacagatatttgcagtcatttgaaagtaggacttgagaaaagatttgtccctcatgctttttcattagcaaagcagcaactccatttccaggataaactagggggacaacattcatttatttcagtccttcatttgcttactttctgaggcctttctatgcacatataacacccccaaaaagggagagaatgaaagaaaaagacatgaaccctctcttccataaactaactttatactttacatgtaaaacacacagagatgaaggtttctcatgaatacgatacaaaattagtaagagagggagaaaaaaacgctgaccagagaaggaagattcagtaagagacagagttgagatcctggagaaagaagatgtcaatttggactttagaagcaaggctcacagcatcctgaacaagagcaccagagggagagaggtaaataagcttctgtgcaacaaaaacctcctttagttacaaatgtctcattatgataggggaaaaagtggtatcttaccatatagaagtccctgtgttatctctgagccagtttgtttgcaaatagcttgtctaactttttcaggcagttttgctagctttttaagagatttctctaatgtagttctctggctttcaactcccacaggggttttagggcagtgtttgaaaatgagaaagataaaaatgcattcctcttagaagttcatataaaagcgaaagaattggagtggaggtgggaagctattatgtacttcggtgatctattctgcctgtaactctaaaggctgatgagaggcagtgtgatttcaggaggaatcaagaggagatactttcactgccctcattacagggagatcattggctcctaaaaggtcactgtcacagtgattctaaatgacatgaataaaggatatttaaactcttgtctgagccaattccttgtaacacggtttatagtagtaaaaatcttgaaacaacctaaatgtcttttccacaggcagattagagaaattagggtaaggtagaatcacgtcttttggcaggaggtaggatgtacattcaaaggtattgataaatattaatatcaaaatcacactagaatgttctgtgatttgttcttactttgccagaatctaagatcttggaaacttaaaagccacagttaacttctgatatttttcttgttttcaattttacccacccattcccatggacacagccacctctagtttaattagggggatgaactgaggcagttaaagaaaggaatgctatttcctttgtccctttctttctcttgctgcccccttctctctctcttcacgtatttctcttttcccatacacagattcccgctaacatatatagtttatgttttgcattaattaggcataagatttacctccaatctatatttttagagcaaaatgatatgtagttaactaaaaataatgatatatgcataataaactgcatccctcaaaaaaaaacaaggcatagaacagtgtgcacagctaccatttatgtaaatgcaagtatctctatctatatatgttagggactgaatatttttgtctcctcaaaattcatatgttgaaaccataacccactatgatgtgatggtatttgcaaatagggcctttaagaagtgattaggtttagcttagatcatgaggatagggtccttatgatgggattaatgccctgataagaggaggaagaggccgggcgtgatggctcacgcctgtaatcccagcactttgggaggccgaggtggggggatcttgaggtcattagatcgagaccatcctggctaacacggtgaaactccgtctctactaaaaatacaaaaacttagccaggcgtgatggtgggcgcctgtagtcccagctacttgggtggctgaggcaggagaatggcgtgaacctgggaggcagagcttgcagtgagctgagatcagaccactgcactccagcctggtgacagagtgagactccgtctcaaaaaaaaaaaaaaaaaaaaaaagaggaagagagatcagagctctctctttctaccatgtatggacacagacagaaggcagccatctgcaagccagaaagggagtcgttagcaggaaccaaatctgccggcacattgatctcgaactccccagcctccagaacaacgaagaataaatatccgttgtttaagccacccagtctatggtattctgttacggcaacccaagcaaagtaagactacatacacacaaacacacacacacactaacacacacacacacacacacacacacgcacatttggcaattcacagaacatttctagaaagataattgagaaactagcaatagcaactgtgtcccacatgacaaggggaaggccggccaggcatgctggctcacacctgtaatcccagcactttgggaagctgaggtgggtggaccacttgaggtcaggagttcaagaccagcctggccaacatggtgaaaccccatctctactaaaaatccaaaaagtagccaggcatggtggcgtgcacctataatccaagctactgggaaggatgaggaaggggaatcatttgaacaaagcaaacagaagttgcagggagctcagaccgcaccactgcactgcagcctgggtgacagagtgagactgtctaaaataaataaataaataaataacaaggagaaggcctacaagatctaaaatcaggaatgagaggaagatctacttttagactaaataaaacctacttatttagactgaaaatcttcatctgaatatgcgatatatgtgtatataatgcttttaataataaaaagtcactattagatttttttaaatgtctgtctcaaaggttccaccaaaatataacaaagcaattctcataaagcccctgcagttcactaacctccataatccatttgaggtttttcaagaagactgtgacacattttttaacattctcttaaagtgtttcttactctaatgtcacatcctgccctgaggggatgtgggcatgtcccaataagaacagaccttatgtgagagcactggtgagaacaagattccaatgggcatttactaggtcatatctgactaggtcatatcttaatgtgctacaagataaagtgagacttaccagtagaacctgtttggtacaaccccttcttggataagctgccatcttctcccaaattcagcagagctgtataactgtaaagaacagaaattactcagcactatggttctatagtacatcaaatacacaaacatcagttcattggatcaatagtaataataataatacccaacatttactgaacacctgccatatacaaggtgagtgctccatgtgtaccatctctattccttatacaaattctgcaagtcagactaatatcatcattttacagttgaggaaactgaagcttagaaggattaaccgacttgtgagaaattacatgtcaaagaagtggttgaatgaactggaatgcacaccctgttctgcctggcgataaagtcagctgtgccacttgacctagcatgtgctgagcattgtgggtgatgcaaagaagtgcaaaatctagacctggttctggaagagtacgcaatgtaacctgaacctggctcacataatgagaaatgcacgaggcagccagtgagaaaataatgcagaagacaggagccaatttagggatgctttccagatgctgtggtgaaacagctgggacctgaacgaatgacagcattcaaatggacaaaaatagcattattcacaaaaggaacaacatgagttaaagtggtaagatagacagggacaagatataaataagcctagcttatctatgtaagcttatctaagtaataattacacattattcaggcatctagccaaggagaatctgtaactttttctttctaagtcttttttattattcttttttttttttttttttttttttgagacagagtcttgctctgtcgcccaggctggagtgcagtggtgtgacctcggctcactgcaagctctgcctcccgggttcacgccattctactgcctcagcctcccaagtagctgggactacaggtgcctgccaccaagcccggctaatttttttttttgtatttttagtagagatggggtttcaccatgttagtcaggatggtctcgatctcctgacctcatgatccgcccacctcggcctcccaaagcgctgggattacaggcgtgagccaccgtgcccagcctattattcattctttggccatcatgcctgggggagactggtttcctgggtacatttcatgtttgatatattttatgagtgccaaggagagatgggtgacaactcccctcatagagataacagaagatgggacaggtcacactgtcttaactgagaactcaaacagccagtgtatacatggcctgcttcttgctctcagcatgtcctgaacacctggtatttcaacacagaggactgtacaacaacagcaggcacccaacccgagagtatccgcttctctctctctcccctttgtcttcttttttttaagcccggagctctacttctttctataagtttaaagggaacagagttcataccattgtggtgtgcctatgtcatatagatatatcgatatttagtaacatacaaaaattaatgcaaatgtaaaagtatcaggacagttcaaaataataatatgtctgggtaacaggctgaactcatatacatgctgcaagaataatatataaactctgtgtgctcctatggctataccaaaggattgctattcctgctcccacagagaattcatctctgtgaggaattgttgggcgccagcgtttgtggttctttttttctcttgttaaatgtatcccctaagcttgaatctggagcctgtggaccactcaggtatgtcccatgacatttgtttatatcttcaaagagcaactttgttatttgtgagcatatagaggcccctcaagtggtgggtatacaaaacaatccactaaaccaagcctctcttattcagcttactgagattctttcaatttactctctccaaaggtaactttcggtcctggtgggctggccctgtcaccttctcacacatgccctgctacgccttcactgaggctgcccactctggcagaagtggcttcaagactttccttcttcaacaccagtcttgttttcagagccagatgaaaggccacctcttctatgaaccctcctctacctactaagattcctaccggtctcatctccaaagaactgtggaacaagagcagatgctatcaaactaccagccacgtatttatatttaattctcttaatagcctttcaagagaacctttcacaaatgcaaggcagaaattcctttctatctaaaattactctaaaatatctaagaccacttcctgcctctttaatgagattgcaaagcttttagatgttggaaatcctatccttctacgtgtacgggtgcctcaaacacagtagatgataaaggaaaaagataatgattttgtaccacgtgaatttcctagtcacgtttctacctaatagagaacacaggtttcacaattggtgtacaaagaaaatttatcagaggaatatgttttgcttccatggatttataactagaggcgtatacctaaaaaacaaataaaacacacatccacaaaaccctataaatatcagtatatttgaaactcccaaggatttgaaagcagagtcttgaatattcacttttagacaaaattgctctatattctccacctactacttcagacattttctccctaaaaaattaattgtccagcctggtgttataccgaccaaaaagaaaacaacaactctgccattcaagttaacgtgttaattaaacctacagagtctggaagcaaagtgctcctccacaaagaagggaatggtatcaaagcattttacccaatgactgtctcagccaccagcggaaggctttccctgtagaatgagtcaatgtcctttaataaaattcatagtgttggcagcacctaagtaagatttatttccctccctgtctgtctctgactccaaggtttcttttgactgtcagaacacggaactgagaactatcattactatctgtcacatcagagaaagcagcagcagctttctctagctatgccaagcttagagaaagatagaaagattaggaagagaatgaaagagtacttaaactagttttaggagggcactattcctctactagtgccgtgtcatgaacttaaaaatgccattcttggccgggcgcggtggctcacgcctgtaatcccagcactttgggagggcgaggcgggcggatcacgaggtcaggagattgagaccatcctggctaacacggtgaaactccgtctctactaaaaatacaaaaaattagctgggcgtggtggccggtgcctgtagtcccagctactcgggagactgaggcaggaggatggtgtgaacctgggatgtggagcttgcagtgagccgagatcgcgccactgcactccagcctgggcaacagagcaagacactgtctcaaaaaaaaaaaaaaaaaaaaaagccattcttgggtttgattttgtttagctaacattagtataaatgttgaaaaagaactgaaggagcagaaatgttagagaacagggaaagattctggttatatctgcaataagaatgcaacacagaaaatcctttctgtgtaaaatcattctaaagtatctgtgactacattgcattagtaaatacaacttaatgagcacaaacccaacactcacctgtgctcaagatctattagcagccttagggcctaaccctccacactgtcattatgctactctggggctattagcacttctctctctatcctgacatgttcctctcctgaagggtttttttttttaagacatctttcacattggcttgtttccttgccatctgtctttgtttgctttaagaagaatgcagataaaaatacacttaattccaaaggatgaaattgccagggttagtttcattgagagctttgagccaactgttaggcatctctggcgccatcctctgaatgtctttggagctgccagttgggtggtaggcactgacaaagagggatgccacagcagggcaaaatagcctgggggagggaaagaatgggatgcactggttttgctcaattcctagtctacagcagatgaagatgggatgagagaagggtagcagccatttccaactttcatttccaccttaacattcacattttggttaaatccctagaagagtgacaacttgctactagataagaaattcaactccttgtggtgatccacaagcttgcaattgtcagtgtccctagaaagtcttttcaatattcctaaatcggatcaacgtatcctctcttttcagattgttagacaggtgcacgtgatagaattctcttttgcagctgggaaatgagtgaaagagcatccatttcaaagaaatttgtgctacgagaattccatagaagctaagagttgtgataacgttttaagtctttggttcatgggaccagatgttgttcaccacaaagcttcccacggtggcttccccggtcaaggggtagtttcctggggatcctccacacaggctccttaggaggcgcctgtgttggcggaaaacatcctgctgtcggctcttttcaaggttgcctgcccactcctctttccttctctcctcttaacattttggaagcagggggcctgcaaattgtacttcttgaaaaggctgacagaaaatcctgccagttctattttatttgcctcatcctaatactgccctggggatggcctgggtacaaagcactcatccaccttatgactctctgcttctcactgctgttcctccatccttttttagcaagaaagagatggtaccttaaggacttcatataaattcctaatgccaggcctgaggcatcacaaatatcaagttcttttttccatcaccctcaataggaagaaagagaatcagtccagagaaaaatgcggtcctcagaagtatgttctgatgctctggttccacagcataggagggggccacgacccatgcaaaggggaaccaaaatctacaacacttaaaaggattccataaacttcactaagagctgacacaagtctttaacttggctgttccgtacagagagcagatagtgaaagagccatgatgcccaatccagacccccacacccaaccctgccccaatagatttaagtttctcaaagaaaatgttgtgtattagtgatatcacagacaacctacagtaatgtgtaatattttgtgcacagtgttgtagtggcctatgttgtagagaaaaagtttggaatttgcaaaagaattcacagcgggctttgtaatacaattaatatgtcttagaatgaagacatgcagaaaaagtgttctaggggaatgggtcagtctgtgcaaataaacagagcagcaaaactcagggtgatgttctcacatttctttggtcaatagcaagagacccagtttggctgggatacataatagagtgaagtggaagctggggctacaaagagagcctggaaccaggctgggtaggtgcaatcttaccaatacttgtggggagctgatgtagactggatccaaatgtcattaaggtcaaaagataagagtatcaaagctgaacagtcaggctttgctgatgaaggctgggcaggaatgatggcctattgctggttccaccaatctctcctacagctggatttatcaaatttgtcactgcccattccccagctgtcactgaagtctgtcaaatgccctacagttgagggtggtactctgaagcttggaagattagacttacggaactagagccggttgggaagggagggccaatatatgactgtgggcgagtttgatttgtgaacacctcctgtgcattcaggtctggaggtatataggaaaatgataagataaaatcttggccttaaagattcttatatatttatttatttatttatttttgagacagagtttcgctctgttgttcaggttggagtacagtggcgccatctcggctcactgcaacctctgcctccagggttcaagagattcccctgcctcagcctccccattagctaggatcacaggcatgcaccaccacgcccggctaatttttgtatttttagtagagaggggtggtttcacgatgttgaccaggctggtctcaaactcatgacctcaagagatctgcctgccttggcctcctaaagtgctgagattacaggcatgagccaccacgcccggccccttaaaggttcttaaagacaagcgttggtggcatagaacagatgaagaactagctaaaaatttggacaaacaaatacctctctttcaaagcctacaaaactattaaatagcacaattgtgcctgttcaaatcttaaacccaattgcttgttttaaaatgttcatttctccttattcttgtagctctatttttttttcccgaaatcattagaaacaggcaaatcaaactgttccaggtagcaattgaaaaataatgatacaacctgtttaaacacagtatctaaggtgaacgtagtaggccttccttgtttgcatatgatggcatttcagcttgagaattcgttttataaacaagtgttggggttgacatttagcgagctccctggtttccactctaattgccagttttgtacttggatacttaaattactcacatattcatgaggttagaaatcagatctgacactgggaaatttcaagcacatgaaaatcctgccaaaccagcatggtatataatgctcaacatatttcttataaaaaactgagtgccttttaacttaatgcagtgccttggggaaacatgatggcattaggtagatatcagtttcctaagtgtttgtgcttgtgcagaaatcatttgaatatccccagggggttgaatttcaaggatcaatttgtctttatctcaatcttgcccttttgacattaaggggctgctaggtctattaaaaaacaaatagagttaatgtgaagataaatactttaatatttaatggttttctattgttataatcaataatatttctaagtaccacatatctgtcggtcctgttccattcattctgcttccatgggaccttttagtgattgtctaaaaaggcatttaaattaaattgattaaagtgcctgtagctctgcgtactggaaaggcacagggataagacagcctctgcctaagacatgctttgtctaattccagctgcaccacaccaggggtgctttctttcaggtctttggataatacactggctggcatctatgccatgtttgctatgtgtcaggctctgtgttcatattttgcatgcgttatctcagtatcatcaaatagtcccatgagccaggtactcttattattgttcccactttacagttggagaaactacatttaaacgacctgttgaaggtcacagagcaggggtaggacgtgacagagcagagagctgatcctcttaccagctcactctactgtcggtcagtggtgagaaaccttagtatgactgagattttgaaagcgctggcatctatttctttattaagtagtcaatatttcccagggaatgtctgccattgaaagcagccatgataagtattgcccttctgtgaaggctcactcaggaaaagaaaggaacaattggctgggagcggtggctcacgcttgtaatcccagcactttgggaggctgaggcaggcagatcacaaggtcaggagtttgaggccagcctggccaacacagtgaagccccgtctctactaaaaaatacaaaaattagccgggcgtgggggcgggtgccagtaatcccagctacttgggaggctgaggcaggagaatcgcttgaagccaggaggcggaggttacagtgagctgagatcgcgccattgcactccagcctgggtgacagagctagactccgtctcaaaaaaaaaaaaaaaaagaaagaaagaaaggaacaattaaaaggaataaagagaagattttttgtttatagatatgtttatagatatacatgtagaatagatatgaaactttaaaaacattgcaggactggtagagagagaaagaaggcagagaactaaaattagttcttttttaataaaattcacttttatgcatgttactaaaattctgtcattggctgttcatcacattggcagtccatttttccttttctatcaccatatgattttaactgaaagtcagccttcatttctgaagagaatgccagctgttaatatttagagtttccagccaggcacagggctcacgcctgtaatcccagcactttcagaggccgaggcggatcacttgaggccaggagttcgagaccagcctggccaacatggtcaaacccagtctctactaaaaaaatgcaaaaattagacaggcatggtggcaggtgcctgtaatcccagctatgcgggaagctgaggcaggagaatcgctggaacccaggaagcagaggttgcagtgagccaagatgacatcactgcactccagcctgggcaagacagtaagactgtctcaaaaaaagaagaaaaaattagattttccattatttgtaaacagaacctccctatcaaagcctgttttctgcctttaaaagtatgttttggtatctgacacatatgtaccaaaaaatgttgaagggaaggccaacatacaggccttaggattttctgtttatttcataaactgtgatcctttggaatttaaagaagatcaggaatgaagcaagttttccacatgttcttacttggactcatagagctccaaaataagcgagtcaatataaacttacaaatattctagaactgccacaaaataaagggtggcccaccaaactgtcctaaaagttttattctccctcgacaaaaccgatcatttatttgaatgtacttttttcaaaaaatcgcaaaaaaaaaaaaaaaattaacatcttctcaaataaaatcaaaagagagacccatgaacaaagaaaaacaaagataatgggaaagaagaaaggacaaccacagggcagcagatgaggtttatttgtcctatgcagtgcttctttttaaatttctgaggtcattgttacacacataaaaataagaaaacttcacattgaaaacaaagcagaattacttctctcaaaaaaagaaagaattctgaaggtctggtgacattggacccaccttcctacatggcaagaacagcaggctagagcttgacaatatccctccctccttctaaatgaacacctgctctccaacttcccacagcctggacccagcctgttttgttcagttgtacttcttgcctgtttgtataggaactgcgttcatgctctacgtggtcttgaacgtccacaagggtgggaattgcacaggacaggagaagagcagcccttcctgctcctggtaaggggcagcaggcccttctctggagctacctgaagaagaggtctggataaggacagcaaggggcctctgctctccagccactcagcagcaagagtcctgacagcgttcatgttggtttcacaacatggcactctcccctttacaaatcacgtctccgttgcaaatcctaacagaggctccaagagcccttaccccggcatagacagcaaagctgaggtatacacagattcttatacttctctcctgttttttttttttaaatttccttacagtcacatctgctctttgttttctctcatttcaaatgtttcccaacacatcatgtttagtgaggtgtttaagacagactgagagatgccgttggaggcaatgttttatagcacagtttgtacactagtttattgccaaattgaaataaagatgtaatctggcaggctcagccttctgctaagccttccttgggtggtttcctgtattgaggcaagaaagtcagctagcaatgaagtaaaggactatatctcctttctcttatctgctcagtttccaaatgcaaagaatttttttaaatgggtagaatgcttggtttgcctactgtttaaattatagaaataaaaaaagtaaattaataaaagaaagcaacattttggtgctcctataataaatgccatggaattcttcatactttccacaaggattcattgttttaaaaatgtgaggggtgggattgtagacaccaagtagccccctgtccatttgaaacagaatctctataattgtatctataatgttcctttttctgaagatttcagggctttccaaaggcacatcctcacataggcccttcagaggccaagtccagctcctatgtctttactcgataagtctcagggcagggtttcctatgaacgcaggctacttatttaagaatttcaatgggtaaaaggctccacacattttcctttcagtcattctagtggtgcctggatagccacatccccagacaagatagcatttacctcttggcaactatgatggtggtcaattttatgtgtcgacttggctaagagatgcccaaagagctgataaaacttatctgggtatatctgtaagggtttttttagaagacattagtgcctaaatcagtaggctgagaaaatccaccctctccagtgtgggcaagcatcatccaatccttggaggtgttgaatagaaaaggcagagggagggtgaattccctctttctttttgagctgggatatccatctgtctcccctggccctcagacatcagagttcctggttctcaggactttggacttggaccaggacttacaccattggttccacccccaaccaattctcaggccttcaaacttggactgaattataccactggcattcttggttgtccagcttgcagatggcagatcttgggacttataagcctccacaattacatgagtaaattcccataatcaatcaatcaatcaatcaatcaatctctctctctctctctctcccctcctctctctctctcctccccttattggttctgtttctttggagaatccttaataatacaaccacctagatgttgaatatcacaaatagatttctccttctaagtaaaaacaaaaaatatcaaaaaccttggtttgtgaattctgaggacatttggccatacacattcttccctgattaaaaccaccttttaaaatcttaatatgacctcccataggactgatatccagtaaaattctatcttggaccagaaaggaacacctgttcaacaaaactctttgagtcccttataatgcccacatcaaaaagcctccactgggatttaggcacccaaaatgaaacacaattagagcagggtaccgcagctcatatacggtctatcctgcaggccggagctccaaactctgtccttaggagcttaaaagtcacatgcactgaaggagagaaaaagcaatgtcagggagataaggggaaaataaatgtggctatgtgttcaaaagacggagagtatgccttaaaaaaacaaggaagccagcaaataaagaaaaagagaaaagaggaggaccctgttcataggaattgccacctcaataatgcattttctaagggattgttcaccacaatttgatgtaaaacagcatccagcagagataatactaagtaagatcctagctgggagatctgcagcagtgacattagcagctgtcacagaaaaactgatgagcaatacttacatgaaagaataaatgttcctgtttcctaggcaagggcagtcactggccagccaacaccagcacatggtcctccttgttgccacacatctcatcagtgctaaaagttccacgacccatgggggactgtcagcttttatttccgtatcactgacccacctgagtggccacagaccctctcaacttgacttccagccaatgccatcagctaacggctgcggctcactcccttccagcgaatgccccactccctattctgtgattcaagccttgagatacggaggtcttctctgattcctacttgtagagctggctatccatgatgtgttttttccagtatgatttatccttcatcctctcttaaagaaacagagaggtcagtagaaagcctggctctttcccatctgttcatctcaaaatatcaccttcaaaaacgagaaccctggctgggcgtggtggctcatgtccgtaatcccagcactttgggaggccaaggtgggtggatcacaaggtcaggagtttgagaccagcctggccaacaaggcgaaaccccgtctctactaaagatacaaaaaattagccaggcgtggtggcacacacctgtaatcccagctacttgggaggctgaggcaggagaatcgcctgaaccctggaggcagagattgcagtgagcccagattgcgccattgcactccagcctgggtgacagggcaagactccatctcaaaaaaaaaaagaatgagaacactatcaaacgtcaggtagccccttaccccatttgtagaatatccacatgtgataccaattagtgatttttccctttgagaaaatgtgttaacctcttagatatttagatccttggcctcatacagaaaaacaacaacaaataaatgaagactgcttccaactttaaaatgacaggattcattgggtctgtggtcacaaagggtaccttttggttcttacccttagcatctgatgccaggactgctgtaatatcatcccaactggtcttgtttttgacctcatattaccacagtttatactgatattactactgattaacgcttgaaatctatagccctaaacatatcattctctggatgcaaatttctgaaggctcctaattaaggaaacaaaaattagttttcctaaaaatcaaacagccaaaacagtgaaaaataataaggattaggttccaaagtgtgtgtgtgtgtgtgtgtgtgtgtgtgtgtaaattataactagctataacaaattttagtttcagccaaatagaaaaatttgcaattttgtaaatgtgatttttacaatttcatgtatatgacattcctgttgtaaaaaattggcctcccctactgttacaatagaaatccgacatatccattaaagtccagctgaagtcattttgtaagacttctagagtagacagatcactagatctctatctcctgaactttgagctaccaatttaatgtaattcatccagtcccttgtatataatattcagtgacagcactgcctttgtggcctctcttaaactattggtcaactcatatgtgttaatcatctatctccagatggatagaatattgttattttatatcaacactgtatcatgcatggcacttaaaagagatgtggcatctaacatttgtttctttttaaatcactttggaagggtacctacaattataattatccatacaaacacattttaacgcaaaggaaaccaacgctaaatactattcaccataagtagctgggatgaagtcacagcccaggcatcctaactggtcttgtatcatccactctgccacagtgaccatgggaggcactctttgaagtgctgggaacgaaagggttacatatttgggcatctcctccagcataactgcaaagatgcaaagcttttacttaggcaggtaaatctggtcctcgctgtgcctctggcatcggtgggggggaattaaccaactgtcgaataaaatgtaacaaccctgtggattaaatgactaatactctgtctgagctggtcaggcttcgcctctgttaattgcaccatcctggaccagatgcactgtggcttgactccagaaacaaaattgtacattctgctgaaagggtagccaggctgctcaacaggaaaaaaaaatgaattgtaaattctttctatttttaggattaatgtgcattttatttggcagtaggggcagcatgaataaaactccaatcttaagaattttaatttgcttcctttaaaatgctcctgtcagtagagaccttgggaagttgctcataccattctcctaccttcaaaaatgccacatatctatgcaaacccagacaaatgaaaccccagaatattcacctcacttagttaagtccagtatttctttaaatttatataatttctaattcatgatccctctaaggagaattctcagaatgacttcactgcataatgcatttcacaaggagtattctagtatttcaccaattatccctctggtttttatggccagagtctctctcacatttgcctgtgtaaatgctgtttcttttcattttaatttaattttattagctattgctagccttttattctacctgagaaagcaagttccttaaaggcagggaccatatgtatgttatagtatatatgtcgtatagagtacataatatatattataggatgacattttatgggtcatatgcacatatacacacacacagctaataccatgagctcatttaatcctttcttacgaagtggacttcttcaactttaccaccaagtgaagaaaagttctgagatgactaggttctgcataaggttacctatatacatcattattgttcctctggccatttctctcagtgttttagaacaaccctgcttcgtgttcttaaacttttcagggttatgcttccctttaagagtttgagaaaagccatgggtctttcaccaagagaaatgatcaccaatccacaaacataagacactgtctccaattcagtgggggtcagaggctcctgactgccttaagcatctatgctgagaactgcttctccaccatgtcttacttagtacacctaatctttatttggtaagtggtttcagatatttacatgatttaaacaagcaacctgagactctccttgctttcccttgtcccattagcacagaggtcaggctactgctcagaacaaaaatgatcactgaggtgaaatggagagatgattaaattagcactattttccccggagaaccatgcttcattgtctcaaacaaggtaagtatgctcaccttttggtcttgactgtatgccagaatccagtcttcttgtttggggtgaaaaagcaagctttgaatgtagaagttcagccggtacttttgataagttgccccttcatctgagctgatcaataaactgctctcaatctccgggtctgtgagtaacattatctgcagcaaagaattgttggagaaagaaacaacagaaaattaagtttacaaatttgcaaaacttgaaaattagctaatttttgacaagggaaggacaggggcaggcaaagaatgcttggccaaacagggaccttgactctgtcaggattatttttccatcttggatcaatgctacagaaatatttctacaaagaaatgaagggagtaggagaagctggaagaacgagggatgaaatagataactgtattctcttctcttttaggggactctttgttttatttccaaggttatttcctgaacctggaacacttacccttcttcccttcttcctactgtgccttatgcactttccattttgggggattaacagactggttatagtctgctgtgggaaaagtggaagagaaagaggatggagtccattgtttttcttccctacctcgaatcttttcattccacttcaatgatttcctacgccatccaaacttagcctgattttctgagtcttaagtcagtctaggctctaaagctttctctaggaatttcacaaaggctattttaccccaccaccctcatcaccttctagcctactatataatttacttatttattttgtttcttgtctatataacctctactaaaaaataaaccctgtgcgaacagagatagctgtctgtatagttcacagatgaattcccagcagctagactaaggtccagtatgcatggtacactgataaatatttgtcgaatgaatgaataaatgaatgcatagaaagatgcccagaacactctgagatatggatggaagcttcacaacttctaagtctacatgactctctaaaactctctgaaagaaaagttggttgctctgcacagtctgcaccacagaagaagctataaatacgtaaaaattcacagcttcagacgttttacactgtctcattgggatgcccaattttgtccagagcaatgggatcaatcacaatagcagcaagatggaggagctgccttcgaaactgccttaaatcctcattttatgccttcacgaatgtgtgataaattacttcattcccaactctctgtgggtctttcattcaaagtgtgcacctaatgtctccagacaggtggccttaatgctacccgttgacctcttccccatcaacttattaattggtactttctgaatttggttcagggaagcatgaaatatgtgtttaatgtgttgctgtatgaaaagaaatcactgcagcccaaggattaaagattaccagctgaggatgctgcacttccaagaaagagagagagaggggaatagaatcatatcttaaaagagcagagtgccaggcaaacacatggagctttctcaagcatttggaggcaatcatattaaagcctctgaacagttagtgtcatctttgaaagtggtgtcctgtcactgtaaatggcacaaaaggattgcatgccagacactctgcccaaactctgtttatgctatccaggacgaatttaaggttccttgctgttctttcaacctccccttcttgaagaggagaaaagggatgtaatggggtgaaggcaatgctgttgctatcagctacactcccgacaagatgaaaagcgcacacaaaactgaagactaattgcctcttgtaccatgttccaggaaagccactgcccaccaaccataaattctgacaaagttatggatttctctgtctcacattcaccaagcagacggcgttccctcatcagatggccgacaaggagccatcaggtaatctacgaagtataaactcatatggcttcattaaaatctagtgtatgcattaagcaagtacatttagatggctcctaaattcacaggaatatttccaagtgagttcatatttatgaatacataaaacctgtcattttttgaataacaaataagccatcaaatgatcatattgttttgtgtctccaatcacaattaacaataatgtaaaacaacctttttgcactactgccgaaaagtcatttccatgataatatgaagaagctcaattttatagaacatctattgtctcaggcaaggtgattcccttccccactctgattttctagttccctgttagccagaatatgctttcctcttttcccatgagtatagatctccccacctgcttctcctggcagaatacttaatcaaaataaaattaaacacaattacaaactaggcctacagaatattcccaaagcaagctgatttttatcaatcactttaaagtatttttgatacccatttatgctccacgtgatcagactgcataagacatcctgtatcaggtaatattgggtgcgagtggcagagtaacgcacatatttcccaacagatggaaacttaatattataaaaataaagcgactcgtatctttggctttttttctggatgttgaaaataggcagaccaaaatcccaccttctctatgcagccctcacctaaaactctccatctgagaatttgacattttggaaataatgggaaatagaaatttcccggtgagctttataggtatgtctgtactacagaaacattccagtggctgctctcttaaatttctgttcaattctactcagaacaaacaggtcaatctggatccatttttcattagttatttttcttattgcagaaacaactccataagacctctggtagaattcaaaagaaaaagaaaacaaactcatgaccctatcattgcaagttaaaccatgtttgtgtttctttctacttctttatccacatctctatatcctattgtggattgaggattttattctggttttttcttttaagtttgacattatggcccatattttttttttttttttttttgagacaagagtatcgctctgttgcccaggctgtaatgcagtgacacaatctcagctcactgcaacctctgccctctgcctcctggctaatttttgtattttagtagagatggggttcgccatgttggctaggctggtctcgaacccctgacctcaggtgatctgcctgcctcagcctcccaaagtgctgggattacaggcatgaaccactgtgcccagccccccaaatattcatttttaactgagccatagacacacaaatgcacacacgttaacacacatgactgtataatgtactccaattaatcacaaccttcaaattaattaaattatgattgttgtaatgactgaaacatagtatgtacctaattgttaattgaataagtaaaatcttattattttagtcttaaattcaaattctttaataattttgcttcaaatgaattgatgtttgtcctaccattttatcagtaataaaatataaataagctaataagtaaaaaatttaatgcgatctaaataaaaaagccttaacatacttgagaaacaaacactgaaaataataaatatgatccagtctttagacatagatgatattgttcataaatgaataagtcatatcttctcacaagattttctgctcagaaatattttcaaaatagtaagttcaaattagcaaatattcttcaaaaacaatagattacatttcttaaagatgcctaacaatccctatttttgctagtttagaatgactctttatccccttctgactcttcatgtaactttgaacaaataatgttttgttgtgtttacttctctgtattctggagcatgttctggacaacagaattttagcatgcctttgtaaaaggcatgaatccaagctttgcagattcctaaagtaagctctccaaaaagagaggtcattgtctgccaggatcaaagcttgttccatagtaggtccacatactgttgtaaatgaataaaggaatgaataaatgaatgagtccttttcattcctgccttctgctgcctgcaggccaggggcccctgcaacactgggatttccagtccccttgagcaaatcctcgctgttctacttgaggcaaggaaggtgaagataagagaaagacactgcctttatcaggaaagtaattattccctgttcagttccacccatgagtgattagaaccagtttacttatgccttgcagggtgtgccgactgactgcacctgcagatgaattgtttccatagaaagtcaataatggcaacacaggatcctaccacccaactccaagcaatcattcatcacccacttcagaaggaagaagaaactttatttgcttttcctagagtagacaaatgaacatgaaatgcaatttatagatttcaaatacgtcacttctccttttttttttttttggtattagtccttctgacagctcagtgtcatcaaaaattaaatgcactttcactgtctttagtttgctccagattcaacatatggctacaggaagtaattctacaaaaggttggcaggcagctttctgatccttccagttgtcgtctcctgcgggccttcttcccagaggaatgctgctactatttagttttccaaattcttttcctagatatgctgttcttggaattccaccatttattggtttatgtggcgtggagttaataaaaagttcttcaccacctccgggcatatactttttcgtaccatttctttggtcctaatggaaaaagtatttattttatatgttgttcattatttgttggctcatttgtctattctttgtcataaatgggctggaatcaagcagaggtaatgggctgctgtgtggatatctcttttgctttactcagagcttaattcagctccagatgcccatatcacaggtgcataataaatgcttttcataatgataatgacaacagcaaagaaaaacagcaacagcagcaattaggcactccagttatctactgctacccactttattcaaacagaaatatttctctctataaacagaataaaagtctatttgcaaacctctgatctcaaaattaaaatcaaattaagcaaaatgtaatcagagaaagtaagtcatctgctgaccaatgagggtggaaaagctacctattctcaatgagggctgagtacttatccttcccagatgagctgagggaaagagcaattaagtgcttatcaattggcaactatttggaggacagtgttagggaaagttgaacaggatcccagaatgaaccatggaaagaaaatcacagaaatacaaacagtgaaggaaggggaggaaggggattaaaaagaaaaaagctcaaatcaagcacacactgatagaaatgagtcaaatcaagcacacactgatagaaatgagtctgtaagaagatggaaatgacacaaccaattttcctaaatcccatccttccaaactcagcgaagcttacctatgtgccatctttgtttattagcacaaaatcgcgtcattcaatactgagatgaacagaacatttaggcaacagactgtctgcttgtgacctggaaagtgattcagtgaaatgactgggaaactatggcattgtattttaaagagtttattctgtccttttgatttcaaactggttttctaatgaggatccacagactcagattttttaacggaaaaaaacaagcataaaaaacattttttaagacaagatcttgctctgtcgccccggctggagtgcagttgaatgatcacagcctcaaactcctgggctcaagggatcctcccatctcggcctcccaaaacactcagattataggcatgagccaccatgtaaggctgggaagaaacatttttttaaggagcatgtaatttcagtccttcatatgtgtgttaattgccttgtcaggagacccaacccattaattattatttgtaacaataatgaggagtcattcagtacctcttggccaattccacagagtacatagaagatgagtaaggtttatcaggaatgacaacatatgagttacagtccttggaagatgattcaaaaaagaaaacgtataggacatctcttcttatttcacttgggactactgaacatagtcttctcctttgagacaatttagagaaacccaaacgtacaaacactattttactgtaagaatctgcttccaccattgtgaatggcactgaacttctataaaggaaatatatgtccacgtatatatttccatggcgggttgatccacagggctgagcatggggctggtgcaccacagacttctgttccacaggaagagccataacctaatcctaaacctggctctagtcaatgtcttcatgaatgtgtacttttcctcacaaaatagaaaagaagggagtgtgcttagtgaaggtcattcacaccatgagaagaaaggtaagctacaatcacaagaaatagtaaggggcctgggtttaaaaactcggatttgaatttcttctctgctattatcagttgtgccactttgaataccttatagctcattaaatcctttttttgagtctcagtttcctcattgaagacagtagtgataccacaaacaagttgccatttattgagctgttgtgtatcaggctccctgctaaagctttaaactaaattattccatcagattgtttatgaaaactacttcaggtagatatcattatgtccatttgatatcgggcttagagagatgaggcaatttgctcaaggttgcacagctagtcagtggtaaggttatctatgtcatgccctgcagagattcgtgtgaagatcagataagattatctgtgcaaaagcactgttaagttttgtgcaaatattgcgtttacctcacaaaggatgacatatatagtactttatgttctgctaaaatatgatagttgaattccaaaaaagagagggaaagagatttaaatctggcattacaaatatctcataaaaatattgcctagatgaaaaaaaagagacagcaagaagaaatggggtgtaagataatggagaattccagtaacaagtgtaagacgacactatattcttgaacaaataaagataatttcttggttttaaatatacagtcagaagatcaaaacagccagttatggttcataccccagatttttcacaatggctctggcttcctttaccttgtccttccagcatgattcttccgtagattggattttatgctttatcataaaaatggatgggaaaaggataataggaatgggcaaaaatctctgatgtaatgttcttattggtggagaaacattttcccacatgctagttcgcaaagaagtttatgctaaagcaaataagaactattacagtgtaactattttcctaataagtgcatcccatgcttaactgtcatttaaaaaaaaaacagactcattttactggagaaattgctattattaatatcatatgaggtgacagtgcagaatatggaatattcactaatgcttagcattgggtcatctggtttaaaaaactaaacctggggccgggtgcagtggctcacgcctgtaatcccagcactttgggaggccgaggcaggcggatcatgaggtcaggaaatcgagaccatcctggctaacacagtgaaaccccatctctactaaaaatacaaaaagttagctgggcgtggtggtgggtgcctgtagtctcagctactcaggaggctgaggcaggagaatggcatgaacccaggaggcggagcttgcagtgagccaagatcgcgccactgctctccagcctgggcgacagagggagactccgtcaaaaaaaaaaaaaaaaacctaaacatggtatttcagagggaaataatgatgtacacattcaaagaatgtttttattattgcagtcactatgagaactaattaaataccttgagaatatttgagccaccttaaaaatctcattatcctatagcctccgttccaacccaatcagaacacacttccatcaacattacaagtcccaaagtaacttctctcttaaatccccaaaggtctataaatgccaaaaggttacatcattttaaaatgttagctgctatcagaaggagccatgatgctaagagaaacagacattcatcttctttgctcatgggaaactttacaagaaatgatgttcatttaatgataagaaatctctttattccacaagaaatgataaagaaacacaggtgagaaggaagagagagcaggaaagagaagctatcagtctatcttaacattgatttaagtgagggaaatccatttttggtaaaatctgtaagttgtgtacttgactttagagtttgaataagtgtcaagttgaaagtcaggaaagtaaaatgaaaagtccatagacattaatccactctaaaaatcagtgaacagaatccatccacattcttcatcccttgctgtatttgtatcatcatcctaatgaaggagttcaggaaatgccaccccaaaataccctgctttggtacactgattacctcaaactgagggctcttggggaacagccaatgctggcaggagctctctctgagctctccttatctgtctgaagactgatctaaaataactcaattgtcataatttccttccccaggaatctcatcaaccaaagatgaactcagattacagaagagactagaagttgacattacaaccagactcgctatcacctgttcttctgagggcccatttgtctttcccaaaattcatttacttttccctaaattgcctacatccctcctctcctccttcctatgaagtgggcatataagcttttagatctcactgggtttttggtattcacttttctttcatgtgatgcccctgtacatgtaatacatttgtttacctgttctcttattaatctgtccagtgatggtttatttcatggactcaattataaagcactcagagggtagagggaattttttccctttcctacactaacaagtacgttttaattttacttatattaatgcttcatgataaactggcaaatatactagggtgtactggggaagattaatgaagtctcagccacgtgagaccttgctaatgtatttgactattaaagctttcctgaaaagactacggagaccaccagggatttctcttatacaggatttgcagattagtgaagtgagaatagcctggtgcagctctactgcagagctctttggaagatgggcctagagggggtcatccaggaggaagcctctcatattaacaatgaggtccatttcatgtaaaattttccttccttcttcagttatttaatgacaaacattgatcatctcaagttgttgatgagaggtggaaaagggtcaatgtgcttaattgacatgtcagagcataattacatcatctgctgctttcctctctctttttggatttcagtcacagcaggaaagacagcagtgcggtgttttatgaagatgatttttttcatgactgcatattctaggtttaattctatctcaatatacatacctcagaagcattagaactgacatagtatactaaagagaaaaggagttctattctacttatgtattgtataacaatctatctcagaacagtggcttcaaacaagcattttgttttgtttaagattttgtgggtcaggaatttgggaaaagctgagctgagtaggtagtctcaaatccacatgatgtcaactgtggtggccagagttggatatttcacttccaagatggctccttcattcctgtatctggttggacctctccctttctctctgcatgacatcacatcctccaggaccccccatgtggctgaacatcacataacatggcagtttcataatagttgaatttcttatatagcagtggtttccttcagtgtgaatgtcccaagatcaagtattccaaagggctaaagtggaaggtgcaaagctttgcatgacccatccttggaagacccaggacatcaattttgccacatgctattggtcaaagaattctgggccagacttaatgggaggaaaaaaatagacttcacctctcaagggaagaaaagcatgcacacgcacacacacacaaacacacacacacagaagcaagccatattgaagataagtaaccacaactatcttctgtaaaacttgtcacataatttttaaaaatagatatgataaaaagttgtaattattatattcaatatgaattaaaatgtcctcataatcatagaattcctgggatatagatatcttgaagttgccagaattttcattgggtcttaccttaaacttttgaaggctgaaaaattctaatctgttatcagattaaggtaagtgtatttattgaagaccaagtgaattgcattgtttagtccctctcagggacattaagggagccaaggttgagtaatttcagtgtgtgaattttcagggtacataaattacccagattaaattatagaagaatagaccagttcaatgtccattaaagtgtgcctaagcaactctctaataaaagaacctatatctaggcattataatcccctcatttaattaaggatctgatatcatgaaatatgggtttcttaagagcaaagtagtccttgctcttctatgctcacagagaaagcactgatatcatttacaacataaaccagaaattgaaaataggatacttagtgttcccttcagtttggaaaatggatcttaaaataaacctaatgattttcaggtatccttgggctaacaacaacaaaaggccatttaggtctgaaagtgaatggtaaatgtattctagaaacataaagaaagttcaatttttatcatgcccaggcccacataaaaccatctaaaatttttattttattattttttaaaattgtatttgcatctggctgcatagctcaattcctgctgctgctatgccaaccctataaaacactcatctgctccaagttattaccaacagggaatccacacttcaagaaaataaccacaaaatcagctctcttgacatcagtggtatttctcaacaccccaaaagtattttgtatgcaaagggaacaaaaatgttgccttctttaaaccgtttcaaacaacacgatcttttatggatctggcctagtatcttttatacagctagtcaccacaattgcttataggcaaggatcctcatcaatcagaataattcctaatcaaggggctaccatgaagtccaattataaaagctccaattctgttttgtgactatacaaaagccattttcagacccaggttcatattcatgataagttgaataagttcatgaagatactgtcattttaaaagttgtctgatcttgattcaagagctgccttgatcatatgaaagacagttcatagatggtttggctttctttgaatgtgtcatgaatagggtgaacatacattacatgttgcctttgaaagtcttggcttattcctatagcaccatcataaatattattactgacatgcagatatgacttggatgataaattaatcaaacagttataaaaccaacagagctcatgagaactcactcactatcatgagaacagcatgaggggaaccaccctcatgatcaaggtctctccttcaacacccaggaattacaattcaagatgagatttgggtagggacataaagcctaaccatatcattctgccctgggcccctcccaaatctcatgtcttttcatatttaataaccaattatgccttcccaacagtcctccaaagtctcaactcatttcagcattgactcgaaaatctacagtccaaagtctcatctgagacaaatcaagtcccttctgcctctgagcttgtaaaatcaaaagcaagttagttacttccaaaatacaatggaggtacaggtattgggtaaatgctcacaccaaatgggagaaattggccaaaacaaaggggctacaggtcccacacaagtctgaaatccagcggggcaatcattaaactttaaagctccaaaatgatctcctttgactctatgtctcacattgaggtcatgctgatgcaggaggtgggctcccattgtcttgggcagctctccccctgtggctttgcagggtacggcacccctcccacaccagctgctttcatgggctggtgttgagtgtctgtggcttttccaggggcacagtgcaagctatcagtggatctaccactttggggtctggaggacggtggccctcttcttacagcaccaataggcagtgccccagtgggcactctgtgtgggggcactgacccatttcccttctgcactgccctagcagaggttctccatgaggcctctgcccctgcctcaaacttctgtcaagacatccaggcatttccatacatcctctaaaatctaggtagaggttcccaaatctcaattcttgactttgtgcacatgcaggcccaataccatgtggaagtcaccaaggcttaggacttgcaccctccacagcaatggcctgagctgtgtggtggtccctttcagccacgcctgcgacagagggcaccaagtccctaggctgcacagagcagcagcagtgccctgggcccggcccacaaaaccatttttccctcctatgcctccaagtctctgataggagggacagccatgaagttctctgacatgccctggagacattttcccccttgtcttggcaattaacatttggctgcctgctaattatgcaaatttctacaggcagcttgaattcctccccagaaaatgggtttttcttttctactgcattgtcagactgcaaatttttcaaattcatgctctgcttcctcctgaatgctttgctgctttgaaatttcttctgccagataccctaaatcatctctctcaagttcaaagttccacagatctctagggcaggggcaaaatgccaccagtctctttgctaaagtatagcaagagtgatctttgctctggttcccaacaaattcctcatctctatctgaaaccacctcagcctggacttcactgtttatatcactaatcagcattttggtcaaaaccattcaccaatctctaggaagttccaaactttcccacatcttccagtcttctgatccctccaaactgttctaacctctgcctgttatgcagtttcaatttataccagtactccactctctgcagtaccaattcactgtattagtctgttctcacactgctctaaagaactgcccaagattaggtaatttataaagcaaagaagtgtaattgactcacagttctgcgtggctggggaggccacaggaaactgacaatcatggcagaaggcaactcttcacagggcggcaggagaaagaagaggtgagcaagaggaactaccaaacacaaaaccatcagatctcttgagaactcactcactatcatgagaatagttagggtcgggtggggaccatccccatgatccaggtctctccctcaacacctaaggataacaattcaagattagatttgggtagggacacaaagcctaaccacatcatggtgcttctcaattcataaacaattgatactggacttaattccttcaatttgttactgtaacatcagagatttgttctaggtcctgatgctcaacaattggtactggacttaattccttcaatttgttactgtaacatcagaggtttgttctaggtcctgatgctcaccacacagaaagccaatcactgagacgatgagttattaccaaggaaaaaggctttaatccggtgctgcagccaatgagctgggaactcagtctcaaatccatctccctgactgactgaaactaggggtttatatagcagggaagaaatgtaatcgtgtgtaagaaaacaggaactaaggaagggcaaggaagcaatcaaagtgaaagaggggtccaagcttctcattgtcaggatgtggtaatctggtgagtttcagttatttgatacttttttttgagaggcttgaaggtcctttcctaaggaaggaactcagataaaacaaatgtaagcctcaagcttcaattgaccagaaaggtcaatttctatgtttatccaaaacgacagtctatgggactattgggttggtttcaaattcagaataaaagaatgaagacaaagagtgctcctagtgatggccggacaggtttttaagctacttgtccgatgtctagctcttgctaggtatgaatctttgtgtcaaagatacaataattttgtttcttttcatttagtcatattatttgctttaaagtttaggtattgtgttcacatatgaacaagaaaaaatatgcattaactgcagatatttttgaaaaatgtccccaaaaacgtactcagaataaaagaacaatcacttaagcatcactatgcagagattattgtcactgacactttgatatttgttttcaatctttgttttatgcatatatagatatacacacatatacataaatgtttatgggtgtcagaaagagacacaaagtgggagaaagagaaatttatacagcaagagggtgtcgtgtgacacttcctgctttttaacctgcttttcccactttaaagccgcacttcgaagattttctatggttttcaatattcttctgtgttatcatttttattggtgatatagtattgattgtacaaatatgccactatgtaattaatctcttatttaccaggtttccaattttcactaatattatgattaatgtagattaacatttctgtatgtcaattactatttcctcaagtaatttcctagtagtgaaatttatggataaagaatatgaattttggccaggtacggtggctcacacctgtcatcccaccactttgggaggccgaggcgggcagatggatcatgaggtcaaaagatcgagaccaacctggccaacactgtgaaactctctctctattaaaaatacaaaattagttgggcgtggtggtgcacagctgtagtcctagctactcaggaggctaaggcaggagaatcgcttgaacccaggaggcataggttgcagtgagctgagatcgggccactgcactccagcctggcgacagagcaagacattatttcgacaaaaacaaaaaaagaatatgaattttgcaaccacttttgatacacactaccaagtgtttttcagaagagtatactaatttaactggaagtgcctatcgcaacactaggttttgtctgtctttttatattgttttctaagatgactggagaaaaagatgtattttatgtcaatatataccactttcattcctaatgacagtgaattttttcattcctttttccctcccttttatccttttgtcatttatgtttactcacttgaaatcctcatttgatacacagactggtcatatttttctccatttaaaattctgggtatgtctctttttcttattgatttgtatacattgttattcttacttcatagtctgtttataagtctgcttatgcacactttctatcttcatctacatttctggaaaaagacaacacagtagcattctgcacatattatacacacatagacatgggtgatcccaagtgcgtatttcaagctcgaagacaattaagaaattagaaactctaaactgcatatttcagtaattgcgttcccgaaataaaggagctgtagaaaaacattatttctcctttttgtactatgtcatcaattcccagtcaaacctttctggttatccttttataaattctaagatgttaaaaaatagctcattgcacaaaaaactcaaatttgttaaactgctatttcaaaagattttatactcacatgacgtttttcatttaagcattacacagcgctttacaaatgttaattaggatattccaactggaaattgaaacaaacctcaagagagtgaaattaggcatggagagacataatcattcctccaagattattccagagcatccttggcatttccatggctcacacccaagtacctggtttcccaggactgcatcttaaccattagagcacataataagcaggtcttcgtaagcacgggcttatagagtaactaaccaacattttaaaatttgtctaaaacataagtgaaaatgtgaaataaatagaaattctctctttgacacacgttacactcaattcataagtgatacactaaatggaaccttatgtgccttgtctataaaatattttaatgaatataataaatattcaaaaaaattaaaatttttagaatccttttttaggcctttcaagaacaaatagaaaaacacgacttttggaaaaacatcacttttttgagaggaaaatttcattctttgtgggatgagcagatgttcatcattcaaccattcatttcattttttttaaaatctaatttaagaagtttctgcaaccaagtgacagtccctgtgcttaagacttgggattaaataatgaaaaagacactaaatgccttattacaacagataacaccacaaaaataacagatcaatgaaactaccattgcagagctattgaaatgtacaaaattttactagaacacggaaaagcacttttttttcctattgctggaataagagatgtaaccacagaatacctgacaccaaaattagttctgaaggaagtaaaggtgtttaacagaataagtaggaaagattcgtgacaggggaatcacgtatgcaaaagcagaggaatgcgggcatgcattacatgttttggtaatggcaagttcctcagtttggctaaagttaggcaaagcagtctacagccaagttgaaagagacttacttgccaggtaaagcgattttgactaaagcaacagaacctatttattcaggggcatacatacagaatcaagatttttaagcaggggaagagaaagagtatagctcattcagaatgatcactttggaggtaatacagagattgtgttaaagacaagagaatggggggcaggaagttcaagctaagaggttattacattggttcagctaagaggagtgtttcagaaacacacaataacagcgttaggcaaaagaaaaatactcttaaatccaggcagatgaccagttaagcattacccaaaatatgtccaccaggattccaagcatactttatagctatttccagccaaatgtataagtactggcaattctgaaaatacttttccaaaacacactacttataaagctactgctgagtctgacaatcaatcctctttaaggatctaacaggaagacagaataaacaaaacatatgtctccccaatttaacacttgccaacaatgtaaatgagcacatgtgccttttcaatgttcaacaaattcctgaagccacagaatgtataactgccacaaaggaaaccatcaggctacaaagaatgatttcagtggcagaccttttttctttggcaagtagcatagtgaaatgcaaacattagaaccccatagtccacagactgactctgaccagcacccgagttctatttgatgtagataatattggcccaaagagcactgtttaacagattttccaacaatgtccagatgtcctggacattattcccatatggccatactctacaacaactctagaactgctatcccctatagagaggtcataagctttccaggttaccaccacccacatcatcttttgttatcttgttaaaactaaaagcaggtctctgttggcatttcttattgatgtaaggggaaaaaagcatacattcttagctaaaacaaagtattgcatccttctggctgttcaaacagaacaacaaacagatttagcgggcagagagcacattaaacactggaaatattcctcacttcctacaacgtcctatgctcactagcattgtttccttttctttttctttttttttttttttttttgagacagagtctcgcactgtcgcccaggctggagtgcagtggcacgatctcggctcactgcaagctgtgcctcccgggttcacgccattctcctgcctcagtctcccgagtagctggaactacaggcgcccgccaccacgcccggctaatttttcgtgttttttagtagagacgggttttcaccgtgttagccaggatggtctcgacctcctgacctcatgatccgcccacctcggcctcccaaagtgctgggattacaggcgtgagccaccacaccgggccctcattgtttccttttcttaaaataaagtttctgtattcatagactccctagtcactccattcatctacaattacctgtgtaagtcaataggtatttgagttgagactcctgtaggagctaagatcataaacttaaccaggggtcccccaattctgctcactcacacgaccttaggaaatcacttcttatgtctgatcctttatttctatagctatgaaatgaggctaacaatacacaattcacagagtgggtgttcattatgatttgatggagctaacacaatgaatgtagcattttctaagtgaaattaaaagttctaacaccataagaattcaatagtcatgtaaatttgggggataccagaatgcagaaaataaaacaggttcctttggtttattaaagtctttggaaagtgcatcctacagcaagaagagtcgaagataatttgtcaaatgtattcaaagatataatctagttgtttttttttgtttgttttttgttttttgcccaggaagcttctagagaactaaggttctgagaaacatactttgggatactagtgattggttagtatccctttttggtacatagtagatacttaacagttatcaactcattcttagaactggatctagaatttctgtaaggtttagatcaaattcagctttttcaagtttatctgtgaaaacaagatgcaaaataataacaataggaacactgaggactagaccacgtgatgtggggttgctggctaaaagaggggtaagaagctctggctataatgatcctttctgtttcgggagatgatcaaatccataacattctgagccattgaaataatgggtgttcgtgtgatctttggtatttataggcatcaaggtatttgctacatattctgaagttatccagtataatgaaggaaatttgctacaactctagaattaagaaagagattgaatgggaacattctgtaaaggtgggtcaacctctaagagacagcagggggaggcagtgtgccgtggaatgagatacggggtccatctctgccactgtctagttctaagacgctgggagaaaaccaactaacatctgtgagcccaaatttcatcatggtcaaatgctgagttagaagagaaagtttctagtgatcttccagttcaaacatcatgtggtttttctggggtgagagatgcatgctagtgaggttatgaacaaatcaaattttagtgaatcaaatcttatatacctataaattgatattacattttccaaaaatgccatttctcaccattaattgatcttcctgtggcactggatcttagcattttagtcttaagttttgcccttatttagcaaaacatacaaggactgcctgctattttttaaaatgtctgcactgcttctttgtgtaaagtgaagaatttctacatttacatgttgacagttcagattttctaaaatcaaggtaaacctagggtgccaaggacacagcagacattaagtctgtgctaaatggaagctttaaattatagaaacttcagcatgtttctaaatctaagatcagaaattttcaagaagatgtagatcttcttgacatacaatgtttctcaccagtccctttatcaaatttgtttttttccctgaaggaaaattcttccactgctgcattatactcataagtcccatcccggcaagactcaattgccaatgatacttataagattatatttacttctttgagctaaaatgtaaaggtcattttctgtattaaagctcagcctttaggctaaatatctttcttctcttttcctgggaaagagtgagagagacaaagattgacagggacagggacagttgggggtggggagaaagagagcgagcagagtttgggaactagaaacttttactaatggatctgaaattggttccctggatcctaaccaaatttaatttgtctaatccatagtttaactagagtttccactcaaaccaaaagtaaatcttacctagaaaataatgtacctggccgggcacagtggctcttgcctgtaatcccagcactttgggaggccaaggcggatggattacgaagtcagaagattgagaccatcctgccaacatggtgaaatcccgtctctactaaaaacacaaaagttagccgggcgtggtggcgggtgcctgtagtcctagctactcgggaggctgaggcaggagactcgcttgaacctgggagacggaggttgcagtaagccgggatcacgccactgcactccagcatgggcgacagagcaagactcagtctcaaaaagataataataataaaaataaaagaatgtacctttctcagacaggataacaaccacttttttacttatctttcatctttattctaagagattcagtaagattctttactgggaaaaacactgtcattttgctctggctctttttatctgcatcaaagtgtttcaaaaacctctgagcattttggaattcctagacaatggcatttaactcaaatatacaattttttttttcaaatatatcatttgcctaaatttctctaagactgaaaagtaaactacatgatgttgttaactcttggaaatcctgaccccaacatctatacttaggtgattttcatgaaaaccacacagattttcttctaaactctgaatacaatccttttccaatttagtctcttgctgaggagttgcttttttttttagcagtgccagaatacatgaaaaacagagggtagaaacaaccaaccaggtgcattcatgaatttttaaaccaggtctgctgaaaaacatgcaaaacaaaacctctccaagcacgcttggggtaaaacatcaatctgaatattattcagtatcatctccatgtctataccagccccagcagatggccaatttgcttttaccaccttcagtccatgcagccagatgctcccagatgatggctttttcagactgcatctctgattgtgcagtccaggtacccagggagcagggcaaccccagagtggcacacagatgtaaaaagtaaaaataaccacataatcctctaaaatgtttttaaaactaaccgtaggcagagatgggctaagatataaagcaatctgacacagaaagtttaccggaactttccttgaaatatgaggtaccatttcttatgggtactgatatggtttggctgtgtccccacccaaatctcatcttgaattcccatgtactgtgggaggtacctggtggaaggtaattgaatcctggggggcagatcttctccatgctgttcttgtgatagcgaataagtctcacgagatctgatggctttataaggcagagtttcccttcataagctctgttctcttgtctgcatccatgggagaaatgcctttcaccttctgccatgattgtgagtcctccccagccccgtgcaactttaagtccattaaacctctttcttttgtaaattgcccagtcttgtcttttttttatactttaagttctatggtacatgtgcacaacgtgcaggtttgttacatatgtatacatgtgtcatgttggtgtgctgcacctattaacttgtcatttacattaggtatacctcctaatgctatccttcctccctccccccacccacgacaggccctggtgtgtgatgttccccttcctgtgtccaagtgttctcattgttcaattcccacctatgaatgagaacatgcagtgtttggttttttgtccttgcgatagtttgctgagaatgatggtttccagcttcacccatgtccctacaaaggatgtgatctcactcttttttgtggctgcatagtattccatggtgtatatgtgccacattttcttaatccagtctatcattgttggacatttgggttggttccaagtctttgctattgtgaatagtgccgcaataaacatacgtatgcatgtgtctttacagcagcatgatttataatgctttgggtatatacccagtaatgggatggctgggtcaaatgccatctccatcaagctaccaatgacttttttcactgaattggaaaaaactactttgaagttcatatggaaccataaaagagcccgcattgccaagacaatcctaagccaaaagaacaaagctggaggcatcacactacctgacttcaaactatactacaaagctacagtaaccaaaacagcatggtactggtaccaaaacagagatatagatcaacggaacagaacagagccctcagaaataatgccacacatccacaaccatctgatctttgacaaacctgacaaaaacaagaaatggggaaaggatttcctatttaataaatggtgctgggaaaactggctagccatatgtagaaagctgaaactggatcccttccttacaccttatacaaaaattaattcaagatggattagagacttaaatgtcagacctaaaaccataaaaaccctagaagaaaacctaggcaataccattcaggacctaggcatgggcaagcacttcatgtctaaaacaccaaaagcaatggcaacaaaagccaaaactgacaaatgggatctaattaaactaacgagcttctgcacagccaaagaaactaccatcagagtgaacaggcaacctacagaatggaagaaaatttttgcaatctactcatctgacagagggctaatatccagaatctacaaagaactcaaacaaacttacaagaagaaaacaaacaaccccatcaaaaagtgggcaaaggatatgaacagacaattctcaaaaaaagacatttatgcagccaacagacacatgaaaaaatgctcatcatcactggccatcagagaaacgcagatcaaaaccacaatgagtaaccgtctcacaccagttagaatggtgatcattaaaaagtcaggaaacaacacgtgctggagaggaagtggagaaataggaacacttttccactgttggtgggactgtaaactagttcaaccattgtggaagacagtgtggcgattcctcaaggatctagaactagaaataccatttgagtatgtctttatcagcagcatgaaaatagactaacacaggtcctaaaaggggaattgccttctgtcactttattcttcaagttcctgcaagaagcctaggatgtctagattcagaagtgactgaaagcagaactattatatgcattgccacaaatgtaacatttggttatagagatcaagcaggacctattacagggagtcagaattgtctgcctgccctatttttctacaacttagaccaggctcttgattttgatgcactgctacagctggatatgttgtctcatttgtaattgacctatagagggtgataccttctaacactagctctaacctctcaagcaaaaaataataataatctattaataaataattaaatgtaccagtaggactcacccaccaaggaaagtaattggtcatgtccatgaatcattttgaaaaataaaaaagtatatgctaagtgatacttacataaaacctccatatgactgtaagacttcctaaaggttgatatctctgtttaacagaacatttctaggattgtgtacaataccatacacaagggatttctgtgtctgtgtgttatagttcaccaacataccatcaacagcagagattgaggggccaaaagatacataggttctaggtgaatcttttttttttttttttttttttttttaagatggagtcttgctctgttgcctaggctggagtgtagtggcgcgatctcggctcactgcaagctccacctcccgggttcatgccattcccctacctcagcctccccagcagctgggactacaggcgcacaccgccacacccagctaatttttttgtttgtttgtttgttttgttttgttttagtagagacggggtttcaccgtgttagccaggatggtctcgatctcctgaccttgtgatctgcctgccgcagtctcccaaagtgctgggattacaggcatgagccaccgtacccggccagttccaggtgaatcttaaaaagaaacagagggtctcctaggccttcagtgggctggattaggtgaccttcctcagtccttcaaaagcaccctgggattaatgctatccccagatcaattctactttgtcgttatttccttatttgtgtatctccttttccagactggaatatcaataccacacactggaacctttcatcgtctttagttcactatctctagggcctctacatagtaagttgttaatcaatgtctgatgattgaatggacaaacaaaatattttcttaattttataatatgtatttagaaattagctcattaaatatttatatgaacacctaattttcacatactatcatattaaatatgtgctattcataattttaaggaaagcaggaaggacaagagaataaacagaaagaagaaaataggaaaggaataaaggcaagagaaggaaggataaagtttctaaatagtatggtttggggaattaagaaaaatttctaaatgtgctttatatattaaccataattggtctattttttttactaatttataaaacatcacagtaatagcaaacatttaatagcccttactatgtgttaggctcattttaagggatttgcatatattaactcatgtaaacccacgaatttattgggcaggaactattagtatagccattttttttttttttttttttttgagacggagtctcgctctgtctcccaggctggagtgcagtggtgggatctcggctcactgcaaagctccgcctcccaggttcacgccattctcctgcctcagcctcccgagtagctgggactacaggcgcccgccaccacgcccggctaatttttttgtatttttactagagatgtggtttcactgtgttagccaggacggtctcgatctcctgaccttgtgatctgccctccttggcctcccaaagtgctgggattacaggcgtgagccaccgtgcccagctagtatagacgacagtttacagatgaatatgctgaggcacaaaaaagtttcatgactagtccaagaccacatagatgataagtggccaaaccaggattgaatgtagttagtttagctctagtgtcagcgttttcatccattatgctatgcggctccatctcgaatttgcaagcatttattaagtactttcattctcaaagttcacgccatttggtcaggcacaggagggatatacatgtctaagccactgctttatattatcagttcctttaccaagtacatgtcatatcttctaagacagaaagttgcatatggagagtaaagacagagtcccaaaaagagcatacatactgtaggagtacagaatcagaagaaatgtttaaggatggtgtagtcaaagaaagtattatgagagtgataaggtgagcctggcttcagggaagatttgcatccacaaaaggcagagaaacatatgtacaatggaagggccacttagcaaaatttaactttacactttttttgagacggagtctcactctgtcacccaggctggagtgcagtgacacgatcacagctcactgcaacctctgcctcccgggttcaaacaatccttctgcctcagcctccagagtagccaggattacagacatgagccactaaacccagctaattttttttttttttttcgagatggagtttcactctttttgcccaggctggagtacagtggcatgatattggcacactgcaatctccgcctcccaggttcaagtgattctcctgcctcagcctcccacgtagctgggattacaggcatgccccaccatgcccagctaatttttgtatttttagtagagacggggtttcaccatgttggccaggctggtttcgaactcctgacgtctgctgatttgcccacctcggcctcccaaagtgctggaattacaggcgtgagccaccgtgcccagcctaatttttgtatttttagtagagacagggtttcaccatgttggccaggctggtctcaaactcctgacctcagatgatcctcccgccttggcctcccaaaagggattacaggtgtgagccatcatgcccggcctgactttacagtattttttaaaacttcgttaaaatgctggctcaaggcaaattatgacagaaaggaaagaactatcctttagtcaggaatgatcttctcccttctgattagggagactgggctacttctctttcacttgatcacatgtgatggcctcaatagtctgtaacatatgttgacacgacaccaacctagaacgcagaccttgggcccaaacctctgctcaccaaaccaaaatcagccagcttgcaatatttataagaaacttaaccaatgtaccaataaatgaaaatcgtggttcaagaatgagggtagtattcttgatgaaacagatttatggtaacaaaattattcatttacatatccatatctttccaaagaataatattttgtattacaaaagggacacacacttatatggaaaacataccagggcacttgaccacacttataagagtatttattgtaaaaggctagtttttatcaaatcattcacctacagataaacgcagaaactttgatgtctagcactagttttcattctcacaatactttgtacatttgagtgattagattctgtcctcttgatagcatggctgaagcttgttggtcagattccaatctgttctgggtactggtcatactcagtatcttctctccaacctctatcagctctttaggtcttgttatctcaatgatacattttggtgtctctccagcttatatattgtttattgactgatgtgaataatgtagggagggtagaacattctttgaaggttatgaacaactgataaaagagtttctgaatgtagtgtctgtcagaattgttacagccaagggatgcaatgaaatagattactgtgcatcttctccctggctcccaatctaggtttgcagcagagaatttctgggaaccatttcccattacagttgatttctgcaaggacatttttcatatcagaatctctaaacatctactctacagatgactcatgtgaacaaaagtgacacacgaccatttaacaatcagcctattttacaggttaaattccaggagactatggggccaatttgtggggatagcatctgaaaaagaaaggaatttccaaacctgagtgtttcattagaaagaggaagtcagttgggcaagccacaggtaatctaaacaaattgatgggagagagtgaaaaagtactcataattattgtatcaaagaaaatctcttcattatcaaaaatgaggagagtgtgcttggggacaaatatggctacttgccatatcagctgcagtttggaaacataattaacaactgtgtatggaaataattaatcttgtgctgcagtgatccatgattgcatgactgcactctagactggttacagagtgaaactctgtttccgaagagaaaataaaataaaataaaataaaataaaataaaataaaataaaataaaataaacctaacaaattgaaaatcttaacaatttagttgtaagaataatccttctacgtggtaaacagaaggaagaaacatcgcttaaccacaacaaaaattaaaacaaacacacacaacttaaattcaatcaataaagtaaaaagtttataaatatataccagaaccattacaaagaacaaaaacatatatacaattcataaaataaaagaaatgccaaatgtaagatgcttgaaaaaggaagacgagaatgtaatctaattttgaaatatttttcagtagaagataagcttcagttatctaggaaatccacttaaatagacttttcctagcatggtgcactcacaagtgatagtgaaatatatggacctcttcatgaacatatattacagcaacccctggtacagaagcgtactcagaattaaagcaggtggtcccaaaaagaatatcattgtttctaaagatagataacccattacataggatataagcgcactaagaaaatggtattcatttatatttacttttgcaaactagctcctggttattcagtattttcagaatgaccattcactgatgccctaagattatgtgcaaactataaatatgagaaagtgaatttcaaaaccatttgtatcaacctcagaacccaattgtcataaccttttaagccctcctgagcactacagatttatcactccccaggccttccaaaggacttgaaaaggtattttatctcaatatacagcagttaagttcattcactgtaatcacttgctaatggacatcatagctgcaaattaaactaaaatggtgtttagagataacaaatcaatgggttagattaaaggatattatcaaacaagtagcagagagtctgataaggatcctacgaaactaaccagggagatttgaaaggattaacttactccttgaagaggtacctctgatgttgtgaggcttggaatctattacctttggggtccccatgcagaaagccagcagctgcaaactactacttagttttacaaagtaaaggtcaagtaaagagagcagactgcagtagacatcaaaggaactacaatatgttaagtagaaaggacctcatgacatttataggagatcttaaggttactatccatttaactgatttaaaaaagatcctatgatgctaagtgctttattcccaatgccaggaagatgagacaagttgcccaaggccaccctgcctgttgactcacttgccatctatagcttccaatactagttcatgccatgacagaaatgatttatttgcctatatggtatctggatgtggcatttattaattttttctggatatatacatataaatcataatgatgcaaaggaaatagatttaaaaaaaaatcagccgggcgtggtggctcacgcctgtaatcccagcactctgggaggccgagacaggtggatcacgaggtcaggagatcgagaccatcctggctaatacggtgaaaccccgtctctactaaaaaaatacaaaaaattagccaggcgtggtggcaggtgcctgtagtcccagctactcgggaggctgaggcacgagaatggcgtgaacccgggaggcagagcttgcagtgagccgagatcgcaccactgcactctagcctggacgacagaactagactccgtctcaaaaaaaaaaaaaagaaatcatggagtaggccgggcacggtggctcacacctgtaatcccagcactttgggaggccaaggtgtgtggatcacgaggtcaagagatcgagatcatcctggccaacatggtgaaaccccgtctctactaaaaatgcaaaaattagccagatgtggtggtgtgaacctatagtcccagctactcaggaggctgaggcaggagaatggcttgaacccgggaggcagaggttgcagtgagccgagatcaggccattgtactccagcctgggtgacagagtgagactcctcctcaaaaataaaataaaataaaaataaaataaaataaaataaaataaaataaaataaaataaaataatcatggagtagcgtctacctacccatggatataaatcctgagagactacagcccttctgatgagagaggaagccttttttttttttttttttttttttttttgagatggagtcttgcactgtggcccaggctggagtgcagtggcatgatctccggtcactgcaagctctgcctcccgggttcacgccattctcctgcctcagcctcccgagtagctgggagtacaggtgcccgccacctcgcccagctaatttttcgtatttttagtagagacggggtttcaccatgttagccaggatggtctccacctcctgacctcgtgatcagcccaccctggcctcctggagtgctgggattacaggcgtgagccaccgcacccggaggagaggaagcctttcaaataaagaaaactccaccttccctattattcatgacaaatgcataattgcttggctcttttcaacatcccgccttactcacatactatcatgctataagtggagctaagattgtgtattttaattcccatagtcctgaacacaatatcaataaaggcatggggaaaaaaagcacatatgttcaccatcctacttctcgtcataatttagtataaaattcagggaaacccaattagttttccctttatctttctctttagattacttctctaaatacttagcttgtactgcagtgttggtcaatgacactatcaaaggttttctgctaacataacaatctgctttgaagaaggaaggaaggaaggaggaaggaaggaaggaaggagagagagggaatctcagtcggagagtgcaaggactgcagataaagaactttctcctcctaatgtttgtgtgtagacagagaccacatagcagcactgaatggtaaactgtcttttttgaaacttgaaacttctgtttaaatggcatttaagacatgataaaataaattgtttcattcactaagcactgggactcccaattacatctctcctctaagaaccccaagtccctattgcctgcccctgctttttgagctcagatgtttgtagatccatgcaagaaaagtaatttctcttggttggtgatttctggctgtggttttgcaggtttttcactgagatgtaaaacaaaggccctgactactcagtcatttaaggaagactccctggaaactttctgcaaaaggtagtaatattaacagcaattgccctggccagaatccattgcaagtaattgcattccaccaggtagtttataacaaaagcctcttcccatgcagtcttctgcatctctgccaagaatacagcagcagctaagctccaactatgtttgggtcaaaacagtttctggagtgaagtcatttaaggaatacatacagtgagccccaactgccacagcctcctttgttgtctgcaatgattgctgtattagtttgcaatgtcaatgcattctttacatcttcccatttgccaagattcagctcaaatctcttctcttccaatgagtccttcaaaagcctctcagattgagatcaattgcacccttttccgagtttcttcttctacatggtattagtgactctatttttatttatttttatttttttgatggagtttcgctcttgttgcccaggctggagcgcaatggcgcgaccttggatcaccacaacctctgctcttgggttcaagcaattctcctgcctcggcctcccgagtagctgggattaaggcatgcagcaccacgcccagctaattttgtatttttagtagagacagggtttttccatgttggtcaggagggtcttgaactcccgacctcaggtgatccacctgccttggcctcccaaagtgctggaattacaggcgtaagccaccgcacctggcccggtgctgtttttaaatattaaattcagctcaataaatgcacatccctttgtgtttgtgacctcctggccctcactcccatgcaatgagctaacagaatatgtgttattatcaatatttggagataaagagtggcacccaaaactgtgtggttttgtgtgcacaacagaaaagagtttatttattttatttatttatttatgtgaggcggagtgtcgctctgtcgcccagtctggagtgcagtggcgtgatctcggctcactgcaagctccgcctcccgggttcacaccattctcctgcctcagcctccctagcagctgggactacaggtgcccgccacctcgcctggctaattttttgtatttttagtagagacggggtttcactgtgttagccaggatgttctccacctcctgacctcatgatccgcccaccttggcctcccaaggtgttgggattacaggcatgagtcaccggaaaagagtatatgtaaagcaaagtttctgaatgtcttttgttagctggaggggtaatcaaaaccagaggactccactactttcatcccatttagagatctttgttctcaatctgaaactccctccactctagaggtggcaatttctttgcatgtgtttgaataaaccaagtcaaaataataacttcaatgtataagcctgcaggaatctggaagcagttgtcccttttaccgccagttgtaaagtaaacaagacatgggattcaagccaagtcatcagactcagattcagtctttgcatgatgattttcttttttctagacaaggcttttttcgttcttcttctttttgttttgttttgtttttgtttttgtggttgtggggggaggggcgagaatggggagtaataggtatacaataaaaataaataaataaataataataataaaaaacctcccagactaaaagtctcgaagttcttagacattggaaatgaagttgaccttgggcttggcacagggacagaagatgccagggttggaggagcttacttttctcttggctgagatgctctgctgccaggctgcccttttgagaagatggcatgatccaatctgtactgggctcccaggaaggctctctcatcatgccaggatccccctgctagccctgtacaattccactcatcacggcaggatcttgaaagacatgacggccaaaatgcaaaatggagatgagtgacagcccagctttggcagcactgggcagaggaaggctgagctcctgagtacaaaggaaggggctagtaaaggtgacatctggtggtatctggaccatttattcttccattagttctacagccttcacagactccccttcactatatatatatataaaaaatctccagaatctgtttgtaggctgatatgagcacctggctctctattaaagtgaaagaaccctcttctgtgtatttgtgtctgtctcttttcaaacaatagtccttttcttcccttgtgttttgttatttcactttaaggcacatctactgtttgtggatggcagaagggaggcactacaattatggaatagaacatgtccatgattaatagcatctttttgtggggaggtgaaaaatgtttaagttagccaaaagcagtggcccacgcctgtaatcccagcatttcggaaggcagaggcgggcggatcacctgcggtcaggggttcaagaccagcctggccaacatggcaaaagcccgtctctactacaaatacaaaaattagccaagtgtcgtggcacgcgcctgtagtcccaactacctgggaggctgaggcaggagaatcacttgaacctgggaggcagaggttgcagtgagctgagatcatgtcactgcattccagcctgggtgacacagtgagactccgtctcaggaaaaaaaaaaatgtttaagttcagtgacaggcagtagcccactagtccaagctgccttaaagctacatcagtccaaatttaaagcaatataaccccctcttcactcatcttgcaggcaatgatatatgttagaatttattcccaaatttgttttttaaaaaaatacctgcaattttttaaaaaaatgttcttctttcaagggctctttgaatagcactttgtatctaataagcctatgtgggatgcctgtgtttcataccaagacagagtcacttgctgtgctaaggaataaagttagaactctggaataatggagtggaacttttgaaaaacaaaattccaagaagctcccctccctgggcttaacaaatgtctttgaatacaccataatagtggcctcccagggctctggaacgttcaactgctagtaagcattctatgccatgaagtaactaagaattatgaattccagtccctacttcaattcctaagtggaagagcagaggggaaagtgctacctgctcactgtgctctcctaatgcactcctaaaagctgtggctacccatttccttaaatttcaaagatgctctgagcatgtctatgtactctccttcacccatccagcagccaaatgcaaaatacagctgtctttctaggagagaaatcatgaggctagtttttatgtcaaagggacaaatggagaaaaagggtataatttctttttttttttttttgagatggagtctcactctgtcgcccaggctggagtgcagcggtgcattcttggctcactgcaacctccgcctcctgggttcaagcaattctctgcctcagcctcccaagtagctgggattacaggcgcctaccaccacatccggctaatttttgtatttttagtagagacggggtttcaccatctcggccaggctggtcttgatcttctgacctcatgatccacccacctcggcctccaaagtgctgggattacaggcatgagccaccagaagttttcaaatcaaaacttccactgtccagtagaggactgctggtttcaaacacataacttcaatatttatccttgcatcaccaacaccaagagccttttcataaagagaaaatgtaaccaagagtttcactgaaaaataatgccttcctgttggcacagctcacctctgtttagtaaagtgtagtacttggtctacgtgcagcagaactgcagggagatggaaaagtggcacatgcttgttaaaatgcagattctcagaactaacgacctagaatttctgagaaataggcccccagatctgcagtttaacaagctctctagatgattttcatatatgcggacgtttaagaacctcagtagtaatttaggcacttcatcccactaatcccttgaaaggcaactgggcatatctttaggattttcatttatattgggaaaagcaaagatatcaaaacattcaagcagcagtactctgctataaatggctaagaaacagaaattactgttactgcttgcttcattgagcagttgctattaactcccaggcacccttggggaaataattgtggccctaaggagattatactctttagttactatgtagagaatgtgaatgttaaccaaaaagctcgagaaaatctccaggttgccacatccttgcatggttaccagctacatgacctggacaatccactcactgaatcttcatttcctcaacttgaaaatggagtttatcatacttaccttgatggtttcagagtttgtttgtttgtttgtttgtttgttttgagatggagtctagctctgtcgcccaggctggagtgcagtggcccgatcctggctcactgcaagctctgcctcccaggttcatgccattctcctgcctcagcctcccgagtagctgggactacaggcgcccgccactgcatcctgctaattttttgtatttttagtagagacgtggtttcactgtgttagccaggatggtctcgatctcctgacctcatgatccgcccgcctcggcctcccaaagtgctgggattacaggtgtgagccactgcacccagcctggagttttgttttgtttctgaatctactaccaccatacgtgggaatgttctcagtacatttcacatatgcatgtcttagagcttacagtttattataatcactgatttgagaagctggagccattgctgttctatttcttctttaaaacgtgtgagtgtgggttactttaaataccacttagctcaaaaggcaaaggcagatttctagttccaatttaggtctagttgtaaacagctttctttctaatatttgtctttatatctttccctgtggtagttctattagtttcttttataaatctgatatagaaaaagtgtctgtcactgaaaaagtggggggagagttattcactaggatccatgtgttcagtgtttaatagagtaaatgcaacatacatgtatgcatgtatgtatattatgtatatattaatagctatttatactacagaggaaatttcatggaagaataggatctctcttttctagggagctgagaaagactagtagttcctacagaaaaagcaagtacctacagatttaatggtagtatatctcaaaggttaaaggtaacgatagagccacaagatttgatcagagcccatgaaaaaagctgtacaagggaaagaacaagttctgctcagcacgcacatgcaataatgtagtgaccatttctcagctgtggcttctccaagaatcatcatttagggcaatggtatctaagcagatccttgcaccaaacatcagcgaactgtattgtccctcatgacactggccacagataagtgagtaggacaggcgcatttctttgtttctttttcttctcttttcttttttttttttttttttttttgagatggagtcttgcactgtcgccctcgctggagtgcaatagtgagatcttggctcactgcaacccctgcctcccaggttcaagctactctcctgcctcagcctcctgaatagctgaaattacaggcacccacccgcaagcccagctaattttttgtatttttagtagagacggggtttcactatgttggccaggctgttctcaaacttctgacttcgtgatcctacctacctcggcctcccaaagagctgggattacagacatgaaccaccgcgcccggcctgacaggcgcatttctgaaatgcattccctccaatggagaaaagaaacccagagtaaacgaatgtacgttgtgagtaaagagaggcagctgtaggccaccaggaaatcttaaagttagaacaagaaatattgtcttgttacagaaatggcatgacatctccctgccattgaaaatctatcttgattattgttggcaactctaatcttagaaataccaagggccaggcagagtgggctcacgcctgcaatcccaaagctttgagaggctgaggcaggaggatcacttgggcccaggagtttgagactagcctgggcaacatagggagaccatgtacctacaaaaaaaatgtttttaaattagctggcagaggggacagtgggcggtgtcatgtgcctgtcatccctacttacattggaggctggggtgggaggattgctccagcccgggaattgaaggctgcagtgagctatgatcacaccactgcactccagctgaggctacagagtgagacattgtctcaaaacaaaaacaaaagaaataccaacgagaaaatccatcaacttccttttatctattatattcattcatccatgcatgtatttattcattgacttattggcaagtatttactgagtccttcctagaaaccagtactgagacctggacttacaacaaggttttcttgggatcctcgatgtagaatccttttcagacttctgaaagcatcaagcttatcctgtaaatctgtcaaggctgttatccagaaatgacaagctgaattattttacataaggcaacttaaaaatatgacatatggtttgcctttacattttctctgtgctttgtattttatctgagattatataattcgtatttaaaacgcgaaatttattgaagatctacagagggatcagcctgaagaacactagtaaaaactaaccttccagacaagaaaactggagcaaggtttggaaaacagtaaactatgatagaagaacatagaccagaaatgcaaagatcggggttctagttaaaggcaaccagtcactaactaggcttcacatataaagcagcaatgccttaacctctcctacccacctcatggtatttttataaggataagatgattacacattcatactcacagttctgtaatcattctgaaaatatactatgttgtaaatatacaaggtggtcttggccgggcgcagtcgctcacacctgtaatcccagcactttgggaggccaaggcgggtggatcacgaggtcaggagatcgagaccatcctggctaacgtggtgaaaccgcgtctctactaaaaatacaaaaaaattagccaggcgtggtggtgggcgcctgtagtcccagctacttggaaggctgaggcaggagaatgacgtaaacctgggaggcggagcttgcagtgagcccagatcgcgccactgctctccagcctgggcgacagagcgagactccatctcaaaaaaaaaaaaaaaaaaaaaggtggtcttatattctgtccttttatttattttttagtttttgagacggagtctcactctgttgcctaagctggagtgcagtggcatgacttcggctccctgcaacctccacctcctggcttcacgcccttctcctgcctcagcctcccgagtagctgggatacaggtgcatgccaccacacccagctaatttttctatttttagtaaagatggggtttctccatgttggtcaggctggtctcgatctcctgacctcgtgatccacccaccttggcctcccaaagtgctagggttacaggcatgagccacctaacccggcctctgtccttctaataaatgatatttggaaagaaaaaaggaaggaataaagggagggagagagggaagaaaataaaatagcaacaaactaagcagttgtagatacataatatccagtatccaatttcaacaaggccctctcccacatatttatttcagtgttctttgtaattcccccaagttaggtatgtatgggaggaacataatgaaccatgggcaaaactttgtatttataataattgaagccaaatggtttgggtttgataatcttctgggctttatcaaatgagcttgatcagtttccactggtacctgggtaagagaatgctgacttgggtctccagggagccagatggcctcctactcatcatattatactctcagtctataccaccaaggcctgtggggtaggataagtgagatgctatggctctcgggaatttttaagccctcatacaagtataatcttcacaagtctataaaatttcaaatagtaaatagaggggagaagggaaatataactgcagaaaccacttcctctgcagatcaaataattaattgcattttctgcatgtggttgttagcactaaaagtgcaaggaggaagtgggaggaagaggctacttctacaagaagaggccagttctttctgtcaagctttaacttgcttagatcttgaattttaaatcaaacggggaaaggcaaatttcaagctctatttactttttagcaaatcgggacttcttgtctcaatctgagtaaactcagaattctttttgggccactgtgtttgtattatggccatttctaccaaaataatttggttggtagaatttgggttcgaatcccattaaaatgtcagcagcatcaaacccttagcacaacagaaggtagtggaaatagaagagtgaaaaaagttacaaagggaattataaacctttcaataccttttcatttttatttctctaaattagcacatctttaaggctactggtcagtcagaagtaccaatcttgctacaatgaacatctgtgatttcagacaaactagttctggctccaaatgccctaaacctaaatttgattataggaagaaacttacgtttacctgagaggccaccagcctagcagtgtgctggtaactcatataatttgataggtagagggctcagtgcctgatgtcccacatgctgggactttggtctctctgtcagcttgccatagagcatacccagctatgcctagggcagaacggccctgcaatttagcaacaaatcatcatcaggaagtaattagagagctctgctgttttttgaagctgggataatcctacaggcaacttcccaattttttcctaattattttatttatttagggtcattatttatgttgacacaaaaggtcatttaattgaaaatgattggtaattctggtggtctgccccttcttttaaagaaagcatacattttcttttgcaggtccctctcttcttgtttgaaaaaaataataataataaaacgaagactaaaatgaatgcatcccaccagttgcaatgggcatcgagccagaattacagcaagcactggcgctgcaggggtaagaaacaatggattttaattggtgcctaggggtaaaggtcagctctcttggaacaatgggcatctatggtagtaattgactgagtcctctgtgggagtctgtaaatgtcagcaatgtacttccaaatggaagcacaaagggcttgggcccaaggaacaaagacagtattagtgagtggagaaaatacgtaaatcagttcgttaaataatgcactaataaagcaaaagtggtggacacacacaaacacaccacatcacagagattcaaaagaaaacagactacttcaatatcaaatacatgccttcctataagatccaacctctctttccccagcacaagttcagctgttttcctggacagcctggaatccaaacactttaattatttgagtcaagttggatgggtttggctcctaagaaaagctacatccatcccggtgaaatctggatgctgatggggatagcatccacaattaaagttgtagttattcttgttcaagggaatttgggccctttttagaaagtagtagagaaaaagatgaagtactaatcattggaacaccaggcccctcctgcttccccacaaatgcttggctgcttcttttattgctatgttttactccatttttctcatttcctcatctttcccaatattcacccactcctgtgatccagaccacctcctcagggtccaataagtttagagagactgtattctctacatcaagaatttacataaacgatctatcaaaggaacattttatgagctttaagaggcaaaagagtagaatatgtaacataataacacattattaagattctagagaatgaaagatacagtacctttaccagtataaactcgatgctcatttccaactacatagttctcccttccatctgtgagctctctgcagacagggccctgtgttatgcatgtttgtatctctactgcctggcagtcaataaatattggttcaactaaatgatatttttctgttgtgaatgtcatgactttgtgttatgctgatctgcttcattggtcagcttaagcccttttatgctgcttccctgactatgtgagattacagccctctctaaactcttaaagcctttgttgtctgtacaatccactctactaccttatattatttaattgcattcctgagctgggatggtaaactccgtaagagcaaagcgaggttcatgtttcttttatattcacctttatgcttgcagagaacaaggcacaagccaggtgttcaataaaacatgtcaattaatctcttcttaatattatacccctaaatttcatcaatagttctgactggccagtagtacttaagatacatgctgaatatatcaaatctataatgtgaattttagttgtattaattcaatattaataatgtcaccactgcccatttactgattttacaagcaagacaggaagaaagtttattgcacctgaaaataaattacattattacataaaaactgtaattcaaatgggtcatgaggattttttttttttttttagatggattcttgctctgtcaccaggctggagtgcagtggcgagatcttggctcactgcaaactccacctcccaggttcaagtgatcctcctgcctcagcctcccgagtagcttggactacaggcacgcaccaccaggcccagcaaatttttgtatttttaatagaaacggggtttcaccatgttggccaggatagtctcgatctcttgacctggtgatccgcctgcctcggcgggattacaggtgtgagccaccacctccagctggaattttttagggtttaattagcatagtaagatagcagtggaaattaacatgttttacgagtctaaatagacactcttaatcatttaaatctgaaaactacgtcaagatatgcattgtgcgcttgtggacactagtttctcatagtacatacaccgaaagactgttttcatcttcctttccccttctcctttgacaaatatttgcatctctgtgaaaccttcctagtctccaaagatagagttctatgtacatagctatcatgatacataagtactgtgctgtaagagattgtttatacattcatctcctcaaccagactgtgcaatcattaagagtaagaacaacctcttatatttctatttcccagttcttaaaaaagatctggaacaaaataggcatttaataccttctggttgagttgacaaaagacagcataaggcatggccatataatttggaacagttaagaagagtaacaatgagactaacatttgttgaatgcttgctaggtctcagacactgttctttgctggttttgactctttatttcccataactactttaggatgttgacacaatcattatattttagtttggagaggaggaaactgtgtcatgcaggggtttacaacaaataaaccaacaaataaaatgttgtctaagggcacacaattattatgtagcttagctggaatttaaggccaggtcgcctggctccagggtccattatattaaatactgttccacaactaatgatgcccctgagcaaaaattcataatgaccaccttcaaataacaaagtgtatctccgcagtgacaggaaataggtgctgagttggtatacgtgacgagtgcagaaaatacaaggtatacatataaatacaagagatcattgcacagtggtatgagggagtagctaagagagcattaaaaggacaaaaatccattaagtgtgggcagcagcgatgatatttgaatctgctgcaggggagctggagaacctagatctaggcctaccacacccccacacttgagtcataattgtgctttccttcctggcaaaaccgatttcaaccacagccatcaatatcttttacccctttgaaaccactcaggaagaacagaaagataagggtaaattgtactccctctgaaagtcttaataagttcctggtaaattagctctcctctctctgagagatctccagagattcctaaacttctactgctgaaaatatttacaattttattatttctttttcttctgccctctgtcttcattgtgctctttgtattagcattctcccattactctggttactttaaattctgcacagtaatctctgtcgtcttctctctcggctttacctctgtatccttccttctatgcctcttctcttatctgtgagaggctgtgcattccagatattttctttttacatatcttttgttttttggatacatccacattgtcattttctccactataagcatgttcatttcctggtgccagatgccatcaatcaaggcaacacttagtattctactccccaaacacacatactgccccaagcagccaggaaaagatttttctctcccagctgttatattgtatatatcccatacagcaggccttttcacctatgagcatctaagcctacctgttacctacaagctatagtttttgttctgcaaaacctaatttaagtacttgacttgaaaggttgtaaaacaagagcacattagaggtcaaggacccagtaaagtagggaagtgatgctttgaggaacaaagggacaaaaccatcaaaagaagatctggtcaagggaaaggtcaggtcagcaaaagaaatgtttgaatggaaacaatttagcccctgaggctggtggtgcactcttaatttctccaggggagaaatagtggttttattaaagattcatccacattgactttgttttcatgacagcaccaggagaaagcttggggcagttctgatacattggagtgaaacatctccaccctagtaaatatcgcaaatttcctgtagcggacagcattcatctccatccatcttatataagagcagcacaggctattcactagaaacaaatgttctagatacagtatgtcaaacacaagatgacggaaacccctgagaaaccacagggagtgtgctggaagcaaacagaccagaatgttgaaaagacctctgaccattttccacagcagagcataacttggaaccaaccagaaataatgcatttgaccttcataaaagggtaatggatgggcacttaatatttggccagccagacctcagagaacatgagctctaataaggacagatgatgagacaaaaataaataaataattagacagataactttaaaaacaaattgttctcaaagaagattgcgcagatagtctattatgcttacttgaagaatggtcagcttccaaaaggtttccttttgtatttgagaatttctgatcacttggccacagaggcaacctattttccaagaaccactcagtgatataaaaaacatgcagtttccagatcaatcttcataatatttagagagtaatttaggctatcattaccttgattaatttcatttgttaaaaaggtatcaaaccaaaagatagagtctattttttaatgaaaaaagcattatctaaacttagaagagatttataggtggacctatctattacctttctacctatttattgagctagctaaatacctgtatcttttaaaaatacataaatgtagctaatacaattttgaattataatgtcaataacatataaacttgatcatcatacagatataacttagtttttaaagtcaccaattcatgattaatatgtaatgcattagatgcttcttatatgtgatagacataacacttacaaatgaagaataacaaatatgttaattaagcaggaagcttctttctatcaaaaaaatactttgtactaggcagggcatggtggctcatgcctgtaatcccagcactttgggaggccgaggcgggcggatcccgaggtcaggagatcaagaccatcctggctaagactgtgaaaccatgtctctactaaaaatacaaaaaaattagccaggcgtgttggtgggcgcctgtagtcccagctactcgggagtctcaggcaggagaatggcgtgaccctgggaggcagagcttgcagtgagccgagatcgtgccactgcactccagcctgggtgacagagcaagactccatctcaaaaaaataaaaaaaaaaaaaagtacttaatgccacatgaagtaaagcagtaaaccacctctgagaaccaggcaaattagcagatatgggggacaagaaaagataggaggaaggaaaaagtaagttttggaatgtatgcattgatcagaatttactgcctgaacctgatttatcattaattaatttattttttactacatcagtgttagatagacacagataatatcccagaaaaatcaactaggtacttagtgtgtaatgtaacatattgtattaaaatttaagagtgtagttttattagcatttttaaatttatgaatgttataataggtgctttgatttatataaactaatatagaatatatggcaatttcgggtataggtcagtgtacagagaggagtgtcttagatcagtgttgtttttctctatgttccaaagagcccacgagttccagaggcttccgcagggacttcttggagtgacaaggggttgtggagtgggcactgctcctggcactccaaccctgtttcaaagagagcattctgcacttattattctgtagctcatttgaaacccaggggattactgttggaaaatcactccaagtaaaaagagagatgcagcatgctttcttggattttatatttttaatgttcaggaagaaaacagaacaatgcttcatggactgaaacagtataaacactcagcggtacccaaaaaaagatcaaaggagaggacctttccctttggccatcattcctcaggttaagtgtagggaagtaaggatttacttactacacgtcacttttattgaagtttggaaaatgccacttccactatgtctctgaattcatgtgtggttttttttttttttttttttgaatattgctctgttgtgcccaggctggagtgcagtggtatgatctcggctcaccacaacctccacctcccaggttcaagtgattctcccgcctcagtctcccaagtagctgggattacaggcacctgccaccgcacccggctaatttttttgtatttttagtagagacagggtttcagcatattggccaggctggtctcaaactcccgacctcaggtgatccacccacctcggcctctcaaagtggtgggattacaggtgtaagccaccgcacctggaccatttctttatgaatgaaacatacatccttgttaaaaagattagaggcaaatggatgatcttgtgtacaaagtgacagatgaaagagttaaggtggaatgagcaagtgttgcttgtccgccaagggaatgtcatgcaccccctttgatgtattatacaatacgctagctcctcttggcctccctagataatgtcaagtgagtgctatgcaaagtcctggcatttaaaatattaatcatgttcttcttggttagaacagacaaaattatacattatgacctagaaatgactaaaacctacagagattctttactgttcttgtttactcacttgaaataattaaatttatagttagagaaaagaaaggagtcaaagctgatttcacagagcatttcatttaagtttcagcctaggagtccaaaagcgaaccaaagttcaattcaaatattcagtcatgtattggacacctactgtataccaaaatcctatgctcggcacgttaaagaatacataactgattaaggcactttatgccatctaggtcctcgcattctaaagggagtattagacatggtcaagaacaactataatcagaagtgagagtaaagtgctagaaaaaagaaaacggatgtcttggagataagagggagtgagcaagtctcctcagggaaattgattaaattttatggaagaggtggcatttaaggttcactttcaaggtctaatgatcttagcttatcattccccagctgcatgtaacttcagacaagtcactaaactctctgggactcagtctccatatctgttaaagaaaagagtagaattttaatatccccaaaatcttttagattcagattcaatgatacgtgattcttcctaagagaaggtggcagatcctatcaaccattcctctttgctgtcctcaaaagtcacatacatgggcctggcgtggtggctcatgcttgtaatcccagcactttgggaggccgaggcgggtggatcacctggggtcaggagttcgaaaccagcctggctaacatggtgaaatcccatctctaccaaaagtacaaaaattagttgggtgtggtggtgcatgcctttagtcccagctactcaggaggctgaggcagaaggattgcttcaactcaggaggcggaggttgcggttgtgccactgtactccagcctaggcaacagagcaagactctatctcaaaaaaaaaaaaaaaaggctgggtgtggtggcccacacctgtaatcccagcactttgggaggccgaggcgggtggatcatgaggtcaggagttcaagaccagcctggccaagatggtaaaaccccacctctactaaaaatatgaaaattagctgggtgtggtagtagacgcctgtaatcccagctgctcgggaggctgaggcagagaattttttgaacccgggaggcggaggttgcagtgagccgagattgtgccactgcactccagcctgggcaatagagtgagacttcatctcaaaaaaaaaaaaaaaaagtcacatacatgatacacaaactactcaaccaaatgacaagaggaattaagcatgctcagatataaagagacaagaagtcaataatcaaacccttatttagaaagtgccacatataatagggtaattaaaacttaaacatctggagaaaacacagtgtttaatgctggtatgtaccaagagacccgtaggaatgaccaatgtattctgaggagctagggtcctctttatagaatgaaagtcttagaagagtctctcagcaggaatgatgtaaattaagtggtgataacacagaaatgagaaaaaactggagtgtgaagggggtgcagaaaacataaagaacaaatactgtctagttttttctttgctagatagtgtgctgagaccacaaggataaaacaactaaaagaattggcttttccaagtaaaaaaccaaaacaaaacacttttttttccttttattccccagtgaattccactaggggttttatattctttaatccttgaagatgttacacgatccttgtgaagggagaacagcttgggttagttgggggtgatgggaaaggtatggctgataaagacacacagagtatatagaagttttctttttaggcagaatacacatcaactcagagaatttgagagtgaaattgagatttcaacttttttttttttttttttttgagactgagtctcgctctgtcacccaggctggagtgcagtggcgcgatctcagctcactgtaacgtccgtctcccaggttcacgccattctcctgcctcagcctcctgagtagctgggactacaggcacccgccaccacgcctggctaattattttgtatttttagtagagacggggtttcaccatgttagccaggatggtctcaatctcctgacctcgtgatccacccgcctcggcctcccatagtgctgggattacaggcgtgagccactgcgcccagccaagttttttttttttctttgctacatttgtattagttcttcccatcaccttctgcatcccagctgttcctttccggtacaggttaaatcatcttttcttacagcagactttatgtgaccaataaacctctgctgacacaaacaagccttgggatttatcatgaactggggtggggggaactgctctccctctgagacatcgtgacagatagccagcctgcctctcctctggcactgggaccactcagccttttcttctgggctaacctcatatatcagcggccagatgcaggtttcctttgaaagaacaatctaggctaatacctaggacccctctttctatctcttagtcaagatttcttacactgacatatgttgagattacagtttttactgtaacagacctagccaaggaaagctgctgtaatttacagcaggcttgcagggaaacagtcgatggatgatcattaatttaaactgtaaataagatcctgctttattctggactctgatccccggtagtacccctaacaagctgcctgcaaaggcaaggcatgaagcctgctgtttccaacatgatgattgaagaactgctcttgtccgcacaaatggctaaaaatagctataagaatgtgaaggcaaaacaggtttccgggaatgctgagagttaccctgatgttgtcagttttattccagttgctcccactagcgtgaaaagcagagagaagtatctggtacaaaagattttgacttgctagatagcaccgcggagacctgagagaattaatacaactttttaaaggagtctgcccttttcactggaggatagcttaagtcctagaagaattggagcaaatgtgagcactgcctttgttctgcataattaacagagcctgaaatttctttctttttgttttaacataaattctcattgattggagaaaatatattcacactttaaaatgttgtgcaagtactatctctttgattcaaatatgtcctttgggtgggcggagtacatatttcatggtgataaattcaccttataagtagaaaaactatgcacaaatatactgcgatgtcaactttattgatttgtgtaccattgttaagacgttcatcgtcctccaatatttcttaaatctatcagcatctcagaaagtgaccatgaaggcctcatttatctatagaggaaaagatcccttcctttaggttcactcataacattgtgatttaaacagctcaggaccacctctgctctgaagggtaacagtcccagagaaagccattccctcatagtcatgcacagggacttctctttttgtagaactagggtgtgtcaagtcttaagaacagtaaaatgcccatggctaaatgcccttttaaacgtccttcagataactatggactaattatgcagcctgattcatggtatattgacttgagtggatttgatggttaggctctttgctgtattattacctctctgcttcccttccagtcttagcagctatatctggacttgagcatctcactccttaagtcctgctcctgaaacaatcctggagtttctggatcatcaccatatattctgcagctacagaaaagcctatagtcagatttgatatttggcatctttttttttttttttttcatgtttctctctaacagcatcagtgaaacagagactatcattgattactctgaggtctcttccaggcataaatgtcttccattttcctatattagtttacaaatggagaaaatgtaaatgattcacccagagtcacctgttaggtggaagtagattcaaggcagggacttagatttctgaatcttagttcagggatctttcaattacaaaacgtcatgccacatttagtactagaatataggacctctgaggatgagttgctggcttatttctctttacatcctacagtgcatagcacattgcctagcatacagtttgttgactgttaaattaaatttgctaaaaatgtgaactagaagaaaaattaagagagattgtaaaaatcgatacaaagccaacaaacaactaaatttcatcataaaaataaaagatataagttcagttccttaatttgggactgcatacagcagatcaaaattgtttaggtgtaattgttgatgaagtagccagccaattaagggaagataggaatgtttgggtgtagttctaaatttgtgaggttgacagtattggttgtgtggtactgtggccatcagccacccacagctatatcaatttaaattaattaaaattaaatgaaatttaaaatccaattactcagtaacactagccatatttcaaacattcaaaagccataaattgttaatgtctaaagtacagaagagcttagaagaaaatttctatcatcaagttctgctggacacttcagcaagaaaaaagaatgaagagaaaacattaattaagcttttactattctgtgctaagcacctgaaatgcctaatttcatataatccttacaacttcccacacgaggtaggtaggtactgtaactgtcccccttttaaaccgaatcccactgtgcttggagagattaagtaaatcaccatgcttatatacttggtaataggtttagctgggttttctctcttcttcttactccagagtctatgctcaactgaaaagttatgctgtttctactgaagaacttgaaatgcttacagccagaatgaacattacactttatattagtggttcttaatcctagatacctatcagaagcatctggggagctttagtaagatatagttacctgagccctaatccagagcaacagtggtggggctagagcttgcacgtttggggaccacttttgacaagcagccagaattgagagtgattgcttaagagatattttcatcaccttccatattccagatggcaaaatgcagaccctacccaaggtcactaacagtagctaatgaaaaatctgagatgagaacatagacatcagtgctaccttcataacacattatggtttagggtatgttaatgaatgacacgtttctatttcctgattaatactattagttcatgtaacctatgtactacttaacaatcgtatgtcagaatttggaatttgataatgcaagtttatgaaaataaaggtatagatgtagtaccactccccttcagggacaaataaatgtcttcctcatttaaaaacaatattttcttcctaaaaaatgacatacctgaggagtagataagctctcataataggagatgtatgacatagtggaaaaagtatgactgctaaccaagacgccttaactctagtcctaattatggccataactctgcaatgggcacaaactatttctttcctctgaatctcagttttcttatctgtaaaataacggtgttgtagatgatgatctccaaggcttcttgaagctaagatccatgctcagaagggactaatcttatcactctttccaagctactctattctgctaaatgcactgcattcatcctgacatttgtgtgcagactgaacaaactttaaaaatgaaacttcctatctgctgcaggacaatgcattcacttaaattctagttaatctatttgttccatgtcaaggaaaaactgggacatcagatgaaaatccatcttttctgctgtcttgtcaagactcattctgactcttctgattgactggtcagaactcttactagagagtcagcagcatccacccaacaagactcattctttgtagctgccttttggaaatggtaatgatctacctatccctcaccctcttacattcacagctgctgatctgaaaattatgatgtgtcagacattttacaatcttaacatccatcaacccatctttacatttctaatcccagattaactgtaatggatttttaggtagctagagtggttagccaaccaagacagaagtcacatcatgaatgagtagcatgctgaatatacatttcttaccttacgcttgttggtaggacacacatagagatagctcaaaatggttttcaaaccaactttatcattcagcttctcataggttgttccataatcggttgacctataatccaaaaagagcattaatgaggacagaagtatatgtcatttggctgcttgtcagtataatgcatgctttacacagtagaatggctctcaggaggtttctcaatgattcatgtagtatataatgatgcttaattatgtacacagtagcatcatgtgagtggttaaaatttgcatttagattgaattggtaaaaattaaaactccatctctctactgctccttaatgtacgcacattgcataaagaatgtggttaatttaaaaagattaagagatgagggtgtcccttgatttgaccaaagaattaaagagtttttagtcagatatgacatttccaaacttttactttatgtttggcccagtagaaaagcaggttctcctgatttatcaacaaattgtgttttctttcatgagtcagggaatatatggtgggtcagtcccttcaaaggtcagtcagtcttttcttattatttaagagcaagaaaatgtctcaataatcagtgagatttcatgaatttcatactccatagccttttccagtgttaagcaatcctgagtcaggaggacatgacttctcgacactgacactgttttttcctatagagcctctcagctttagccattggtcaataaattattcactcggattaaataaattgcttttaattaccttctctatgaaggtctactctatttcagaattttaatcttattatatcatcatgacaactatgtacaatagggattattatctgtctttgatgaaaatggctgaacttcagtgacttattcaaagaaatttaaaaaatttcctgataaatggacagctagaaattgaattcaggtattttcgcctaggccccatgttgctttcattatacctcagctttttttttttttccttttttttttttttaaaaaaatttaaagaatatagggctgggcacagtggctcacgcctgtaataccagcactttaggaaaccaagacgggtgaatcacttgaggtcaggaattcgagacaagcctggccaacgttgcgacactccttctctatcaaaaatgcaaaaattagcctggcctgatggcacatgcctgtagtccgagctacttgggaggctgaggcacaagaatcacttgaaaccaggaggcagagactgtagtgagccgagatcacaccactgcactccagcctggaccacagagcaagactctgtttcaaaacaaaacaaaaaaaggccaggcacactggctcacacctgtaatctcagcactttgggaggctgaggcaggcaggtcacgaggtcaggagtttgagaccagcctggccaacatagtgaaaccctgtctctactaaaaatacaaaaattagccaagcatggtggcagtcgtctataatcccagctactcgggaggccaaggcaggagaactgattaaacccgggaggtggaggttgcagtgagccaagatcgtgccactgcactccagcctgggcggagtcttgtccagagcaagactccatctcaaaaaaaataaataaataaataaaaaggacatagacataaaatgatataaaatttcctctcagctttcttttcttaggagattgtttgtaaaattcattcattcattcattcacatttgtagcactcctaagacttaccagacagtgttgctaagtgtaaggacatagcacacagcctctactctcaagtatgtcacaattttatttgaaagaaagaaatataaacaaatatttagaatatgttaagtgcaaagatagagatatgagttaacaatgcttagaaattaaagttgatttaattcgaaaaacacaaaaattgtaatcatcttaattaatttctgaaactggtaaaagttacaaattcctataggccataacgactaagcagaattgcatgttaacaacctcactaccatccattcagtatacacagtggaccaaacactggagcaagaaagctgcataaaagtgatcctggagctaggaattaaggatttattctggctggaaattcaagatatttcttcctaaaatttatacatagatggcaaacagaaaacggtcaacacttcagaggatttagatgccattcctaatcgctgaggaacaaagtactacgcaaaacttcttgaaagaactatgaaccttgaaaatgggtaagtttagaaaacaaaattagaaagagcatcacagactagatgttacctttgtaacaaaaatatatacctggcttatttcaggaccagtctctgcactactataatcaaacacacattagcttgatagtcaagaatatttgaggagcattccagagctatttcacaggatatcttattaatgaatcacaacaaaacttcttaacatcttccttccaaatctatctttttctccaaaattcatagcttgtttgagggaattccctggtattctctaagaaatatcgaagaattctttcctagcccagtccactttgttttcgcttttttttttttttttttcttttttgagacggagtctcactctgtcacccaggctggagtgcagttgggtgatctctgctcaccgcaacttccgccttctgggttcgatcgattctcctgcctcagcctcccgagtagctgggattacaggcacacatcaccacatccagctaatttttgtatttttagtagaaatggggtttcaccatgttggtcaggctggccttgaactcctgaccttaggtgatccacccgcctcaaactctcgaagttctgggattacaggtgtgagccaaggcacccggcccctagtccactcttggtgttttgtctttttttccattcttatcttaacctcctgagtcaacattctctttcttgtgtgtctcccgcatcttgctagccttattctatctccttttattgtacagttttttctattcattattctgaacaatactcacaagttccagaacaaaaaaaccagatgcaaaatctacctgggggcggggatggtgggagaagaatgaaacatgtaaatactgctatattaataaatttagcctgatgataggtggaaatcggtaagactacatgagagacaagaaaatggttcaattttcctagtggaataatgaaaaaagagactaaaaaagtaggaactagtctatagagagtgtgaagagtttcttataatttctattaacttgatccctgagctactcgatgaagattttcacatttaaaaaacaagccatagaaaggcaaatgaggattatattataaggatgctacatacaatcatccttatttgcatgtgtgtgtgtgtttgtgtgggtgggtgagtgggtgagtattaaactctaatcccaatgtgacaagatgacaatagagtgacttagtcagatttacattagcaacatttttttcagaaagcttacactatattattggacatttttatcttattgtaacataattcatccaccaatccagatccctcaaggtatctatcattattttttggtgccatcacttgtttcttgattttacaaagctcaaaagttaacccaaattttgataattctccactagagcagaattgcctatttaaacatcatggctttgtaataagcaattgatagagagaaaatgatgcattttcacacatccaagtggtacagatcagcggttgtccaagcgtgtcccaaagaactggaattagatagagtgttgacaagtttcatcggtagaaccaacaatcagccggcgtacattggtatggtggtacagaagtaaaaatagtaaatactttcaaaccagttgataaatagttactgcaccaagttctctgagtagttgttcctgcgaggcttatcacctatggtctctcactcaggggcctctcaagtttcctcacagtctagcaatcaaaagattgaggcctggcacagcagagatcctcaaaaaacttgctccagcaccaagaccaacacacctgtgctgatctgtcgatgcctttgccaatcaggctgctccccagtgggggacacagtgaccttgggttggcactgcatcatggaaggcaatttctttcttttgttattattattattattattattattttgagacggagtctcgctctgtcacccaggctggagtgcagtggcgcaatctcggctcactgcaagctccgcctcctgggttcacgccattctcctgcctcagcatcccgagtagctgggactacaggcgcccgccaccatgcccagctaatgttttgtatttttagtagagatggggtttcaccgtgttagccaggatggtctcgatctcctgaccttgtgattcacccacctcggcctcccaaagtactgggattacaggcatgagccaccacgcccggtcatggaaggcaatttctagtgcccctctgtaagtcctgattcacagctaagagatgcttccagttctagtcgcacatttatgggagctgtagtctcctatggacatgagctctaaaagagcagaggatgctttttgcccaacaaagaggttaggcagcagactggcttgtgagccgatatgctggttaaatattttaactatcatccctaggtatgggagaggacattttccaagaacaaaaaatattgagaaatatgtgattaggcaacatttaatgttcctttacttcataacttttcacaaactatattattctaatatacattgaacctcttaaaagcatatttcatgcgacattttccaaacatatttgatgataggatccattcttgagggatatctaatgagattagtgttctgagcaacacacttggggaagcataagatcaaagacaaagaaaaaaaaagaaaggtatggatcttaatttcgtaagaaagaggaactataaaattatcttaaatgaaaattgcaaacagaaatgccagcctggactaaccataaagtgactactgttgtaatagaaaaacaaaaaacaaaaaaaggaaaggatcttaaaatgtgtatcttaaatagtcataattaagatgcgacatatgcagccttgaattcttcacttgtaccatttttaaaaaatcatttcaaagcaagcatttttattttcaggctttgtttacaggttgacttatctataaatgaaaaagagagcttctgtcaacacctatactgtgccagaagaagctaaaagcttaacaaaataagcattccatgaaaataaatctgcaagtgattaaatcaaggcttactttcttctgcttttgatctttaatccttacactacgtttttacaaatatatcttagtagcttttagaacatttgaaagtatgtctctatttaagtatttactgtatacacagagctgaaataagtcgctctgtggagttcagaaaccaccatctgaggcatcccacccgccttccaagaggttattatctttttgaggtggcaaaatctcctatcacgcttgaaaaaaggatcagtataggatacagctagtttccataagagttgcagaaatgcagtgtgtgactggatttccttcactataatcttatgccatcaaatgggatgctaaataaacacagaatcattgtaatctaaattaacccataagcacaatgattggcacagaagcaaactataaatgatagcttttgttactcattttctaacatttttttcttgattgtttttggtgttctttgctcaatacttactaaaacctacaacgtgaaccctcaatgaaaaccccaaccactgaaaataattttgagttaggttgcttagaagaaaagatattcataaagcaattacaacattttaaaaatgtagcataatttagtctatcatatcttgaaggatatgtgctagtagttttaggtggtacttggatcacagagttaatggtaagaactggaatataagcaataaagattccacactctgcttctataataattatgtcacaattccatttctgaatagaccattatgcttaaaaatcctaacagaagccgggtgtgatggctcatgtctgtaatcccagaactttgggaggccgaggtgggtggatcaactgaggtcgggagtttgagaccaacctgaccaacatatagaagccccatctctactaaaaatacaaaatcagccggatgtggtggctcatgcctgtaatcccagctactcaggaggctgaggcaggagaatcgcttgaactcggaaggcggaggttgcagtcagctgagatcgcgccattgcactctagcctgggcaacaggagcgagactgcgtctaaaaaaaaaaaaaaatcctaacagacaacatcataacaacgaatgctctttgagtacatacaatgttatctgagctcttcacatgtagaatcctatgagatggacactgatattaatatcacatgttacaaataaggaagactaaaaagtgtaactagcctgcttaagactacagaacttgggaggtgcgccgggcgcagtggctcacgcctgtaatcccagaactttgggaggccgaggcgggcagatcacgaggtcaggagatcgagatcatcctggctaacacggtgaaaccccgtctctactaaaaatacaaaaaattagccgggcatggtggtgggcgcctgtagtcccagctactcgggaggctgaggcaggagaatggcgtgaacccaggaggcggagctttgcagtgagccgagattgcgccactgcactccagcctgggcgatagagcgagactcggtctcaaaaaaaaaaaaaaaaaaaagatcttgggaggtgctgagtgcgcactggccagcatccttaactccatactgccatgcctctgtcaaaagccaccgggagaaatctgcagttaaggagatgtattcagaaaacctagttgagcattttttggtaaaagaaacattaactaaaactctttgaggttgtatatggtgtagaccaaagcctggcttttctttatacctattaaaaggcagacctgccagggaaaattgattaaataaaaaaaaaaaaagtataagcagaaactctcacaaggatctatgaggaaaagaaggtatatcctttatctgatccagcctgactcctgtgaaggctgaaaatatggacaaagtgattgggctcaaccagttaatgacttgatgatgcctcattaagattagcaagatatctcagtctaatagaaaaagcaagttcttgaagcaaaacacaactggaattagtcactcactgttacccactgcagtgcctacatgtattagttggactcctagcccacttatgttgcccagtgcaatgccaatacgtcaaaactagattcctattcagctttaactctgcttatttttagcaaacaggatgtctgtggtcaggagttccttcttagaaataaaccagctgaagttagcaaaatccaaaactgcagcttactcaacctctgaagaacttctagcttcattataatccaatttccatgctgaatgacactcccaccagtatcatgacagttgacagtcaccatgacaatgactggagcagaccaagaaaaaatagaaaagaggcagctccttgattccaggaaagtctcactcccttcaaaagaaaagcataaatattcctccccttgctcttcaacccaaccccctatgttaaagataccctgtatttgtaactgcctggttctcaggagctgggaaattaatttatgagctatgttcccacttctccaattccatgatgattgaataaagacagtactgcttgacactcactttcagttttgtgtattggcttttgcaacaccaaacaggaaaaagccccctttggggtaactgagacccccaataacatcactatctagtaggcggtcagtgccctggtttctacaacaaataaatctctcagtactccacagaatttcatgtataatttgcattccaattgtcacctaataggattgcaatataattgtgagctgcctgatacccaatccctctcttttctctgcctcctcccaactccactcacattccagtcttgtcccttcacttggaaaggtttttttccagatacctaatagacaactgtcttattgctttctgaacaatgctcatgttgtatgaagtgacagcctccctcacccacccctcagcacactctgcccttcctaggtgcttttattttctgttcacaatatttatccccatctgatagatttttacttatttttattgtgtctttctccatgggaacagggctgatgtctgttttgttcacagatgtcttcctagcactcagaacagcgccctgggcacagtaggcactatttgcttttgactacttgctagcctgatggaggcttgcttttcttgtgttacccagtggacttccatgaaataaaaattgagaagctcatatggtttggcaaggacttttggctacaatagcccctgctgttagaagataaaatcagccgtgtggaaagaagggacactagggtggtgactcggttctatgccctctactttttttaaattaataaccttgatttttagagcagtttcaggtccacagcaaaacagagtggaaaataagtagttctcatatagcccatccctacacatgcatagctttccccattatcaatatcctccttcagagtgttacatttgttacaatcaaagaacctataacgaaggataatgattacccaaagtccacagtttacattagggtacattcttggtgttatacattccatgggttctgacaaatgcataatgacatgtatccaccacttgacatcatagagaatagtttcactcggtcaaaaatgcttggtcctcttcctattgattcttcctattcccctaacccatactaaccactgatccatttaccctctccatagttttgccctttctagaatgtcatatataggcataccttgttttattgcactttattttactttgcaaacattacattttttacaaattggaattttgtggcatcctgcagggagcaagtctattggtgccatttttccaacagcatgtgctcacttcatgtctctgtgccacattttggtcgttcttgcaatatttcaaacttttccattattatcgtatctgttatggagatccgtgatcagtgatctttgatgtttctattataatcattttggggtgccctgaaccatgcccatgtaagatggcaaatttaatcaataaatattatgtatgttttgactgctccaacaaccagctattccctatccctttctccctccttttctttcctcccacccctcaggcctccctcttgcctgagataaatgatattgaaattaggccaatgaataactctacaatgtcttctaagtgttcaagtgaaagggggagctgcattaaataaaaagctacaaatgattaaacttggtgaggaaggcatgtcaaaaggcaagacagggcaaaagctgggcctcttgtgtcaaacagtcaagctgtgactgcaaagaaaaagttgttgaagaaaattaaaagtgttactccactgcacacaagaataagaaagtcaaacaggtttattgctgatatggagaaagttttagtggtctggctagaagatcaaaccagctacaacatttccttaagccaaaacataacccagagcaaggccgtaattttcctcaactctatgaaggccaagaggtgaagacgctgtggaagaaaagtttcaagctagcagaatttggttcatgaggaaaaaagccttctctataacgggtaagtgcaaagtgaagcagcaagtgctgatacagacactgcatcaggttatacagaaaatctagctaagatcattgatgaaggtggctacagtaaacagcagatgttcaatgtagaggaaacaacatccaatcaaaagacgattccattagaatttcaaagctagagagaagtagccaatgctggcttcagagctttgagggacaagctgactttcttgttgggggctaatgcaattggtgactttcagttgaagtcaatgctcttttatctttctgaaaatcctggagtccataagaattatcctaaatctattctccttgtgctctatacatgcagcaatgaagtctgaatgatagcacatctgtttacagcatggcttattggatattttaagcccattattgagacctattgctcagataaaaagattcctttcaaaatattactgctcactgataatgtacctagtcatccatgaactctgatggagatgtacaaggaaatggatgttgttttcatgcctgctaacacaacatctattctgtactccatggatcaaggagtaattttaatttttaagtagtattatttaagaaatacactttgtaaggctacagcttccatagatagtgattcctctgaaagatctgggggcaaaataaattgaaaaccttttggaagggattcaccattctagaagccattaagaacattcataattcatgggaggagatgaaaataccaacattcataggaagttggaagaacttaattccaatactcatggatgactttgaggggtttgagacttaagtggagaaagtaactgtacatgtggtgaccataacaaaagaattagaagtggagcttgaagatgtgagtgaattgctgtaatctcatgatcacacttgaaccaatgaggagttgcttcttatggataagcaaagaatgtggtttcctgaaatggaatatattccggtgaatgtggtgtaaacattgttgaaatgacagcaaagaatttagaatattaaataaacttagtagataaagtaatggcaggatgtgagagaatgaactccaattttcaaagaagccctaccatgtgtaaaatgatatcaaaacagtattgcatgctacagagaaatttttcatgaaaggaagagtcaattcatgtaggaaactttattgttattttattttaagaaattgccagagccaccttaatcttcagcaaatatcaaggcaagaccctccaccagcaaaaagattataattcactgaaggctcagataataattcacattttttagttatattatatatatatatatatatatattttttttttttggatggagtcttgctctgtcgccaggctggagtgcaatggcatgatcttggctcactgcaacctccacctcccaggttcaagtgattcccctacctcagcctcccgagtagctgggactacaggtgcacgccaccataccccgctaattttttgcattttaatagagacggggtttcaccatgttggccaagatggtctagatctcctgacctcatgatccgcctgcctcggcctccaaaagtgttgggattacaggcatgagccaccctgcccagccataaaatatttttgattaaaatatgtacattggtggccaggtgcagtggctcacgcctgtaatgccagcactttggaaggctgaggagggcagatcacttgaggtcaggagtttgagaccagcctgggcaacatggtgaaaccccatctttactaaaaatacaaaaactagcctggtgtggtggcatgcgcctgtaatcccagctactcgggaggctgaggtgggagaattgcttgaactcaggaggtggaggttgaaatgagccaagatcacagcactgcactccagcctgggcgacagagtgagactccatttcaataaaatacacacacacacacacacacattgtttttctagacataatgctattacacacttaatagactgtagtatagtataaacataacttttatatgcactgagaaagcaaaaattcattcacttgctttattgtgatatttggtttattgcagttgtctggaatcaaatccacagtatctgaggtatgcctatagttgaaatcatacagcatctagcctgttcagattggcttctttcacttagtgatatacatctcagcttcctgcatgccttttcatggcttgatagctttttttctaagtgttgaataatgtccctttgtctgggtgcaccatagtttccagtcacctactgatctcagtaaatctcagttgcttccaagtttcgacaattataaataaaacttctataaacatccatgtgcagaattttgtgtaaacatgttttcaactcctttgggtaaatatcaaggtatgtgattgctggattgtatattgagtatatttgttttgtaagaaattgccaaactgtctcccaaagtgactgtatcattttgcattctgaccagcagtgaatcagagttcctgttgtttcacatccttgtgggcatttggtgttctcagtgttttagattttgcccattttaataggtgtatagcagcgtatcattttttttatttgtaattccctaaagacatacgaggtttaacatattttatatgcttactggacatctgtatatgttattattttattattttatttatttttgttttttgagacacagtctcaccttgtcacccaggtggagtgcaatggcatgaccttggctcactgcaaccgccatttcccaggttcaagtgattctcctgcctcaggctcccgagtagctgggactacccttgtgcaccaccaggcccggctaatttttgtatttttagtagagacagggtttcgccatgttggccaggctggtctcgaacttctgacctcaggtgatctgcccacctcagcctcccaaagtgctggaattacaggcgtgagccattgtgtctggcctattctttcatgagatgtctgttcaggctctttgtcatttttaaaaaatggctttaaatataaatttcttaatgttgagttttctctgttttgtgtttttgagatggagtttcgctgttgtttcccaggctggagtgcaatggcgtgatctcagctcactacaacctccgcctcccagtttcaagcaattctgcctctgcttcctgagtagctgggattgcaggcatgtgtcaccatgcccggctaattttgtatttttagtagagatggggtttcaccatgtaggccaggctggtcttgaactcctgatctcaggtgatccacccacctcagcctcccaaagtgctgagattacaggcatgagccactgtgcctggcccttactgttgagttttaatagttatgtgcatgtgtgtgtatgtatttccccaatttactgatacgattgacaaatgtaattgtatttaaggtatacaatataatgttttcatataggtatacattttgaaataattaccacaatctacttaattatatgtccattacctcaaacattaactgtctgtgtgtttatgcagtgagaacacttgagttctctaggagcatatttcaaatatgctttgcattaactagagttactatgttgtaaatgaagtatcctgaacttattcatccaatagtgaaaagtttttatgctttgactcatatttccactttctcccaacccccagccactagtaaccaccactctactctctgttactatgagtctggctcttttatagattccacatgtaagtgagatcatgcatcatttgtcttcctatgtctggcttatctcacttagcataatgttttccaagttaattcatgttgcggtaaaaggcaggatttccttttttttttttttttttgtgatggagtctcgctctgttgctcaggctggagagtgcagtggcgcgatctcggctcactgcaagctccgccccccaggttcacgccattctcccacctcagcctcccaagtagctgggactacaggcatctgccaccacgcccagcttattctgtttttgtatttttagtagagacgggatttcaccgtgttagccaggatggtctccatctcctgacctcgtgatctgcccaccttggccccccaaagtgctgggattacaggcgtgagccactgcacccagacaagatttcctttttctaaggttgaatcatattctactgtatatataatacattttctttatccattgatttctcagacacttaggttgtttccgtatcttggctattgtgaataatgttgcaatgaacacagaagcaccagctatctcaagatagtgattttatttcctttggatatgcacccaggaataaaactgctggatctatatggagcatatttaaacttttaggagccaccacattgttttccatagtggctgcatatttacactcccaccacaagtgtacaagggttccctttgctccacatcacttgttatcttttgatattttgataaaaaacatcctaatagttgtaaggtgatatttcattgtggttttaacttgcatttccctgatattagtgatgttgaacatcttttcatatactattggctttttatatgccatctttggaaaaatgcctattcgtgttctttgcccatttttaatcaggttttttgtttaattttgctatttacttgtataagtttcttatatattgtgatgattgtttctttgctatgcagaaacttttttgattaatatattcccacattttgcttttggtgtctgtgcttttggtgtcaaattaaaataaaatcatttctaagaccaatattgaggagattttcttctatgttttcttctaggagtttcatggtttcaggacttatgtttaagtttttactcaatttttaattgattttcatgtatgatataaaataaggatacaatttcattcttttgcaggtgaatgtccagtttctccaacaccatttactgaatttctttttttttttaattattattttttttaaattatactttaagttttagggtacatgtgcacattgtgcaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatggccctacaaaggacatgaactcatcattttttatggctgcatagtattccatggtgtatatttgccacattttcttaatccagtctatcattgttggacatttgggttggttccaagtctttgctattgtgaataatgccgcaataaacatacgtgtgcatatgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttgtccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccctcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttagttactgtagccttgtagcatagtttgcagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcattcctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattatcttttttggttgtgtctctgcccggctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgttgtgtctttgttctcgttggtttcaaagaacatctttacttctgtcttcatttcgttatgtacccagtagtcattcaggagcaggttgttcagtttccatgtagttgagtggctttcagtgagattcttaatcctgaattctagtttgcttgcactgtggtctgagagatagtttattataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaagccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagtatgttgaatattggcccccactctcttctggcttgtagggtttctgccgagagatccgctgttagtctgatgggcttccctttgagggtaacccgacctttctctctgactgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggtaccattctctgcatcactttcaggtacaccaatcagatgtagatttggtcttttcacatagtcccatatttcttggaggctttgctcatttctttttattcttttttctctaaacttcccttctcgcttcacttcattcatttcatcttccattgctgataccctttcttccagttgatcgcatcggctcctgaggcttctgcattcttcaggtagttcttgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcctctctcagctcgtcaaaatcattctccatccagctttgttccgttgctggtgaggaactgtgttcctttggaggaggataggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttagaataccctgccctgtgaggtgtcagtgtgcccctgctggtgggtgcctcccagttaggctgctcgggggtcaggggtcagggacccacttgaggaggcagtctgcccgttctcagatctccagctgcgtgctggaagaaccactgctgtcttcaaagctgtcagacagagacttttaagtctgcagagtttactgctgtcttttggtttgtctgtgccctgcccccagaggtggagtgtacagaggcaggcaggcctccttgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagactccgtgggtggaggaccctccgagccaggtgtgggatatagtctcgtggtgcgccgtgttttaagccggtctgaaaagcgcaatattcgggtgggagtgacccgattttccaggtgcgtccgtcacccctttctttgactcggaaagggaactccctgaccccttgcacttcccaggtgaggcaatgcctcgccctgcttcggctcgcacacggtgcgcgcactcactggcctgcgcccactgtctggcactccctagtgagatgaacccggtacctcagatggaaatgcagaaatcacccgtcttctgcgttgctcacgctgggagctgtagaccggagctgttcctattcggccatcttggctcctccctgatgcctttcctttctaggagagagaaaggcattcccaagacacccaagagcctctatttggtaaggtctcctttacaaatgtgtatgtatctcaagctcacaatattcctcagagctccaattacctatgtctaactcatttttgacaccttcatttggatgcctcatgggaatagatttcaaatctatcaagtccaaaaaggagtcatttccaccctgccctcatctcccctgccacccaccacacacacgccctacggccctattctaggcctaggagtctacctatcagtaaaacatcactatcttctagccaattgcaaaaaaacacagaaacttggagtcatttttgttcctgtccctcatctctcacatgcaatccaacaacaggtcccagtgttctaccatatctccactgccactaccttaatcctagccacctgcaccagctagcttgaaacctactgaatttctttgtatattgtatatgacaggccttcatcagataggtcttttataattttttcccagtctgtggcttgtcttctcattctattggtattatcattctcagagttttaaaatttaatgaagtctggattacccatttttttcatagattgtgactttggtcttgtatgtaaaaagtcatcaccatatccaaggtcatttaggttttctcctagttatcttcaggagttttatagttctgcattttacatttaggtctatgatacattttgagttaatttttgtgagggctgtaaggtctgtgttcaaacttccttttatttgtatttatttttgcctgtgggtgtccagttgtttcagcaccatttgttgaaaagacttttcctcattgcatgggctttggtcttttgtgaaagatcagctgactatatttatattgttctatgtctgggctctctactctgttccattgatctatgtatctgttccttcacacaataacaaactgtcctgattactacaagtttattgtaagtcttgaagtcaggcagtgagtgctccaattttgtttccttcccttactactcagttgactattctgggtctcctacatctccatataaactttagaattatttgtcaacatccacaaaataacttgctacattttaattgagattgtgttgaatctatagatcaagttgagaagaactgacatcttggcaatattgagtctttctgtccatggatatggaatatcttttcatttacttagttttttaacatcctttatcagagcttcatagttctcctcatacagatcttgtgtgcgtatgttgttaaatttatgtctattttcttttttggtatgctaatgtaaatggtaatgcgtttttaatttcaaattctgcttgtttgttactagtgtatattacttttgtatattaaccttatattgtacaatcttgctacaattacttattagttttttcattgttgttgattctctaagattttatacatagatgcttctgtctctgcaacaaagatagttttatttcttccttttcaatctgtataacttttattaccttttcttgtcttatggtattagctaggacttccagctaaaaaacagtggtgaggagatattcttgccttgttctgatcttagtgggaaaactttcgagtttctcaccactaagtaagatgctagctgaaggtattttgtagatgtttcttgtcaatttaagaaagtttcctcggctgggtgcggtggctcacacctgtaatcccagcactttcgaaggctgaggcagtcgcatcacaaggtcaagagatcaagaccatcctggccaacatggtgaaaccctgtctctactaaaaatacaaaaattagctgggcatggtgttgcacgcctgtagtcccagctactcaagaggctgaggcaggagaatcacttgaacctgggaggtggagtttgtagtgagctgaaatcacaccactgcactccagcctgggtgacagagcgagaccctgtctcaaaaaaaaaaaaaaaaaaaagaaagaaaagaaaaagaaatttcccgctatccttaggttgctgagagtttttaccatgaattggtattaagttttgttattttccctcatctattggtatattatgtgattttatttagcctgttgatgtgataattacattaattgatttttgaatattaaaccagctttacatatcttggataaaccccacttggtcatgatgcacaattcttttcaaacattattggattgaggggttttgcatctttgttcatgagagataattgtctgtaagtttgcttttttctcctaatgtcattgggtggtttttgatattggaataataccagcatcatgaaatgagctgagaagtattccctctgcttctgtattctgcaagagtttgtagtaaattggcataatttatttctgaaatgtatgggaaaattcaccagtgaactgactgtgcctggtgctttctgtttggaagattattaattattgattcaatttctttaatagttacaagcctattcagatttctacattttcttatgtgagttttggcagattgtgtctttcaagaaattggtccacttcacctatgttattaaatttgtgggtagaaaagtgtacataatagtcctttattgtctctttagtatccataggatctgtagtgctctctcctctttcatttctgacattagtattttgtgctccctctcttttttcttagcctggctagaggcttatccattttcttgatttttttttttttccaaaaaaacaggttttggttttgttgattatctattttcagtcttgttgatttatgctctaattttttattatttcttttcttctgcttattatcaatttaatttgctcatttttccctaattttctgaggtgggggtttaaattattgatttcatattttttctttttaaatatacactttcaacattgtaaatttccctctaagcatggcttttactgcatcctacaaactttaattaattttattttattttcctttacttcaaattatagtttctcttgagattttttctttgatcgatgtgatatttagaagcatgttgtttaatctctgcttattttgaaaattttcagctatttcttttattgatttccagtttaatttcattgtggttgaaaaacagacattgtataatttctatttgcttcagtttgttaaggtgtgttttatggttcagaaagtggtctgtcttagcaaattttccatgtgatcttgagaagaatgtgtaatctgttggtgttaggtgatattgtctagagatatcaattttaccctgttggttgatggtgttgttgagttcaaatatgtccttataatttttgcctactagatctgttcatttttgaaagacgatgttaaggtctccaattataataatgacttcatctttacacttgcagttctaatcagtttttgcctcatgtatttggacacactcatgttaggcatgtgcatattaaggactcatgtcttcttggcatattgactcccctttatcattatgtaatgcccctctttaccctgataattttctttgctctgaaatctgccctgtgtaaaattaatataatgactccaaagaccttctaattagtgttagcatggtatatcattctccatccatttacttttaatttgaatgtatctttgtctttgaagtgggtttcttgtagacaacatatagttagggcttgtttttctcatccactccatcaatctctgtcttaattggtatatttaggccactgacatttaaagtgattattaatatagttggattattgcctatcacatttttaccattttctttttgtttcctttattctttgttcctattatctttcacatgttttctgtcttttgtgattttaattgagcattttatacgaatttattttctctcctttcttagcctatttgttttcctcttctttttcactctttttagtacttgctgtagagtttgcaatacatatttaccactaatgaagttcacttctaataacaacacactacttcatggggagtgcaggcactctgtcataacaacttattcctaattctccttcccaattcttgtattattgatgtcattcatttcacctgtacataagcatacctaagtgtgtatgtgtgtgtgtatatatatacatgagcatacgtaattgaatacattgttgctattatcttgaagaaagtggtatctgtgagattactactcagaagaataaaggtttttgtggtacattcacttattcattctgatgctcttcttttccttacatagacttgagtttctatcctgtatcattttccttctctctgaagaacttcttttaacatttatttcaaagcaggtctaccagtaacaaacttcctcaacttttgtccgtctgagaaaagtctttatctctccttcacttttgaaagatagttttgcagggtacagaattcttgatgttttccattattttttcctctcagcactttaaatatttcatcccactctcttcttgcctgtatagatctgagaagtcagatgtatttttcatctgtgcctctttacaggtaggtgttccccattctgccttaaaaaagttttttttaaatctttgattatctgaattttgaatatgatatacctatgtggggttatgatggtttttgtggttgttgctttgttttttgacatttatcctgcttagtgttctctgagttttctagatctgaggtttggtacattattttgcagaaattctcagttatcattgcttcatacattgcttgtttctttctctttctttcccttctgttattcccactatacatatattacacttttgtagttgccccacagttcttgctctgtatttgcacttcgatggtctttttttaagttttggaagtttctgttgaggcatcatcaatttcagagattcttttctcagccatgtccagtctaccaatgagctcatcaaaggcattcttcatttctattacatggttttcatctctagcatttcttcttgatcttttcttagaatttccatctctctgatgacattatccatctgttcttccatgttgtctgctttttctattaaagcccttagcatgttgatcatacatttataaaaattatcggtttttctaattctgatattcctatcatatatgactctggttgtgatgcttgtttaatctttagaaactggattgtttgcctcttagaatgcctgaacagctgacatgaggtactaggtaaaaggaaccatagtcaataggcctttagttgtgtgatggtaatacggggaagcgaagagggagacacaacattttttttttttttttgagacagagtctcgctctgtcacccattctggagtgccgtggtgcaatctcagctcactacaacctcagcctccctggttcaagctattctccagcctcagcctcctgagtagctgggattacaggcatgcctcaccgcgtccagctaatttttgtatttttagtagacacaaggtttcaccatattgaccaggctgatttcgaactcctgacctcaggtgatccacccacctcggcctcccaaaatgctgggattactacaggcgtgagccaccccgcccagccaggcaaaacattctttagttctatgattaactctcagattttttgggagtctttgcccctggaatgtgaactttaccagtgcttctcacatttcttccctgcttaggtggaacataatagctagaggaagttgcagttgcttatttcccttccccctagtcagttatggtctgacagatccccagcaggtgaggctctgttaactagtttctcctgagggcaggtcttgttaagacagaatgctctggcgtatttcaaaatggttacttttgccctctccctgctggaagtacgaaggtaagttcccccaccagttgtcactgtggggagctggtaaagctcctggaggtaaaactcacaaaagtatgagggcctctctgattaggtccccacgaagttcttaactctcagacatgtccacactgagcctcctgcaaaccatcaactactgtttaagtttttgtaacttagcactggttcctgtggaagtttctgcttgttgagtttctgctcaggtaaattgtgatttgctgtgtctgactgttggtctttccaattcgggggacagcatttgtcctgtgacttcacttgtaggatgatctgaacagagttgttaattgttcagtttctttagcttttaacttgctaggaaaatggacaaactgtgaacttcttacatgctggaccagaaaccaggagttcacctctcttccttctgatcagaaaatctctgcctggcacccatctcctgattactctaagtgccctgaaagcagtgaacatatctttgttcacccccagatccccagtccccaggacagtgctggcacaatcaggtggcttctccacatgaagggtgaatgaatgcctaatgggcacgtactgaaccagggatgagccaagctgctccttcggtaaggctttagaaagcatacagatatcctgcccatctccttccctacccaaaaccccacagacggaagatgccttatttcagaaacacagagccatactgccaaggtcacaaagcaaagactcaggctatagagggaagcttgggcacaggaagcatcagggcattactcaaatcactgccaacaagatgtcctgaaagcggaacagtgttcacctctaaatcaagcagctgcagcgtctgtgttttgtttctttcttaaaatcattaagagcagccacttccattgctcctagtgcatttggtggcataaaaatagctccgaaagccaagggcgcattgggtgcatcacagactctgctccttaataacttaggatgcatgaggttaaagcagtgagaataatttagggtttggaaaatgtttgcgagtgagtcgacatttaaataacttcattatcattcattgacagattttttttaacctgtcagtgcaactgatatttctattaccatgttataacaaacccctgcacattttaaatacagtcactggattccactagtctacccactgtcaagaaaatatcttcaaatccatttttcataatacctcaagaatataataggcaatctacatcaaacgatgacgtggagctgaaggaaattgtctcctgctttctaaggaatctgccccgaaatacgtttgcctgtcagcctaaacatataattcaaatgtgctgccgagacattatggtgcattctgagctgaatgagcttccctctctttcctggattccctgaacctttcagcgtaacttgcagaattagctaaggggattaaacagtaggttaaggggaagtcatgtaaaattgacataaaaatatttccattctgtcatgtatcacagaatttttaatatcacatcaaaagcttttattctttaaatatgttacttttatgttaataagggatagaagttctcatctatctagcagtctgttccatttttcttctcctaattatatctttattctgtgttcttgatgtttctagtcatacagatccggtgagataagaaatttgggtgcatttggctgggcgcagtggctcacgtctgtaatcccagcacttggggaagccgaggcaggcggatcacgaggtcaggagattgagaccatcctggctgacaaggggaaaccccgtctctactaaaaatacaaaaaaattagctgggtgtggtggcaggcacctgtagtcccagctgaggtaggagaatggtgtgaacccaggaggcggagctggcaatgagccgagattgcaccactgcactccagcctgggagacagagcaagcctctgtctcaaaaaaaaaaaaaaaaaaaggaaagaaaaatttgggtgcatttgattggggttgtgtgcagacagtgacttttctgctgtaggttacccttaccactgacatgtctgctggtttatttttgagtataaaagtaacttacattggccctgatacctggatctctattttgcataagaaagggcaaagtaatttaagcagaggtctcctgttcatctttttaggagcaaattggagtactatccttcactagatgatgtccatgacatccttcttatacaaacacacagttgtctgtgcccaatgtatccaatatgtaccatccattctagttcttactgccattcctagggcaggccatcactatttctgctgtggctagaacttgttgcagtagtccaggtaaatttactagcagctccccctcacagatgcggcctctctcatacctccatgtctttgcaaaggcaatatccactgctaagcagacaagctggtactggtgaggagggcatagggcacgtattccttctcatcttttaacattctactccacagttttcttcccagggatgccactcctgaccatgccaatcaactagcagtcagcctttgttctttcttccatgacaacccagattccctggcattgtatcgttgttgtcaatgctcacagttgtctgtgctaatagactgcattttctaaaggcagggatagacaataatttatcctttcactcttctttcagccgatcacaattcattcatacacttcaaggctggaatcaaatatcctttctttttttttgagactgggtctcactttgtcaccaggctggagtgtggcggcgcgatgttggctcactgcaagctccgcctcccgggctcaagcgattctcctgcctcagcctccccagtggctgggactacaggtgcgcaccaccatgcccaggtaatttttgtatttttagtagagacgggttttaccatgttggccaggctggtcttgaactcctggcctcaagtgatctgcccactttggcctcccaaagtgctgggattacaggcatgagtcactaccggccaatatcccttctttcattgaaccttttcacatccctctgctgaatggaatgcctctctcctttatactgtatgtgatttatttgaatctctccttattggcctttatatgctgccatgtattacatttacatgcgtttgatctcgcttaccagatggccatctactaggagcaaaatgcatttatgcttactcttctgtatctctctccaccatttagctgcttcttacaatccagaaggtgctcagtgttgctaggttgaaccgaacacactatcctgtaaagttctcctttatcaccagaaaattcagtttgaaaaatttcacatttgggttttgcatttccttttggagggtttgggagcaagaaaacttcagggcttccagctgagtttgtgttgggtaggaataattatgagacataaatataagagagattagtgactcactaaggaagaactcatacaaatgcatatgcaaaatgtattatatatcagtttgtttaaatgtctataaatacagctatggaaaataaaatatccatttgtcagttataagggtaaagataaatttgggaggagagcaacttatctttttagctttgtgacatgttctatcttttgatacaaccccaatctccaggtacttctagtctgacaggtagagcatccttcatcacactggggtcaaatcttcataggctgcattaccctacactcctgaattatgcggtttatgaataacagtgaacatttattgaatgcttaagataccacacactgggctaagcacttcataaggattacctcactgagttctctaacatcgcacgagttaagtactggtatgatccacattttacagatgaggagaccaagacttaaggaagatgatcagcttgcccaatgccacataggagtgatgaacatggcctagattcaaactcaggcagttaggctccaaagtcagcatgcttaatacagagatatggtgaattgtccatttaaatagggtactattcgtagaatgatggcagtgtgtctgaaaaagaatagatttttcctaatggagctcccagaacttacatcacctgccttccaaacaacgaaccactgctgtttgtaatattggcgagttgtcatcctaaattcaattttttattagaatgaggatccttaatccaagcttctagtaaactagttcaactgtattaaaggtaacagggattactgcagacttccccccagttgtgaatgcactgtacttgaaatgaaatggcatacatacacacgtcctttatcttagagcccttgttagaaaatgaattggagctccaattctgccaatgtgtttcactctcttctcacacggtactcagttggctgaagacgcagtgttattgtcccgacttaagaatatgcaaaaataggccaggtgcagtggctcatgcctgtaatcccagcactttgggaggccgaggcaggcagattgcctgagctcaggagttcgcaaccagcctgggcaacaaggtgaaaccttgtctctactaaaatacaaaaaaaattagccaggcatggtggcatgtgcctgtagtaccagctacttgggaggctgaggcaagagaactgcttgaacccaggaggcagaagtttcagtgagccaagatcgcaccactgcactccagcctgggggacagagtgagactccgccttaaaaaaaaaaaaaaaaaagaatatgcgaaaataaataaaatacttaccaaatgaagtcaatgttacttggctctcctagcttttccatcaaaacatacatatgcaaattatgaaaaatgtattctagaaggacaagctacgaaacatatagcagtgacaatggaatttacttgatcccttaaatttaaaatggttcaaataccctcaattggccgggcgcagtccctcacacctgtaatccaagcactttgggatgccaaggcaggtggatcacgaggtcaagagatcaacaccatcctggccaacatggtgcaaccccatctctactaaaatacaaaaattagccaggcgtggtggcatgcacctgtagtcccagctactcgggaggctgaggcaggagaatcacttgaacctgggaggcagaggctgcagtgagccaagattgtgccactgcactccagcctggtgacagggcgagactccatctcaaaaaaaagtgtaagctgtcctctaggtgtcatagtataatgtcagcttgttaggtttctttcttttcttcaccatagatgatgagattttcagtctcataagatacatgtttaactgagcttttgttacctttagttttccaaaggttgaatgaggtaaaaaaatgagtaaatcaattcctcatctgtaattggagacaactggaccagctgatctctagctttgactctaacatttaagaattccagtatcagggagttttagggaactgaacatctatagtgaaacctattacacacgtgaaaagttaaacttatggataaatatcatccccaaatcactggagacattcagggtcagagtgtcagggtgaacgcacatcttctttgtgtattacatcctgtctgttttctacttaatttcttgaagggtgaaataattgatgctatccagaaaacatatgcttgcctatttgtgcatatcattacaatgtcttttaatatcaccatttattttgtccctacccattactttgaggaaacctaaaaatcctagaaaattagagcttcaatgacatttagaaataatctcatctctcttcaatgttttttttaagtggcagaagagtttacgcccaagttagtcctcattaaaacacctgttctccatttcacccccgacccaacacacacagtttaccttccttattaactgtttcacactttcatacaatttcataggatcaataaaatagttttcatataataaaaagtttggctgggcgcggtggctcgcgcctgtaatcccagcactttgggaggccgagacaggcggatcatgaggtcaggagatcaagaccatcctggctaacacggtgaaaccctgtctctacaaaaaaaaaaaaaaaaaaaaaaaaaaaagtttcagcattctgattctgcagatgaagtagctgagacttagattaaagtaagtcaagcatttagttgagaccaaagtcatgaaaagaatccaggttttctgattctcatggtaagatatttcttagaattatacattgtcaaatatgcaaaggcaccttcaactcgtcgattaaaaaaattttgtaaagtctatccattttagaattagctaatactgtaagaaaaaatctgataatatttctttagaagttgatttccccccaaacaaacaaacaaaacagaaacaaacaaagagggctacaaatgtaaaaatctgtgtcctgctacacttcagaatcatacccagctgaaaactgtagttacatttgggcaagaggcaaggtctaagagaacattaaaaataaaaatattatatgaaatgcttacagagggctgggcacggtgactcacacctataatcccagcactttgggatgccaagagggggcagataacttgaggtcaggagttcaagaccagcctggccaacatggtgaaaccctgtctgtagtaaaagtacaaaaattatctgggtgtggtggtagacacctgtcatctcagctactcaggacactgaggcaagagaatcacttgaacccaagaggcagaggttgcagtaagctgagatcgtaccactgtactccagcttgggcaacagagcatgactccatttcaaaaaaaaaaaaaaaagtgcttacagagaatgcattccagcatccctcatgaaatagagatgatttttttttttttttgccaagatccccttcagtcactgatctctattcctccagtctgcatgtagtgattcccaaccaactcacaggcaatatctgtttcacaaaatctggatggtagagctgacagagggtggcgctctaatatgcaccatcacactagacacactgacatttgcccacaagtcccaagagaattgccagattcccattgccttcagattttccttaaaaaaaaaaaaaagcaaagtaatacaggaaaagctgccagtcccatctcacaatctttccagagtcccttccctggattcttgaatgctttgagatgaacactgtgtagacgaaaacactcagattcttcttggcttgggttctttctgtggcaaaggctagacctgaacagccagtaacagatgctggaaaatgttcacccaaagcccaagactttgattcttcaaaacccgcacagtatgtagcctgtgtgaagttaattcaattattagaaacttagtatagaaaaaaatctaaagttggctcactagaaacaggtagtgtgcttggctgtcatggagaaaaatgaaagtagtgagtaaatacatattcaactgaaacaaccaggtgctcacattgggactaatcaagagaacaactcagtccacggagaacagagaaaagcaaggcagaatgacggtccaccagggagcaacacaaagccagggtaacctcccccgcccagggaagcagcgggtgagtgtgtgactctgggaacccacgcttctcccgtggatctttgcaaccctcgagtcagaagatccccatgtgaacccactccaccatggcctttagtctaacacacagagctaagtgggggcttagcagagcagccactcgagcacatgcagagacgtgggaaccttagatactcgggctttctgagcttcccggcaaaagcagctgaaactctggcaaagcaggaggttagaccctcatatacaccctcaggaaaaggctgaatccaggggaatgagtagcattcatcttcaggccctactcccacaacacatcaggataagacctgctgatgcggaactccagccagccactggtagcaacaattgcacctcactgagctggagctcctagggttggggggtggggtaggggttgccatattggctgtgtggcagacttagctttttcagccttcgggctttggaaagaccaaggtaaccaggggctgaagtggatctccagaacagcacaactgctctatgaaaacgtgactagactgctttttaaagaaggtccctgatcctgttcctcctcactgggtggggcctcccaaaccagggtctccagccaccctcagtggtgttcactggccaacagaggtttcaaacctccctgagacagctcccagagggaggggtgggccaccaactttgctgttttggtgacttagctgtcctgccctttgggctttggagagacataggtgaccaggggctgaatcagacccctggcacagcacagctgctatacaaaaatgtgatgacagctgctatacaaaaacatggccagactgctttttaagcgggtccctgatccagttcctcttcactgtgtggggcctcccaacccggatctccagctacctcctacaggtgcatttgagctggcaatgggtccataccttcctgggacagagctcccagagggaggggcaggcagccatgtttgtggttttgcagccttcgctgttgatccctccaggtactggaaaacccaagttgactaggaactggagcggacccccaacataccacacagcagccctattaaaaagtggccaaactgggccaggcatggtggctcatgcctgtaatcctagcactttgggaggcctaggtgggtggattgcctgagctcaggagttcaagacctgcctggggaacatggtgaaaccccatctctactaaaaatacaaaaaattagccaggcgtggcagcgggcacctgtaatcccagctactcaggagactgaggcaggagaacgcttgaacctgggaggcggaggttgcagtgagccaagattgtgccatttcactccagcctgggcgagagagcaagactccatctcaaaaaaataaataaaataaaataaaataaaaataaaaataaataaataaaaagtggccagactgtttgggaggcccaggcaggcagatcacctgaggtcaggagttcaagaccagcctggccaacgtggtgaaactccatctctactgaaaatacaaaaattggccaggcgtggtggcatgcacctgtaatcccagctactcaggaggctgaggcaggagaatcacttgaacctgggaggcggaagttgcagtgagctgagatcacgccactgcactccaacctgggtgacagaatgagattccgtctcaaaaaaaaaaaaaaaagtcgccagactatgtggatgcctgttcccatatctcctcactggccacccccgactagggctattgagccaatagcagctctgtaacttcctggacagagcccccaggggtaactgaaagcctctatgccactgactctgcagtggaactgcccttgctaccctccaacaaacaaaagagcaaagaccctaagtgccttatccacaccaccaacaagctgcagtcaacccaagaagaggaggtcactccatctcccatggatcccctccaaccccactcattaccagacagggaacctgcaggttgggcccatcgcacagacccgctatcctgagctgattacactgagcgactgctgacctgcatctctctggggtagagtccccaggagacatgcaaaagacctttagccacaccactactaaggtctcttcctctgctatctccaagttagggaaggaacataaaccctgagatttccccagagctgcagtgggcagcccaagagtgccaagctgcgatctgcagccagaactcaagggggagaaaagcccacactttcagagcactgagagggaacaaggctgcaaaggagaggaaacatggggaagccacacaaccgagcaaggatctaccaactgacaaatacacctaagcaccacctactggatcatacctcaaagcctcagcaccaaaaatatcttgctaaaaaccccacttgctaaaagaagtcagcttcaaataaaaacgctgcagaaaacctcgaccctgtgagaacatttagaaaagacatctattgactgtacttaatctacactgcacttaaaggaacacccacatgcagagatgagaaaaaaccaatgcaaagcctctcgtaactcaagtggccagagtgtcatatgtcctacaagtcaccacaccagtactcctccaacaagagttcttaaccaggctgagctggctggtttttgtattgtccatgaaaacttccccaactttgctagagaggccaaaagtcaaattcaggaaatacagagaatctctgcaagattctacaccagaaggtcatccacaaaacacataatcatcagattttccaaggtcaaaatggaaaaaaagaatgttaaaggcagccagagaaaaaaggtaggtcacctacaaagggaatcccatgaggctaacagtagacctctcagctaaaaccttataagctaggacagattggaagcttatattaaatttttttttttttttgaaacggagtctcgttctgtcgcccacgctggagtgcagtggtgcagtctcggctcactgcaagttctgcctcccaggttcatgccattttcctgcctcagcctcccaagtagctgggattacaggcacccaccaccacgcccggctaatttctggtatttttagtagagatgggtttcaccgtgttagccaggatggtctcaatctcctgacctcgtgatccgcccgccttggcctcccaaagtgctgggattacaggcgtgagccaccgcacccggccatattcaacattcttaaagaaaaaaaaattcctcaccacagatttcatatctggcccaactaacttcctaagtaaaggagaaataagttccttttcaaataagcaaatgttgagtgagcaatggaacactaagtatagaaaggaaataccactaccagctaatagaaaaacacacttaaatacacagaccagtaacagtataaagcaaccacaaaaacaaaccagcataataaccagctaacaacacaatgacaggatcaaatccacacatatcaataccaaccttgaatgtaaactggctaaatgccccactttaaaggcacagagtgtcaagctggatgaaaaagcaagatcccatgaaatgctgtcttcaagagacccatctcacatgtaatgacacctataggctcaaaataaagaaatggaggaaaatcaaataggaaacagaaaaaagcagatattgctatcctaatttcagacaaaatagattttaaaccaacaaagatcaaaaaagacaaagaagggcattacatcatagtaaagggttcaattcaacaagaagacctaactatcccaaatatatacacacccaacacaggagtacccagatttataaagcaagttcttagagatctacaaagaaacacagactcccacataataatagcgggagacttcaacaccccactgacagtattagatcattgagggagaaaattaacaaggatattcagaacctgaactcaatattgtaccaaatcaatctgatagacctctacagaactctccacccaaaaacaacagaatatacattcttctcatcgtcatatggtgcataactctaaaatcgaccacataactggacataaaacaatccctggcaaatggaaaagaaccaaattcataccaaacacactctcaggccacagtgcaataaatgtagaagactaaaaaaattgctcaaaaccatgaaattacatggaaattatgcaacatgctcctgaatcacttttgggtaaataatgaaattaaggcagaaatgaagatgttctttgaaactaatgagaacaaagatacaatataccaggatatttgtgatacagctagggtagtgttaagaaagacattaatttctgcattaaatgcccacatcaaaaacttagaaagatctcaaattaacaatctaacatcacaactgaaagagaagcaagaacaaatcaaccataaagctagcagaaggcaagaaataaccaaaatcagagctgaactaaagaaaatcacgacatgaaaaactattcaaaagatcaatgagtccaggagtttgttttttgaaaacattagtaagacagacatgccactagctcgactaataaagatgaaaggagagaagatccaaatatacaaaatgagaaatgatgagggaggtgctaccaccgaccccacagaaataaaaataaccatcagaaactactatgaacacctctatgtatacaaactagaaatcctagaagagatggacaaatttgtggacacatacaccctcctaagaatgaaccagaaagaaattgattccctgaacagaacaataacaagctctgatattgaatcagcaataaacagtctaccaaccaataaaagcccaggaacagatggattcacagccaaattctaccagatatacaagtaagagctggtaccattcttactgaaacatctccagaaaactgaagagaagggactgcttctcaactcattccatgagactaacatcatcctgataccaaaacctcgcagacacacaacaaaaaaagagaaaattttaggccaatatcttcgatgaatatcaatggaaaaatcctaagcaaaatacttgcaaactgaatccagcagcacagcaaaagttaatccaccatgatcaagtaggcttcacatccaggatacaagcttggttcaacacaggcaaatcaataaatgtgattcatcacataaatagaactaaagacaaaaaccacaggattatctcaatagatgcagaaaagacttttggtaaaattcaacgtcttctatgttaaaaactctcaataaactaggtattgaaggaacatacctcaaaataataggagctatatatgaaaaacccacagccaacatcatactgaatgggcaacagctgaaaacattccccttgtaaaccagcacaagacaaggatgccctctctcactgttcttattaaacatgttattggatgtcctagccagagaaatcaggcaagggaaagaaacagagggcatccaaataggaaaagagggagtcaaactgtcgctgtttgaagatgacatgattctatacgtagaaaaccccataattttggccccaaagctccttcagctgataaacaacttcagcaaagtttcaggatacaaaatcaatatacaaaaatcactagcattcctatacactaacaacaaccaagcagaaagccaaatcaggaacacaatccaattcacaactgccacaaaaaggataaaatacctagaaatacggctaaccaaggtggtgaaatatttctagaatgaaaattacaaaatactactcaaagaaatcagaaaagacacaaacaaatggaaaaacatcccatgctcatggataggaagaatcaacatctttgaaatgtccatgctggccaaagcaacctacagattcaatgttattcttatcaaactaccaaagatactcttcatagaaaaaactattttaaaattcatatggaatcaaaaaaggggctcaaatagcccaggcaatcttaagcaaatagaacaaagctggaggcaccacatttcctggctataaactataccacagggctacagtaaccaaaagagtgtggtactggtacaaaaacaggcacatagaccaatggaacagaatagagaacccagaaataaagccacacacctatgaccatctgatcttccacaaagttgactaaaacaaacaatagggaaaagactttgtattcaataaatggtgctggaataactggctaaccatatgcagaagattgaagctggaccccttccttagactgtatataaaaatcaactcgagatggattaaagacttaaatgaacaactcgaaactatagaaatcttggaagacaacctaggcaataccatcctagacataggaacaggcaaagattgcatgacaaagacaccaaaacctattgcaaccaaagcaaacattgacaaattgaatctaatcaaacttaagagcttcttcacagcaaaaaagaaaagaaagaacaaaactatcaacagaataaacagataacctacagaatgggagaaaatatttgcaaactatgcatctgacaaaggtctaatatccattatctataagaaacttaaacaagtgtatataagagaaaaacaaccccattaaaaagtgggcaaaggacatgaatggacacttctcaaaagaagacatacatgcagccaacaggcatatgaaaaaagatcaatatcattgatcattagagaaatataatcaaaaccacaatgagataacatctcacaccagttagaatggctattactaaaaagtcaacaaataacagatgctggcaatgttgcaaagacaagggaacacttatacactattggtgggagtgtaaactagttcaaccgttgtggaaagcagtatggcgattcctcaaagagctaaaaacagaactagcatttccctcatcctcaaggagctaaaaccagaactaccattccacccagcaatcccattactgggaatcccattactggaggaatacaaatcattctaccataaagacacatgcatgtgaatgttcattacagcacaattcacgatagcaaagacatggaatcaacctaaatgcccaccaactacagactggataaagaaaatgtggtacacatacaccattaaatgctatacagccatcaaaaaggacaagatcatgtcttttaggggaacatgaatagagatggaggctatcattcttaggaaactaacacaagaacagaaaaccaaataccccatgttctcattcataagtgggagctaaatgatgagcactcatgaacaccaacaagggaataatagattctggggtgtaattgaaggtggagtgggggatgagggagaggaacagaagaaacaacaattgcctacttggcttaatatctgggtgatgaaataatctgtacaacaaacccccatgacataagtttacctatgcaacaaagcttcacatgtatccccccaacctaaaattaaagttaaaaaaaacttggtgtagcaatgtagtgtgatagttcatttatttattcaacaattatttatggagagtctaccatgttccatgacttgttctggccactgtcaatgaaacaaataaagaaaataaaatacaaaattgatgtcctcatggagcttaaattctagtggaaatagagtatgaacaataaacaaacatataagtaatttttaaagggatggtacataccatgaagaaaaaggaatcagttatggaaaatagatagttaaaatggagcatactactttatatagcatagccaaagaaggcctccttgaaacgcatttgagaataaatctgaatgacataattgggccaggtgcatgtgttgaggaagtatataagaggcagagagaagatcaagtgcaaggacaccaagtcagaccaagctcaggatatctgacttatgaccaggtggtgagcatatttgaggcaaagtctgtagctgaggaagagagctgtagcaaagatgatcattcaccacgataactgtgcctaaaccacaataagccttgcagaccatgtgaagtcagtggagggttctgagaaaggggagaacatgactttactaaggttttaatagaataatggctctggagttacacttggaagcttagctcccaaatgcaaaatagggataggcatgcctattctcctaagaatgttggaaaagttaaacgagatactccctagaaagttctcagcatgtaataagctttaccaatataagcagttactactgtggttgcaatggttagtcataataatttgcttccagggaacacaggagatataatctgaggtaccaaaagacaaaattagataggacagaaatttatcattatcttgaatctatttatcttaaatctcaagggaagaaacaaacataaagaaaaaagaaaataatggaaagtaaagatgcatcatgtttcttaaaattaacataatttccttggccaggtgtggtggctcacacgtgtaatcccagcactttgggagttcgaggtgggcggatcacaaggtcaggagttcgagaccagcctggccaatatggtgaaaccccatctctactaaaaatacaaaaaattagccaggcgtggtggcaagcacctgtagtcccagctacttgggaggctgaggcaggagaatcacttgaacccaggaggcagaggttgcaatgagccgagattgcaccactgcactccagcctgggcaacagagtgagaaaccagaaataaatgggtaatcccagctactcaggtactcaggaaggctgaggcaggagaattgtttgaacccgggaggcagaggttgttgtgagccaagattgcaccactgcactccagcctgggcaacaagagcaaaactcggtctcaaaaaaaaaaaaaaagaaaagataatttccttgatatttatattcctagaggatatttagcagggcatgttaataatagtggggcctatgtaatttgcatgttgggcttcaaggactgaaatactccatacttgaaaccaggtatcattttcacaaaacttcagaaaacactgtttgaggaaggtgaattggtggcatataatgttagagaacagactttctgataccatggcctacataaactcttcctaaaccattttggccctatgacttatttattacccctgccaaagtcacctactttaattttctacatacgttcctgctttttagatgcctatttttcaaactatatttctctaattctctcaaaaaataatatatcctccaattcacctcaattaggcagcattttcaattttcaatagctggctccaatttctaattacaccaataactccttcacctcgaggcctttgtaattctctcacttcagaacatttagtgtttatacgcctaccttacaagaaaagcgatcaggggtcacccttccaaaaagagtcagtgccagggcttgtcacagtaatgggctctgaagtcgccaatgcaggttttgccaatgacctgctgagtgaccttgggcaagctgcccaacctctctgggctgtgctttaaaaatgctgattgacctcacaaggttgctgggaggaattactactaatcaacctgattgtgaaacatttagtcaatatagagtactttataaatatttactaatatacaatgagctcactgcatctaagagccaggagatttgcataaccacagaaaactctgtctggaccccacaatagcagtcaacattgtgcctgaaatggttttttaaatcttatatattatcagcattctgggatgatttcggttttttatcctaagtgaggagaatgaactagatcagggaagctttagaagtcacttacaagtcaaagaaaacaatgatctagtccattaaagtggcataattatatgcagaaaacaaattattatgacattcataataaagtgtgtgtacaactgagcttatcactcaagaaaccaagtgaactaaggacaatatatgacagacactgttttggttactttggatacaatactcaataaaacaagcaaggatcctactcttcaagagcctgcattttagcataagagacaatcaatccaaccaatctgactgttgacattttcttgtttacatatgtactcagatgaaaacaaaactgtgttgcagtaaaaagtgacagtactttacatttgatgaccttggaaaacctctcctagcagatgacataagctgggaggcacatggctgtgcactggaaacagaacaaactacaagtgcaaatgcctttaagatgtattagaggaaccacaagacagtcatatgcttatagttcagacggtgatgactagaaagaggcaggcagttgctagatcacgtatggcctttattggagtacaggataagacatttggattttattatgtgtaaagtaagaaatcatatgagggatttcagcaaagacatatcatgaactgacaacatttttgtgttttttctgcttgttttgctttgtttttattttttaatgtattattttatttaaatagcttttggggtaaaagtgatttttggttgcatggatgaattatatagcggtgaattctgagattttagtgcacccatcacctgggtagtgtacatcgtacccaatacgtagttttttatcccacatcccccttccactctcctcctcctgagtctccagagtccattttatcactctgtatgtctttgcttactcatagctcagctcccacttctaagtgagaacaaacggtatttgattttccattcctgagttacttcacttagaataatggcttcaagctctattcaagttgccacaaaagatattgtttccttcctttttatggctgaatagtatcccaggatgtatatataccacgttttctttatccattcgttggtcagtgggcacttatgttggttccatgtctttgcaattgtgaattgagctgcaataaacatacatgttcaggtatcttgttcatataatgacttattttcccttgggtagatactcagtagtgggattgctggattgaatggtagatttactctcagttctttaaggaatctccatactgttttccatagaggttgtacaaatttacattcccaccagcagtgtataagcgttcccctttcaccatattcatactaacatctattgttttttgactttttaataatggccattgttgcaggagtaaggtgttatcttaccatggctgtaatttgcatttccctggtgatattgagcattttttcatgtttattagctatttgtatatcttcttttgagaaatgtctgttcatgtcatttgcccactttttgatggtattatttctgacaacatttttgagggataattttggctgctgaataaaatacagagtgacagaagtagaaaaagtagggaggccagttaagtgacactgatggcttggactagggacttatgctaggagtcatttctgggctttattttttcagttaggagtataggctatgatcagttatcatttgcctcaaaatatagtcatttataattattttgatttataaatcaaaataatttctatttattatttatattttctagttatgacttttaatatttcttcaatttaagctcttcttcagcataattctgattcagtgcctgaaccttccttttcacttagaaccaggcaattgctgaagcattctggttaaagatacactgtaaggaatgcagcttctctgacattgagggcgcggtttttataatcaacatgaataattcagcagtgcattatttgtgctttattattgtttgcttcaacttgaactgtagttagaagttatgaactttttttttaatcagcagaagctcatccatcactctgcatcccttgcatctaccaggttataaaattcactatttatagcaacaattgcgatgtgaaatgagaatcagtattttgttcctctgatacctaaccttaggtcaagcacaggatctagagatggatttttacaggaagtgaaatgaaagcacactgctggagattaatgccagtctggttgctctagggaatgccctctctggctgcttcccagaagaaaaatggtaagtaatgtggattgtatgtcaaatctacacagtgggtggcagtggaatgacggacaggatgcccaagtggtctggcatcagagtccatgagcctaattttctcaaaatgagtgatgatctcctaaaatcctgttcagagattgcttgggaaagaagtctccaggactcattacttaattcgttcagtcttcagctctttattatatcatttatgttgttagctctgctctaaacttctttcccatgtcacaatataacttctcgtgtctcttgcaaatactaccaacatgaatagccactttaatcagtccttctcttctgataactgaagagggggcattttcatgtcattaagaggttttttcagagtaagcttctggaggacaaagactgtgcctgtactgtttcctttgtaaagtgcctagcataaagtctttactaattagacatttacctaatgattctgataattatgaagctaatgagaatcactggttatttttatacctctgaaaacatttcaactcttttgtgctttaatgtctgaaaatctttagggagaacttttcttttgccacagcttgatttttctacaaattatgaacaatacaaaatcttctcaaaaattcagggatcaaactcaggctggttaatgggctgtaagagaaaaatgctagcatcagtctacttttgaacaagtagaactctattcaaagaataaagtgggaatgggcacactagctcatgcctgtattcctagcagtttgggaggtcgagcagggaggattgcttgaggctaggagtttcagaccagcctgcacaacatagaaagaccctgtttctacaaaaaaaaaaattagttgtgcatggtggtgcaatgcctgtagttccagtttctcagtgagttatgattgtgtcactgcactccaatcagggtgacagaccgagtccatctcaaaacagaacaaaacaaaaaactgaatataggcccagcaaaaacatgggtaatgtttggtgacaggtgggaaataaaataaatatttgacctacgtatctaggatttgtgggattcgaattctagattagaatctgggaatatgccggtcctgacagaatccagtccctcggggaagccacactcagtgtacagcttcagtgaggaattactcctacagatgaatcacctttgaaatgcagaaccgtattctggttctgtggtgcagagaagagaggcaatgggaggagacatgccacaaaaaagcaggcagattcttccataatacctggcagggtattcttacagacatagtgtcccacttttcagagggtggaaacaactctcagagtagtaaggagggttccaaatgtcagtttgtctgactccaaagtccttagtcataatctctacccgatactatctctctaacatactatccaagagtgaattgaatattgctggtttctctactcctactcctagtctatgaatgtccccatggtataaatggccaggtcataccatacatgacttcaggtctctgtttctggcaaggtagtaaatttttatgagcggaccaagagcagacagggctttttttttttttttaagtccagatactacaaaattccctcaccttgccactgtttctcagctggggtaccactgtcttctgggggactccttgtgggaggttataaacttgtcacaataattcgggatatacatactgcagggggcctgggaatatgctatgttctgaatgtttgtgttcaccctaaaattcatatgttgaaacctaattaccaatacaatggtattaggagctggagaccttggggcggtgattaggttataagggcagagacctcattactgggattaacacccttattaaggggctgccttgcccctttctgccatgtgaggatatcatctatgaaccccataaagagcctttgccagacaccaaatctgccagtgccttgatcttaaacttcccagcctccaaaactgagaaaaaaatttgttttttataaactacctagtatatatatatatatatatatatatatattttatagcagcctgaatggactaagacaggaagttgatgtcatcacacaaaatttttatatgtccctctgggtttttgtgtaattttgtgtaaaatttatatgtaattttacatataaaaatttctaggttttttgcattttttacatatactaatgtttacagaatgtgactcccatgtaagtgaggaaatactgtattcttttttaaaaaatttccctgggcgcaatgactcgtacctgtaatcccagcactttgggaagctgaggctggcgaatcatgaggtcaggagattgagaccatcctggctaacacggtgaaacaccgtctctactaaaaatacaaaaaaaaagtagccggacatggtggtgggcgcctgtagtcccagctactcggggggctgaggcaggagaatggcgtgaacccgggaggcagagcttgcagtgagccaagatggcaccactgcactccagcctgggcgacagagtgagactccatcaaaaaaaaaaaaaaaattcattgataacttaccaagagtgagcaatggtgagcatgccgtttaagaaagtcacataactgatgaccacactgctcacggaacttgccaaccctactcacttgtatcagtcttcacagctcttctgacaactttattacttttggcagtgtaatgtctaaacactcacatactaaaatacatttttaatccattcagttattatatattacactctttttatctctacattgtattacagttaggggattatttagttatttttaaccacatgtgtaggtgagtgtaagtaggcagaattttccctcctcctctcctaaagatgttcttccctaatgaataggttagatgacatgacaaaagggactttgtagatgtaagtgtggttactgatcagttgtccttaaaatcaggagattatcctggattatccaggccgacctgatataatctcatgtgctcctaaaggcagaagaaaaagagagatttaaagtgtgagaaggacagcccctgccattgctgaagatggagagggccaagtgaggagagctgtgggtggtgtgaaggagcagagaacaagccttagctgtcagccagcaaaggcacagtgaactcagacctacagccttaggacctggatgtgccaataacctgaatcagcacagaagagaatgcctccccagagcccccagatgggagtccagccagctgataccttaacatcagccttgtgaaaccctaagcagtgagcaagctgagctcatctggacttctgatctacagaattgtgtgaggtaatatatggatacacttttaagatgctaaatttatggtaatttgttaggaagcaatagaaagctaatgtagtttcatgtgagatattagttctgctaaagctaataacgacagcacaaggtggttggtggctaaggtgcctggaacgcaaagtgttcacagtatcattatttggaacctgggacaggtattgatcaggcttcaataatagttccaaatgaagtctttaggtatgagagttccatttgacttgttgaataagcatgctctgtccttcctgatagtcaaaggtacaaaaagaattgttgcacttcagtcttattacatttaaagatactatgaaataaagactagctttggtgctaaaaaactataaaatcatcttttttgtgttaaaagaaaaaatacctatgaacatatttaggaaaacaaaatttttcagttgaagagttcctaaatatgtcactgaagggcattaaagggccaattttctaaaggagagtctgtctggcatttatgaagtggggagaaggatacagtctgttaaagattcagattcatgggtttctttcccaaagcttctaaaccaacaggtcttggaagtgctcagaaatctatagtctaataagcttcctagaattagtacaatctactttgagaaaaggtttaggtaagggaattatatgaagagtgtttgaaactccagaggataaacaaataggctaaaaataacctaacaaacaatgaagtagaagagaaatggaagaagagtatcagtataactctttgtgcaaactcagctactaccctaagaaacaagcagtaggccatttcgaaagcagaataagccgggcacggtggctcacgcctgtaatcccagcactttgggaggccgaggcgggcggatcacaaggtcaggagatggagaccatcctggctaacatggtgaaaccccatctctactaaaaatacaaaaaaaattagctgggtgtggtggcaggcgcctgtagtcccagctacttgggagaatggcgtgaacccaggaggtggagctttcagtgagctgagatcacgtcactacactccagcctgggcaacagagcaagactctgtctcaaaaaaaaaaaaaaaaaaaaaagaagcagaataaatctcctcaaaggacatgacaaagagcaatgactttagaacagagaggttatgcggtccagtaaaatgactttgggctttagggacagctagaccttcattaacatccttactgattcactcacaaagtcactacaggaattttctccatctttttaagttttagtgtcttcctctgcaaaataggaacagcagtgcctaatccttaagtaagtgttgaagattaaaataactatcgtcattttggcaaactgtagctatttaataaatacctattcttttgtctgctctctgttagaaacaaaagctccaaaggtgacaaatatattccaaattgactaatcccactcctggtctttaaccttttcagagaaaaaagcttgcatcccattattttttaaaggccagaaaaggaaattcattaacatctcttagtcatttgttccagtaacatcatttataccagaaatgccttcttcaaatcccacctaataaaactggaacctattatctatctacaacatgtactcatgaagtagagaagaaattaaaatgagacagctaatgtcactagagaccaacgggcttaacagcaagagctaagaagattcaaatttgttgccaccttactaagccaccatttttagaatagatttcttacccgatatcctatttatcccctgtgaattggtaataattatggtaacaatccccctttgatatgcttgtattcattcaaccaacatgtactgaacattctattgtatgccataggccctgcaaaatactgtgggcacagaaatgaatagaagttggttggttgctccctaggatctctgagggcaagcttggctaaagtgaaatctaagttactacctctttcagatgctccacggaggcaataaatacctaagttctctgtgtctggatttagtacagttgcttctgagttattatttgtcattcccagcttcacccaagatacctggagaatgaactgcaattcccctggttccaccattatgctgtgaatctgagcatactattgggaatatggtctaccagaggtatccaatcttttgacttccctaggccatattggacgaagaagaattgtcttgggccacacataaaatacactaacattaatgatagctgatgagcttaaaaaaaaaaaatcaccaaaaaagtctcataatgttttaagaaagtttatagatttgtgttgggatgcattcaaagccattctggactgtgagttgggcaagcttggtctaggtcaacatttggcaaacttttttctgtaaaggttcgggcactacatattcttggctttgtgggtcatagagtctcatttgcaatttttcaactctcccattagagcatggacaatatgtaaacagataggtgcagctgtgttccaataaaactttatttataatcaggtggtaggcagaatttggctgttgttgaccctagtctagatactttaggctaaaattcctagttgctgactttttagctttttaacctgagattacacacgcacactcacactcacacacacacatacacacacaatctatttgtgtggaggcggggacaaaaacacaaaaacaaaaccaaaacagtggttttccttacaaagggattcactagagaattttaataagaatgagattaaccatgaattacattggatggagacgcagcacaggcttggatttggggctctgcacttgacaacctcctgatgattgttgaggtggaacactgaatgactccatttcaaaaacaaacacaaaaccccagcaaaactttcatagaatcaggttccattctgatcacactgaatgaccatccccacatacacattatataacatttcgactacaaaagccgtatgattgcagaaatgattgttgaaagacctagaagaggttctacagaaggtgtcccagcatctttggagatatccatccagtatgttttcctcaccatttgtagaaagccactggcatttcagagtcagatggttttcaatttgatttgattttagaagacccacttgtagccgacctgagatacacgtatgaccaacataagcatgttataggccttcaaagtgcttctgaatgacgggtgaggtttataagtttagcatatgttgtcaggaatgttaataaaatcttcatagattttttcttttacccttcgatcttgcagattctacgccatgctcaaagactgaatgggggccataggagctaaagtgcaacatcatttaaaaatataattagcaaatgtatttttttttttttttgagacggagtcttgctctatcacccaggctggagtgcagtggcacgatctcggctcactgcaagctccgcctcctgagttcacgctattctcccgcctcagcctcccgcatagctgagactacaggtgcctgccacctggctaattttattgttgtatttttagtagagacggggtttcaccatgttagccaggatggtctcgatctcctgacctcgtgatccacccgcctcagcctcccagagtggtaggattacaggcgtgagccaccacgcccggccttcaaatctattaaccaatggtcttggttgtatatctattgccagctctactcatttctttgacttaagcttctctgactcaccagggaaaagaaaacgatgatgtttctgatcttgcacaggtaagttgacctttcatacagtgtcacagcaggaagaacctggcttgttcactatttttatatgttggcatctgcagtccggtacagtcttgctcaaaattcataatacacccatagctagagttctgagccaatagattgttattttttttgctgagaacataagtcatttctcaagccttaatatatatctacaaccttgcttcctctccctaattctgtaaactacttagcatctgggaaagctgtaaaaacttactctgtcttctcttatttcctcttttcctctctccttctttctttctctcattgtaactatattcatggcactcccgcaatgttctgtgagaactaaggctcttggattccactgatatgaaaatttaagcattaaattcctttttacaagattttgaatagtctagccacagcctattgtggaaaaaacaacttcctctcaaatagagtgctgagataacgtaagattatctaagctataaccacctttctctggaagcatcaaagattgtcttttgtcttatattctgggaaagctttcccactcagcaaatgaggcaccttaaccttcacattctattttttttttcttttaaatttatggacaccatttagggagatttcaattcccattaataatatgtgcaattgatctacatttaagagaatttaatcatgtcttggtgacaaatttagcttaaagcagagcttcacttaggacttccaagtaaatttccattgaaaaggtcaatttctaacatttgtcagttaaagcccataccagacaaattaaattctcctccacttgtctgctgcgtgaacactttcaatgctgaatatcaccagcggttgtcaattaggaaaactgccaccctgcccaaaaaaaatcataattgagaagtttttaaaagaagacttgaatgtttatccaatagttagaattttttttcatactaaaaagtgatctatctcatagtggcaatgaaaaaacaaaataaaacactgtcttactggattttgagtaaaatcaattcaatggtataagtatgtgaacatctattactaggaaagaagtcagggcagggcctaaacttttactgaagcttgagtttcactgggatacaaaagcacctgagcaattagaaattaacatgtaatcatcaaggataaagactgataaaatcatggatcccttgttatactgaagacagtgtgtgattttggatagtagaaaatctatgttgtttagaatttctgtggaaggctttacaaaacaagaaggatattgtaaatagccaatttagacagataaatagaggctaagtgctacaataatcatataattttttcttcttgcttctctgtattttctaattttcaactgtatgtatgattttttttagaaatataataaagtttttaaggagaaaattggggggggggaacttgaagaaaggggaaagaaaaaattagttttcaatttcctctagtcagcctcagatcaaatagaactggatgttctggtttctctcctttttggatctcaattattgaatgcttcataatttagtctgaagaaaagaattcatggccaaacatctaaaaatgatttttgcccatgaggtcagcagcaaaggaaagagatttggcaggtcttacaagaactcttctttcattgttgcaggaaacgtgaacaactaacagggctatctggaggacagtgaaggaacaggcagcctcagaataggggaagcaaggatgctcaatgtatgatttacatgcgtatcttctaatatagtgtaagaaaaggtaatggtagccatgtgatattgtttggctgtgtccccccccaaatctcatcttgaattgtagctcctataattcccatgtcttatgggagggaccaggtggaagataattaaatcacgggaatggtttcccccatactgctctcatggtagtgaataagtctcacgagaactgatggctttataaggggaaatgccttttgcttggctctcattccctttttgcctgtcaccacataagacgtgcctttcaccttcccccatgattgtgaggcccctctagccatgtgcaactgtgagtccattaaacctctttcttggccaggtgcagtggctcactcctgtaatcccagcactttgggaggccaaggtgagcggatcacctgaggtcaggagttccagaccagcctggccaacatggtgaaaccccatttctactaaaagtacaaaaattagcctggcatggtagcaggcacctgtaatcccagctactcaggaggctgaggcaggagaagcacttgaacccaggaggtggaggctgctgtgagccaagatcacaccactgcactacagcctgggtgacaagagtgagactctgtttcaaaacaacaacaacaacaacaacaaaacccaaaaccctctttctctgtattgattacccagtctcaagtatgtgtttatcagcaacataaaaatggactaatacaccatggtggattattttctacattattttcctggatttcttccagaaattagtaattcttagtaattcttagaatcaaacatcacacacacacacactctctgttatcttgggttgagtgacaacactaactaagctgtcccaagattatagaggaggctgtcttttccaagtaccctgtgattactatcgatctgttcagctcattgcaactcaaccttaccaggctggtcaggaaagaaggaagaaggatggatgttattaaagatcctgaatacctactctgcaggtatcattcattagaagtaaactaaatgtaccaacattcacacatacagaaaagctatgcagcagatccattctctttctagaatccagaccctataatgccataaagctcagacagatttaagtggaagtttctactgtgaaagtgtaacatggaagttcaaatgtattagacgatacaaataactgagcaaaggaaaggctagagtagttgtcttcagcaaccagcagttatttattaagctatcatgtgcccaggactatgccaggcactaagcagagaatgtttagaaaaagaagaccagggacctagagactgtgaccttgaaaatataatggtcttcataaatgagagttgatggcttctgaaacagagtagaaatatcaattacaacaagtcttaccaacagattcataaacaccaacagagtaccagtgaaagcacacatcagtcacatgagacagtattaatgtattatcactaattaatattaatatattgtttaacaactggccataattgtgctttttcaatacatgtaataacattcaacaaattgttaaaactaagcaactgttgatacattaaaatgaaaatgacatttaaaatatgttaatgaatattattttgaaacaatatcactatttgaacttagcaataattcacatctttacagtattttgggttaaaaaatagaaatcaagatggcaaaatcatgcctgacattcagtaattttagatggattagagagttatcagaaaatgaaaaatgttattactttggtatagagactataagttcaaatataacctcaggaggctgaggcaggagaatcacttgaacccaggaggcagaggttgcagtgagcggagatcacgccactctactccagcctacacgatggagcaagactccatctcaaaaataaataaataaatataacctcctaataaaaaagcatatataaagtgcttagaaaatagcctttcaataagtggtaattattagcagtaagacaaataattagcttaaaacatactcctgcactgacagttacagaatcactcttaaaaggatctagtattgaagactttggaaatttgctttcttaagctacattctgtaatgtttacatgactattattttttcattacaaatacattgttttctaacctgtgggcaacttattgatatacacagtattctgtattctttctgttgcatacagatacactctaactgaagatggagtgactacgtagacaaagctgcaaactgcatgctcacctgaacaggttactcttccctctatcattgacttattatgtaacatgaagcaaattccaaattcccaactccttgggccttagtcttgccaactataaatggcgacagtactggctcctctctgcaatccatggtgtcatacggataagtgaaatagaatctgagaacgttctttgggtttttatagaaaaatatggaacacaaactattcttccattcttcagaagctgatttgaggtaatagtttatagaataaatggaaaagaaaaaaaagtaaaatactattggcccaatacagaagttaagtctcaggccttctaacttcatagtctccttataagatcaaactgactgaggctgctcaacaattggaaggtatttggtgctggtgcctgtacattaaggaggttcgtgcctttaacatttttttcatgatagaaacagcactggaaaagaagaaaatatcaagactatcatcaaaataagcaaaagaaccaagacggccctatttaccataaaagtagggtcagtatttagctaagtacctggaaaccatagatgaccaataaatatttcttgaatgaaagttttctatcctggttttactagtgggaaatcaattagccttggttacattacataaaatgagggtagtaataacgtgccttgttggcttcacaggtttctattccgtgaccaatttaagtgtcacttcgataaccatctcaaatggaaataacctactctccaactggaatgaatatcctatttgcatgtcaaaagataaatataaccaacagtgcaaagcatgaaatggtatcttatatcctcagattgtaagctggtaagagtaggagaatctatgtcctagaccttgctccaaacattgtgccagccactgcaggaatggaacggagtttacgctggataaactaattaaccacagatgtgaaagcatctgtaaaatttgaaagtatttaaaatcacaaggtgcggttttagaaaggtttatgtgacacaaaaaactactgggaataaagatgtgaaaaacatcaaggtcattccaataaacgctttttttcaataggaggtaaaattttttgtagaaagaatacttgtctttactcaaaagtattcagaaattagaaacaattttctacaggttcacagaaatacggggaaaggcaagttgttactttttgagatactaggttaagcatcctcttctctggttccccaggcagccaaaagcttggcagaaagctcaatctccttgcctcaagacacttagtgccgtaatggacatacaacctagccaatgcccctgccaactctcttttcagcacagcaccaaggaaccaagaaaaacagacagcaattgtagggccttaccaccccaaatgtgctccactgaccagcaacaatggcgtcacctgggagctcattagaagtatagactctcacaccatacaccatccataacaaaagagagccccaggtaatttgtgtgtctattaaggtataaaaagcacttcccggccaggcacggtggctcatgcctgtaatcccagcactttgggaggccgaggtgggcagatcacaaggtcaggagatcaagagcaacctggctgacacaggtgaaaccccgtctctactaaacatacaaaaaaattagccgggcacagtggctcacacctgtaatcccagcactttgggaggccaaggcaggcagatcaccaggtcaggagatcaagaccatccttgctaacacggtaaaaccctgtctctactaaaagtacaaataaattggtcgggcggtagtcccagctactcgggaggctgaggcagcagaatagcgtgaacccgggaggcggagcttgcagtgagccgagatcgcgccactgtactccagcctgggtgacagagtgagactacgtctcaaataaaaaaaaaaaaaaaaaaaaaaagcacttccctagacctagcttgatattaggacaccctgctcttctgatgactttacactactatttctcaattacactactatttctcaaagtgcagcaggcaatggaacaacctaagggtaaattatctggggtttttgtaaaaatacagacttctgggttctaccacaaacatagtaaagttaccgggatggcaagcagaagtctgcattttaaataatcactcaaagtgattctgatgcacaattaattttatgcactattcttccttgttgactgaaaacccttggctatttccctcccatttccctttctcactgggaactctgacatttcaggttgtctttctctccctctccccactcaccatttacaaagattgaacctttttttctatctctaaataatctagggattgttttcctctaataaaatggctacactcttgattaaggaatgtgataagactgccatcaattaccttaattgatctgacaacctgattatacctagaaaggggaaaatttcctcagtggagccttattaaaaaggagaaaaaaaaacaaaggtctatataattaaaatgtgatcgctagcgatgagtatgtaaaatcagccctgagaggcattagtgatgggaaaacttttctaaatgacatcttaggaagacaaaggaacagaaactggtcaaataaatcagtgggctactaggggagaatgctgaatagaaacacaagggactcgtctcaattcttaagttaccagaagttttgaaattaacaaatccactcgtggcttacgatgtagagagccctaacattggccctgtttgtacctctatgaaccaaagtggaatgtcagttactggcaccatttgtggttttacatttatatacatacatttttttttttttaactgggaaatcatgctaaaagtaaaagcttgagaccacatctcaataggaattgaataaataatcctatgaagcagagttcagagcatcgattctactttatagtaaccatgacagctccagcaaaaagagcagcaaacaacatgtgttcctgattcaaggataattcctctagtagtatttatgatacattttcttctctgactcactcttagtggaacatatcttctgaatttatcccctacttgagtaacccccaggccttcaggaacagtaaagcaacatggttcccgtattactttacataacaaaaatatctaggtcctaagagtgctaagaaacagaatattattaattaggatgaactgtcacactggagtacttgatgaaattaatcaagctgatgattggtctggaggggataggaagctgtttttatagtgcacctgtaaattgtgctaataaccggtggccccttagaaatctgaagaaaaagtatttttagatgaacaacaagttagcaaaaagttgatagagtgatcagaatcaatgaaaataccccttgtacagtgagtattgagtaggtatcaaatatatgaatgaatggacagatttgagtttcctgttctcttgacctatgtcaagacaacaaagtaatcagaagtttcaatgggaattctttttttttttttgagaaaagaccttgctctgttgccctggctgaagtgcagtggcatcaccatagctcactataacctcgaattcctgggctcaagtgatcctcccactttggccttccaagtcactgagattacaggcatgaaccacggcaccctgccagggatcttctttaaactgagtataatgatcctctttgacaattacacagaataaagattaaaaaagaccaaaaggaatcagcatcaaagaagatttttgtcttaatttagggcttcaactaaaccaatccatttttagtttgataaagacatacaggagaattaacaggctgtagttttgacaatctactcccatgcctaaatcacttaagaaatgtactgttctttcatttcgtgtgagggtccagggctggggagcaggaggtaaaccattccttcttctaccacagcgttctcaattgggtaagcatcaaaattgccttaattctgaccaattcactccaaatgtaacattctatgccagactacatttgcacgtgaccctaaatatgcttcacacaaagccttctccatgtctcagagcaaaggttcctggcattttataacctacatgagtttgctactaggctgatctgcagatgtgaaattgaatgaaatggaccgagatttcccttgaagccaaatcaaatgggaacacgtgtcaacaagtcaccaacactctttggtgaccctagagttaaacaacggttcaaataggattgcaactgcaatccacttgtcttattcgtaaacaaccttttattctaagtcacctggagtttgacttagtttaaacagatgtggttatttacctacttcaaatagtctctggacaatgccttccatcacagcatattaactggaaagctcagcgactgtgtaatttttatgctccacagaacacctagcacatttcactcttctgggtaggcacttaccaaacttttttcacagttcaaagctttaaatttgaataacaaagttgtacatacatatatgttgggactttatcaagacccatgatttatccacccatttattcattcatttatacattcattctacttatttcacaatttttcatgaagtcttctttaggcaagatgtaaatataaatgaggatagttcaaccctgccagagttcatagtgtgtagtattactggccaaataaagaagtcaagtctccagccctctaacttctacatgtctccagataaattaaactccatttaccaaaataggttatctaagaactgcacatttcaaatgaaaaattttaactgtattttttatagtgtctaaaactcactcaataaaatcacagaaaaaaaagaggcatttggaaagcccttttttttttttttttgagatagagttttgctttttttgcccagactggagtgcaatggcatgatctcaagtcactgccacctccgcctcccaggttcaagctattctcctgcctcagcctcccgagtagctggggttacatgtgcccgccaccacgcccagctagttttttgtattttttttttttagtagagacagggtttcaccatgttggccaggctggtctcgaactcctgacctcaggtgatccacccgcctcagcctcccaaagtgctgggaatacaggcgtgagccaccgtggccagccttgaaaacttttatcaattgccattcccctatcatcacccaagcatagggcttttggtcaccttcaataaataccttcaaaaataataatggatgaagccaacaaaaggaatgagaaacatttgttttgatctaaaacatttagtttagctcagattttataacaacacatacatttaactatatttattttttattcttttttccttattagcctataagctctctgagggcaggggctatgtacttctcataattcatgtattatctgcacctagcacaatgcctggcatatattacatgcaataattatgaaataaataagttaatgatgaaataaatcaatgcggtataattttacacaccgaaaattataaacatctctaaacagctttcaaattaaaacatgatgttgccacatgttgcatgcaaaaattattagaaggttactgcagatcatttcagtgcatgaggaaaggtaatttcttttttcttttgtagaagattcacaggaaaaaaatgcaagtggaaaaaaataggagaaagagtggagttcagctcaaatgacaaactaaacatttttattcaatacttcatagccttcaaaaatggataattatccctccagctcttcgggccagcagcatgaggttgaatacatcatcagttctgatattaaaacatgagtttgcaagtaaacaggaagtttatcttataaaatggaagctttttatttgcacagaagtttttcattaataacagagatggactttcaactacttactacagctgtggctctctccctgacatatggagcttcttaaaagaaaaaaaatacaaattaggagaatttttcagcaaattcaattccttttctctcccagaggggtgggtggaagcagcaggtggcaaattcgtttttatctaataacatttgatcatgtgacatattttatttccacagttgatgtaacttaatgaacagcaaattgggaaaatccgtcagcatgtaggaagttagtggggcatgtgtgcatgtgtgtgtgtgtgtgcgcgcgcgcacgtgtgcgtgtgtgtgtgtgtgtgtgtgtgtgtgtgtgtgtgtgtagggagaatagaaaggcctctgtggtgcagataaggggaaaaggttgctgttacatgttctgggtagaaaacttttttttctttttttaaagacattagttccaatccatgttgacagcagtctaaaggaattataagggctaaacagaccatctttattaaatgagatctggtgatctcaggcaggtcctaaaagaagtagatatacaaaaataaaccccaaggctgacagcagaaatgctggagacctccatggtagagttataagtgctgtgtggaataaactcgcatagccaatgaaggaagatgaggaactgaggaagccatcaatctgacagtttccactaagaaaagcagttgctcatgagtttcaaacaaggttatacttagttttaggtacatgtagtaccagaaaaacaggctttctaagctggtaaaataaaaaaaagacttgttattttatcacattgctgacattgccaaggatcctaaattctagaagaaagccaggagttctggctagttcagaaacagtgtaatcttgagtaaacagttttgtcacaagccttggctttctcaactgacggaatggggataatgagagtaaacacattatttggcatttgagaggattacatgagtatttttttgtaagtaccccaacatattagcttttttcatgattgatataaaccagatgtcaactgggagaattcctgatgaagaaaaccaggtaaatttggcctagtcaagctttcatactgtactcaccctacttcatctgtcagatgagtgctaagacctcacagttagatgatttcctgctcaccttcctcaagtccgttttgtgctttctctgtcccttccctttgtagcaggggttttgaaacatctggaattcctaggaaatgatatgaaacagctgtgctagaggtcctcacttaccttagaccctcattaattctatgcatgacctgtgatttttaggttttgtttaaaaggtaaaaataaattggagatgaccaggtgtggtgactcatgcctgtaatcccagcactttgggaggcttaggtgggcagatcacctgaggtcaggagttcaagaccagcctgacaaacatggtaaaacctggtctctactaaacatacaaaaattagccgggcatggtggcgtgcacctgcagtcctagctacttgggaggctgaggcaggtgaatcgcttgaacccaggaggaagaggttgcagtgagctaagattgtgctaccgcactccagcctgggagacacagtaagactctgtctcaaaaatactactactaataataaaataaattggagaggatgtggagaaactggaacacttgcataatgttggtgagactacaaaacggtacaaccactatggaaaatggtatggaggttccttaaaaaattaaaaatagaattgccatttgatccagtaatcccactcttaggtgtatgtccaaacagagtctcaaagggatatttgcatgcccacgtttatagcaacaatagccaacaatagccaacaatagcaactcaactactcactgatgaatggacaaaatgttatcatacatatacatatatgtgtacacaaacatatatatatgtgtgtgtgtgtatatatatatatgcctacatacatataatatttagccttacaaaggaagaaaattctgaaacatgttagaacatagatggaacttggcgacattatgctaagtgaaataagccagttacacaaacacaaacactgtatgattctacttacatgaggtatctaaagtagtcaaattcatagaaatgaaaagtagaggccgggtgcagtggctcatgcctgtattcctagcactttgggaggccaaggcgggtggatcacctgaagtcaggagtttgagaccagcctgaccaacatggtgaaacctcatctctactaaaaatatagaaagtagctcagtgtggtggcagatgcctgtgatcctagctactcaggaggctgaggcacgagaattgcttgaacccaggagacaggggttgcagtgagccaagattgcgccactgcactccagcctgggtgacagagtgagactttgtctcaaaaaaaaaaaaaaaaaaagaaatgaaaagtagaatagtggctcctagggattaggggtaggggagaaaagacagttacttaatggatacagagtttgaaatttacaagatgaaaatttttttaagatctgcttcaaaacaatgtgaatatatgtaacactagtgaattgtacagttagaaatggataagatggaattaagatggttaattttaggttatatgttttttacattgttttacaaaacagattaaaatgaactttgacacactagatccactctccctggaaactttccccaactaaagcaccaacccataacatattacaaatattaacactttatataactgaagctcagtgttagagttcacagggagagatgaaatgactcaaggtcacaggttcagatgttctgacacattactcactccatttccataatctatgcaccaaatactgtttttttttttttttttttgagatggagtcttgctctgtctcccaggctggagtgcagtggtgcaatctcggctcactgcaagctccacctcccgggttcacgccattctcctgcctcagcctcccgagtagctgggactacaggcgcctgccaccgcgcccggctaatttttttgtatttttttagtagagacggggtttcactgtggtcttgatctcctgacctcgtgatccgcccacctcggcctcccaaagtgctgggattacaggcatgagccacctcgcctggcctgttttgtttgttttttaaaggcagggtcttgctctgttgcccaggctggagtgcagtggtgtcatcacagttctctagactcaagcaatcctcctgcctcaacctcccaaagtgctgtgattacaggcataagccaccatacctggcccccaaaactgtttatgtgcattggtccagaaatgacaaaggtttttagaatttattgtccatgatcaatttgctgttgccttttaggatcctctatctttcagcttatccttaatgtgtgtcctacattaaaaaaaagatataccttttctattcacttctccttggcctgacatcttaatattttacaatcccatcataaaaacatcagcttttgtggttgggtttttccaacacctccataccatttccacactggaaattcacctctgggtatctgtgtgtgtacatgtatgtgtgcttgtgtatgtgactcaaaagccattattccttcccaacactcaaatttcctttcaggaaattaacctctctatcactaaaaaaaaaaatgtcatgaataggggccagaactaaaggggccaaaatccttgtccttccactatgcagagccacagagtgagactgtaaccaacgcttagtcaatggtacacgtgagctcaggactttgaactttgagaaacataagaatggaacaaacattcggtgtctaggcatttgctaaacagcatcctgacttgttaaggttcctatttttcagtcctctggtgcagccttggccactggccattccttcgctgggacccatggcgattctgtaaacatcagttatcctgcagataaattccccttcagtgaaaacagccagagtggattgttgttgctttcaactggaaaacattgcctgacgatgtttatttccacagctctttcaaaagagcaatgccgtggttgtaatctcaagctcttagggcaatgtgaaatccccttattctcctggttctatatggaaaggttttgaaactgtctccatgtttctaattccagtcttgtcattttgctcttcagatttctttaaacccatgctgatcagatactgttctgcccaatgatgtcctaaaaacatctattaaaataaacccacttacagcagagcctgctaatcaccctcccacctaattagatgtctgacagccaacatcggcaggactgctgtccttctgctgggctttctatgcaggagttttacaggtacattaggaaccagttaaccacctgtgtcataatcttcttcctctgtttactcacgaaaagagaaccatttcaaccattccgaaatgagcatggcactggaaacctcccagcatcaaacaaatggccactgtcactgatcaaaagataatttttgcgtagggggtcaggggtagctgtcagggtgcaaatctaggatacgctgctgagaagatgtaggtggtgtggctgacagcagctggagccagacttgtgggggagtggaagacacagggctgccagcctgattatatcattctccttattccctcttgggttttccttattttttcccaaagaaatagctcctaattgtaatgatcaattctgatggttctttttccattccaagccattcattgttgcctttatctttattatctccttttcccacaaacccaaaggcccatttatttatattctgtccccagctcctaagtaaaggaactcactgcctggtcttgacttctttggtcagaatagtgctgggttttggcctaatttctttctctagtttatagattaattgattttagatttacatggtccttagtggtttaccaggtggattcttactccataaatcattcatttctcaaaataatctttccaggtagtgaaggacccattccaaagtcctaccagtagaacgtggtagtgctgagaacacagaaccaagccatatttttttctgtaatagttataagccaaccctattctaacacatttgctcttcctgtcagtcacatgaacccaagtggcagccatgaagttccctctctgaattcctcactaagccctggggatttaacaatatgggtttggcaagaaaagtaaaacattctctatgtagactgagaactaaactaggcattaataggagaagagtaagggaaggaatggtggatcctaaagaaagataaataagcaacatcctgccctattacatgtcccagtcctctcccctcaaaagcgtccaactctctctccagcaccccatgtggataagctgcgggactatgaagtcagttgtctagtctgaagttctaaaaatcatccagggctgcgccatctcacttacttccttttcattccacctgtttactattacttaaatccatcctgccaccagggctttttttttttttttttttttgtccaaaatttttacagtagcctctgaactggtctctatgcttccagggctgcatttccacaaagtatcttccaaatgtccctcgaagatctttctgtgtagagtcttttaatgactcccaagggctttcaagatagattcaaaatcccttaacttccttcataagttcctggcaccagcatggatctttagattcaacaattaccacttgcccaaatgaatgcttccttccaagtatacagggttacatgtaaatagcagaataagccatgttatttcactattccatccttttgcactcttcctctctatatattatatacgtatatgtatgtgtgtatgtacatacacacacacatatttttttcctccatgagatgtccatctcttccttctctgcaaggctattacctactcctcaaacctcagaaaagaagctcaagggacatctcccttgggaccatccttcccaaaccgcacactaaataggcatattttccgtcaagaattctcatgattgctcttcctatgaattttcattacatcctgtttttgcatttgaaacagtgaacgcttaccacactgttggcttacttctctgtttgtaaaaacaaaagtatgagctacttgagttcagagcccatgtctcagccattatatccccggtacctttccctgtgtctggtaacaatgcctgtttaatagaattgaaatcaaaagctatattgcttttgattatacagtatacaatgtccacttatatcctattaatagccctactgctctctgtggcttttctctagttgcaagagtctcgctccccttcagtgattacagagtcagacagcacatgcaggtgaattaacactcactgtagcagccctcaaccaatggccaaaaagaggttatataaatacatccctcctataggataactcagaggtgtgctctacactgactcctacactttcacagtgagattaagcttcaatcatccccactggtgaatggctccagtggctccgtaacgttggctgacattccatccctaacttccccactctccaaactttattttcaggggttgtcttgcaaataaatgacttatatccaaatcctaccctcataatctgtttctggttgaactcgactaagacagtatccaatactatgtttttaagtttaaaaacaattatataactcagtgaagtaggaattcatatcatccttattacacagatgagggagctgaggcacagataggttaaaattcggtaaatttagagcatgtcattgaaaggacaatctatcataaacttgtctgcatattttggttttggtttgtgtgtgtgtgtgcttttttcccactaactttcttcttctgatctctttagcatcattaatgaaaatgctcacatatcagtggctgatggtgcccttgattcaaaaggcagccctctggagaaggattatagcccagcacctaaaatagctgagcctggcaactcagtagagtggtaaactaaacttttccctaaaataacacagagatcactcaagggagtcagcaggaacagggttgccattgtgattacccaggataggagggattaattcacaggtattagaaagcagcccaatgcaatgcacaaagcaaaagtacatttctatagttttttttattttgttttgtaatttttatgcaaaccagacatggtagaaagctacgtaagagacagaaatttatctacaacataaataatggagaggaaaacacatcaaggtgttcaactttataaaaattaaaggtatgcagttttttggttttgttttgttttgaggcagtgtctcactttgtcacccaggctggagtgcagtggcatgatctcggctcactgcagcctcaaactactgggttcaagtgatcctcctgcctcagcctcccaaagtacctgagactaaaggcatgtgccactatgcctggctaattgttttgtattttttgtagagatggggtttcaccatgttgcccaggctggtctctgactctgagctcaagtgatctgctcaccttggcctctgaaagtggtagaattacagggatgagccactgtccctggccacaaagtttaaaaaattagattttactggccgggcgaggtggctcatgcctgtaatcccagcactttgggaggccgaggtgggtggatcacgaggtcaggagatggagaccatcctggctaacacggtgaaaccctgcctttattaaatatacaaaaaaattagccaggcatggtggcgggcacctgtagtcccagctactcgggaggctgaggcaggagaatggcatgaccccaggaggtagagcttgaagtaagcagagattgcgccactgcactctagtttgggtgacagagcgagactctgtctcaaaaaaaaaaaaattagattttactattctatcacaatattagcaaatactaaaatatgataatgtacaatactcatgtaattagtaaaataggcactctggtataatatcaatgagagtataaattggtgaaatctatttgaaaatgcatttggcattttataataggtttcttgatacagaccctcaacttgacctagcaatttttaaaatagtccctaacctttagtccagtatcttccccccatggatttgccttaagaatacaactcacacccatatatacttacatacaacaaaaatttgtcttgaaaattatcaaaatattatttataatagctaattaaaaagaaatcaccacatgcccattaagacaagaaaaagaaataaatgatttaaccatacattagaatacttaaacattaaagtttgagattttgaaaactaaaaaatggcatgagaaaataatatagagagcttaaaaaatgcacggcttataatttcatatatggcatgaacttattttaaatattaataaatcaagataaaagaaaatcacatgaagagattcataggtataactggtggtggtcttatgggttacctttttatttacatgtataaaatatgcatgcatactttttatatttacatgaagttattttaaaacatgaatttgctatacttaggaattaaacctataggtggttattcctgcataacaagacaccagggattaaattaaaattactgggccagatgcagtggctcacgcctataatcccagcactttgggaggccaaggcgagtggatcacaaggtcaggagattgagatcatcctggctaacatggtgaaaccgtgcctctactaaaaatacaaaaaattatccaggtgtgatggcaggtgcctgtaatcccagctactcaggaggctgagttaggagaatcgcttgaactcaggaggtggaggttgcagtgaatggagatcacgccactgcactccatcctgtgtgacagagcaagactctgtctcaaaaataataataacaaaataattagctggtaaaacaaaataatttatgtagtgctctctttgcctaattcatcctccaaatctggagggttcatgcttcctttctccattttaatgtttccaaccataacatccaccattggagagtcttgtggttcatgggcatttgctaattctaaggattcatggactcttatgaaagcatttgtttttgcggtttccattaaaatggcagttgacaagtatacaaagcagtaaagccaaggccatacatctggtaatgaattgctttcctgactgagaaaaaagaggtttactgtgagtgccagttgtttcttgtcctctccaagagttgcagcagaacaaatgttacagaatataaatctacagtccaagacaatcctattgttacttggctctgtgttaatttccgacaccatcatctctccataatcaacaaatttgcctgaaattttgtaaattaatgaacattgtttgttttggaagatcaaactgactcagcaggactttttcagagaaaagaaaagagtgacgattttgaagggaaagcaacaagaaaccaaatgtatttttaattacctttaaattacattaataacaacattctcagtaggacaaagggatcaaattctacttactatgagattttgcattagcttgggaaaatgttttctttctgctttggttggttctgctttaggtactagtctgtagatatttgcaaatctcataatttatgtccatgcttgtatgcatgggacaaaatagttttatttgcctgtttattgtggtctctctgaaacaaatgatgggttgcatcattaccactgctttccttataatgacttagaaaaatcatccttcttccctcaatcctcacttagaatccagcaatcagaactcttatctcttgaaaaacacagctgttttgtgcttatagatgaaacagagataaattaattggcaacgcctaagtttatgaagttgctactgaaatcatagatataatccagctcctttaaatttctctccagaatactttcagtagttgatactaggaatatcctcagtatacagatctaatatcattatttatcttataggtggtcatggaatttgccaaatttagcagatttataccaaatttaaaagttagacttggtctaaatgtttatttaacaaacttttacttcgtgttttttatggtcattgaatatcttcagctctaatcaagacacataagggccttctgggaatttaccttctactggaggaaaggaaatatacatatcaatggctcagccccaaaaggggaaaaacaaaaagtgccacagagaggaatgcatgtaagtaccatgggcatctactgatggggaaaaaaatcacagctctgggtgtgtgaggattgtagaggattgttgaggagagcaagcctggtgcctaaactgagacttgggatagatcattaactgtcagggcatccagacctccatcccatactttggacaaacgcacaaagtcataaaaagatgcacagctacgtggcggagtgcagctaaactatctaagtaagattttagctaaactatgccatgtttagaaaaatcttacctaattatcccacaaatggatccaactgatagacccgttttggcccatttgtattgagatattccatctagactaagaggaaaagttggcaatgaggacttctgtactagcaatgttaatttactaacttcaagaagtcaaattacgtaattaaacacatcttaaataaaaacaatgttagaaatcaaaaatgccctacaaaaactattgaaagaggaaataataactgcaattacagactaattagaaaataatgaaaatgcaaatattgctgtcaaaaacggaatataacacaactctactgtgtagatgaatacatgtttaactttaaatactttcataataaagttaaaaagtaaatatttaattgaagaaagtagaaaaataaccacaattctaaaatagcaggaggaagcaaataaaagtaaaggcagaaaaggttgatttagagaaggaaaaataaaagaaaaataccaaattgctaaataaatccaagagttgtttcttaggaaaacataattagtatactatattaagcattaatgtatgaacctggtgaatttatttagaaaattaagttggagaaggaaaagataaatgcacaatctttaaattataaatagattcctcttttcaattccatgttgatatatttgaaaatctaggtggaataaatacatttctaagaaaaaagatattgccaaaatataataaagaaaaatttttaaatgttaccagaattgtggagcaagactataaaactattcttgtcccataattagaaaactattctttcctcctccctacattgccctgttcaagaaaagtttgtagtggatggctattttgcaagtgatttaaacatacataaatttcatttccaggtaattttctaattaaaatagttataatagaaaggaaaacatttgcaaaacaagctgagagggttagggctgtttttccaatactacatcatttggctttggtccaatctccacttctgtgagtctcaccttctccctcaataacacaagcagagggtgcatgtttacacaagtgtgcctgtatgcatttgtatgtatatcagaatgataaatgttatcgcatgtctgctaactctatcaaacattgaaacactgaattttagaattaaaaggctctaattagctttaaaacaatcccataatgtattatcagtctctctgataatctgcaaactttttgtactatctctgaggtcataactaacttaatttctatcctctcataactcaatctcatctacctcacatcaacactctttcatcctttgggaaaacttttaggtttaaccacttgtattagtccgttttcatgctgctgataaagacatacccaagactgggaagaaaaagagaaaaagaggtttttgtttgtttatttgtttgttttgagacactctgttgcccaggctggagggcactggcatgctctcggctcactgcaagctcagccgcctgggttcaagcaattctcctgcctcagcctcccaaatagctgggattacaggtgcccaccaccacgcctggctaatttttgtatttttcgaagagacaggatttgccatgttggccaggctggtcttgaactcctgacctcaggtgatctgccggcctcggcctcccaaagtgctgggattacaggtgtgagccaccgtggctggccagaaaaagaggtttaatttgacttacagttccacatgactgaggaggcctcagtcagaatcacggtgggaggtgaaaggcacttcttacacggcagcagcaagagaaaataaggaagaagcaaaagcagaaacacctaataaacccatcagatctcgcaagacttattcactatccccagaatagcacaggaaagactggcccccatgattgaattaccttcccctgggtcccttccacaacacgtgggaattctgggagatacaattccagttgggatctgggtggggacacagccaaaccatatcatgactataacttaattagaacaataacaggtgagtctgagttcagatacaaacctgagaatccagatacataaattaaatgttctgcttggattccaaagcatctgtcatcaatagagtatgggatgttcaactgtaacacccagggaaggggctgagtacttggttgaggaaatgtgccatggactaagttgctgtaatatcaaagaatcagcatccagacacaataaaggtattatagacctaaaacaatgctatttcactgtgctttttcttccaagctaacatattgacaaagattgaaaaagaatgataatactcattgctgccaagtgtgtggggaaacaggcacccaaataacttgccagtagatgcatatttagtgcaactgttctggagagtaactgtgtacatggttttgcagaatctttgcaagattttcttattatttcctagcagtgactttgctaggtcaatgggttttatcccagtattacatacagtaataacacactggaaagaaactaatgcttaataataggaattccaataaatattttatgacatacccattaaatattgtgacatattaaaataatatagattcatactgactgacatgaaaatacgattagtacacactgataggagaagaaataaaggatacagttcaaatatattgtcattaaactaactacttgtgtccatacatacagaaaaaaaggaagtatatatacctaaagattaacagtttttatctgaaggtgctaagattacagtggattctatattatttcaattattttaatattgaagtcttaaaaataagtaaatattactctgataatcagcaaattagtaaatatgttcttattttgatgacaaaaatgagtatccatgaataatgttaaaaaattatgtcacggttaggtgcggtggctcacacctgtaatcccaacactttgggaggccgaggagggtggatcacctgaagtcaggagtttgagaccagcccgaccaacatggagaaaatctgtctctaccaaaaatacaaaaattagccaggcatggtggtgcgcacctatagtcccagctacttgggaggctgaggcaggagaatcgcttgaacctaggaggtggaggttgcagtgagccgagatcacaccactgcactcaaaaaaaaaaaaaattacatcacatatacagaaactctattaatactgaaattactttcttgggagagttttattaatagccacagaccattatcctttctctgacatcttaaaagtatccatcatttgtcactcagcatatggtgccttaagttcttaatgaccatttttctgggtagagatctctctatacaggtcaggactatatgtcatttcttatatgtatgtatttatatgtccctctatggatttgaatccctggactctaaatggcagctgatatagtgtcacactcaagtattttcattttttttccctaatgttgtcgggtaacagttccacgggttatgagctgtgggcatatgccagcaccccttgtcctaacttcctaactggcatatgtcttaaatacgggttaggagtttttaccattgagttgttctaagaagtttcatgagcacaccattacgtagaatatagatgtcaaacttgaagctgatgtaacagcctatcaacactgatagtttccaggagccctccgctggatcctcttttattctaatgagcatttttgtcccttctctgggctggaatgaatgacttctgtcccctctctgggctggtgtggatgacagaactttctcggattcagccacagctgaagagagctatggctgaagctctgctcgggggaatgtgtcccctgcaaggcccaagctggatgcatcttcagtgggattcattatccattctgtccattctttcccaagagcccagcagcccttacacacagcatgccattaacaatggaggaagcctgccacagaacggcgctctttgaggcaatggaaactaccctacgtgagcaggctgcacagctccgcttttcccagtcagcctctgagcagttcattggtgacttcaagaacgaatccaatctacatctatggaagccattaaaatctgccctaggcatcttcagcctccaccacccaatttctgtttcttcagccatctttaaactgtccatttactccattatttttttttatcttcatggtacttgtatcctccctgtcttctctgctccttcagattcttgggaagaaatgtttgcctgtcttccaaggtcagctctttcttgagatgcacacctcagctaaccacacaacagccactaagcaagcagttccttgccctctccacccttctccttcactgggtgtggtatcctaggctccttgatgtttgggagagaggttctgacacgggcttttgaaaatccacagaacatatggtctttgaggactgcattcaattttctcctggctgcctggctgccttgcttgccctcaatctattgctctcatgctgaggacccttgctgatttcactagggtgaaaagaatgcatttccttttgtcacaagtcaccatcttttccttgcaaagtagctataggtatagagtggaaggagaatacaaatgacagagagagagagagagagagaatatactcaggaatagaaattgagaggtagaaatgcagactcacacccagatggttacagagagagggattctttgcccccagaccatgcatcagaccagctctgaaattcacattctcatttctctacttaacctctgcaaaacagcatatgggcatgcctttcctagttactatgcattactgtctaagtagggggtggtggtgtgtgcttatctatccagctgacagcttaaaatccctttatcccacatccttcccaagagttgtgtgcattctgtgaatgattaattttttaaattatttttggctccaacctggtttctccatctcttttacaaatcacctccagtggacctccactgtccatgaaattcgttctcctttcctcaatatctatgcacgtatacacacacacatatgcactgaccaaatgatacctatccacccaatatgattgcaggtattgctatgcatgtggttgctgatatggggggaatggttaagtctccagagcttgtcacagtggggaagaatccatgttgtatatcatggcaagaaaatgactttaaaagctatatagcaattttcactcactcttacctacatactggaatttaatagccatgcctctctgtttcagcaaggccaaataacttatctaaatatataatgcaaagcaattctattctctgtggcttctacctctaaactaatatccgattttgctctccttggcacatgcaacaagttttaaatatagttgaggtggaagaaagtagttgataactgggctctggatacaagaaggctgatttcctactgatgtgaaatttgggataatctacttaacaattctatgcctccgtctctttacattgtgtgtgtgtgtgtgtgtgtgtgtgtgtgtgagacagtatatatatatagagagtgagcgagctcacaagcgagagagagggccacattttatatagttaatgacagtatcatattatggggttgcatgaagcttaaatgagaggaaaaggtgctcatctggcacctggcgcagagttaatcctcttaaatgtttgccttagacagggggtcatacaagaggtctcatcccatcagtcactgaagaaatgtgtagtatccagacagatcattaccaatgatataagttaatataaccgtcgctcacagaaggcaaaaacagccctagtaatttgacagttgtttttcaatagcacagttttcctccactgaacatatcaaattattatctactgaacaaagatacacatacaataataatgtgaccagagcagtattgcccatccatggtccttcagtgtgctgccagcaggattctacctgatcctggaccatggcacgtgctattgttcacttttaatttttttctttaaatcaacgatatttcttagttttgttctaagataataactatgacatcataggtctaatgagccgttaatcattgcttaatgtgcataagtagcaataactaacattttaaatctgtctatccacgtttcaactatgataattacctggatttggaagcagaataataagacttgaattactatcccatctaggtcttatatatttctgatgcctgttcttgggtaaatcacttaaactctctaagctccaggtgcttcatttggaccagttcacagatctcttgtaaagatcaaggaagaaaatgcaagtcaaagtattctgtaaactgtaaagcatggtgttaattttcagtaaatgtccaagaactctttgttgcgactgatgacaccagtagattagctttcaacaacagaaaagctggcttttcaaagggaagtgaatgtccttcattcataagctccctggttgatgtgtctcactcaggatttacagcagagtgtaccaccatccggtgacacattgagattcccttctgtagtagcaggggggtcactgctggtatagctaacaccaccctcgtgtccactgaggacaacaaaacctgcaaatgtccttttcttctcctcttaaatttcatattttttttttcagtcacacagcctcagccctatcctatttatagattagctgcatgcatcagtaccagagaaccaggatcacgaactcagtattgggcagcgtagtccccacaggcgatgtcactgaccccactaaatactgtcagcacctgcagtcacagcattggcacctggcatttctcggctgatccaagaactcctgtggctttgcagagtacttacaccagtggttctcaaccctggttgtccattagattcacatggggagatttttctcaatgccaataactgggacccatcccaaaccaatttaattaggatctgttggtggaagcgggggactcaggcatcagtttatattaaaagctgctcagggactgggtgtggtggctcacgcctgtgatcccagaactttgggaggctgaggtgggtggatcacgaggtcaggagatcaagaccatcctggctaacatggagaaaccccgtctctactaaaaaatacaaaaaattagccgggtgttgtggcgggcatctgtagtcccagctactcaggaggctgagacaggagaatagcgtgaacccaagaggtggagcttacagtgagctgagatcctgccactgcactccagcctgagcgacagattgagcctccgtctcaaaaaaaaaaaacaaacaaacaaacaaacaaaaaaaggctgctcagaagtaaaggcttcttctgccactttaggttaactgtggccagacggtaaggctgcacctactgagcatggagaaaagtaagaatgaaatccaattattgtgcttagtttggccaaatcccataagtcagaataactgaacatgaaacaaaacaaaacgaagcaaaacacaatagtgcccaccccgacagtccacctgtaccgcttttttttacgagatgatccttttatttcttacatgggaagatcttgttaaagtgtgaatttctgattctcactcccaacctaaagcaatcagaatctctgtttgccagggaatttgcatttcaataggtatcccagagcacctaagcccacaaaattttcggaccaccactttctaagtgattgcattaaggatcactgtataatccttctggggttttctgccctgattgcaaaacaaaaagaaatataaaatatagattcctggttctaccccatgcatccttggtgtagtgcctgcattgctttttttgtttgtttgttttgttttgttttttaatggagtctcattctgtcgcccaggctggagtgcattggtgcaatctcagctcactgcaacctccacctcctgggttccagtgagtctcctgcctcagcctcctgagtagctgggactacaggcgcacaccaccatgcccggctaatttttgtatttttttagtagagatgggggtttcaccatattggccaggttggtctcaaactccagacctcgtgatccacccgcctcagcctcccaaagtgctgggattacaggcatgagccactgcgcccggccaggcattgctgaatttttttaaagattcatatagagttctgattaaaagccagatcgtgagcctgtgtgataatggcaatgccactggactgcaaagaaaaaaaaaaaacgcaaggcttacattgctaaagtgtcttttctttgaccaggtgtcatttcctaaacaaactcctccatgtcaattctcttcagagtgagaaaaagaaagtctctttcttgtccatttgccttttgcatacagaaagggacacaaatttagaaagtatttaaagcagtgggcgcttcgaatgttcattattcaatgccagaaccaaagcctccccaggcattattaaacacattgatgaacactgtggctggatttagagagaagaaaggtgctgctggaactgcaatacaccaattcttcatttaaatatcttgtaagtaaagacccaggaactgacttcatggattttcatgtggaggcgatagtatttacatctcaaaagcctactctacggctttctcagttatgctggctattggggattcctgaatgagcacaggatgaaatgcaacttaattctatctattaaggagacaagggtttcgtagctgggtgctgtgtatggtgaggaggttattatggcatgaacaaatgcaaactcaagccaattattgcttcaactcctgctgagcttttcagtagaactttaacgcatgcaaaatggagtactagttcttgtctcagctcataacttcacacagaaagatcatttttcctgtaaatgctgaaggcagggtgaagcccccagagcaggccactcaaatctcactcagcaggtggccattggaactgggcatctgagggacaggagcctaagaaatgtccttgagttgctacattcttttaggaggcaaaagtgaaaaataagagccacctgccactcacagagaaaagaaaatacaagttgagtcccttctgtgcttgtaggtcctccccaaaccaaaccaaaccaaatcaaccaatacacacatccagccagtgggaagatggctgtgaagttcccatctctcccaagtctgtgattgacttcaaaacactatcatcaatcatgctaataagcacttaaaaagtaaatcaaaggctattaaaacacttttgacattgagcttgcttcctcaagcaaactataaatgcccagaatttacaacatttgctgaaggaagggaggaggatgctgggttttaaaaacaaatttattagcttgtttcttatgctgttttttttctcctttctcccattgggacagtaataaactaaaactgctagatgctgttacagactgttaaattcgtagttaaggttcatatcattatccaagctattctggatttccggggggtgatttataagtatgtgcgagcaaaaagccacaaaacactgtctcttttaactaaaggggcctggggctatatgaccaacatctatacacaatgtgccaggcagtaaaataatactgtatgtcactcccctcacatgcaaaatactggacagaaccaagtaagactgtgaaataaactgagatcaatggcggccatgctctgtcattattgtgcatggtgactctggataagtcatttatcctctctggacctcaatttcaactgaaaaaggcatgaattgacctagataactttttaagtcctattccaagctacagtcctattatcgaattatccaattagctcattagccagcacaatattaatcagttacctcaggacttatacgaatgactagcgtgggaccttaattctcatctctccaaattatggcggtggaagtggtgccctctcatgctggcaaatctgatttctagccattcattcactttctcccttcaacacatgctcaacattgatcttggatttatactcccattggctccttgctcagtttccaatcagtggtgctgacagctggatgttcccatttcaagcatgtggagtaacagacacgagactgtgactggggcaagacagcatccactaacagaaggatgagtgtcaggttttcattaagcaggagcacagtggttgcttatcttcagctcagttccagacctgcatttggtaactatgcttaagtgtctcaaactgacctcaaagtcaacttttccaaacctgaacttgtgatattctcctccaaaatgggtcctgttttagagtttcttctctcagtgaatggcaccactatctgtcctgttaggcatgctaggcacctagccctcatctttgacacctctatccctttaactggttcatccccaagccctatcatttactccctgagaatttcttaaatagaaacaaaccaatgcatttctaccaataaaaccttagcttatgcattatcctttccctgtttctataatattttcctacatgatttggcagcacttcctcttcgacctttcaaaatgcatatttgcccactccttcccctcctcatcccactccactgccatcctgccaacctccctcctcctcctccctacctgtgtggtctcatttcacaccccactctcccaggcccactctactctagtcacattggagtcatttccattcctctttcttgttgtgcttcttggatccacatggcgatttcccagagaatttgatatgcatgatatatttggggaacatagtagactcacactgaaaaaaagctgaaaactgaggttgtgtggctgttttaagtgaggaagagtggcttcattacagatgtctgacttccaataatgtattgcccccttccagtttgttgcactcccagagtgttttgggacacctggaccaagtgagagcaacaaagtaggaagagcgagccataacctattttgaagggacctggctccaaattctcctccaggaggagcaatggaaacttctaggagaaagccaattgataagaaaggtgcaggaaaagattgcttgcaatgaaaggtatcctaaaaaccttgatggctctatcgagacttccttctaacctacttcacctggtcaatgtctacacacctcttgctcatcactttactgaaaaaatcttccctgtcactcttgcctaggtagaatcctctagcataggctttcataaagataaagatctgcacatcccagtacttaactctgtgaatacattattcaattaattatttttttattttagtgcattctctttcactaaaatgtaaacattctgagagctgaaatcatttctgctttcggtcactaatatgtttccaaggtctagtacatcaaaggcactcaaactatttatttaatgaatgaatgaagtggaaagttgattgatggcaatacattttttttccattatactattggctattccaggtccaattttttgtttctaattgtgtatgtgtgtgtgggggtatacacatacacacgattgtatatatgattatatattatgtatatatgtattatgtatattatatacatatataattatgtacataattatgtattatatataattatgtgtatctatgcacacgatgatatataattgtgtgcatatatatacacacacacacacacacacacacacatatgcacaattagaaatcagaaattggacctggaaaaaaaatttataaaataataaattatataaatatatatatatttccattaaagatctcttctacataaagttgcttatatcagcttcacaaagtagagggtttactttccaatttttcttttatttttttgagacagagtcccactctgtcggccaggctggagtgcagtggcacgatctcagctcactgcaacctccatctcccagactcaagcaattctcctgcttcagcctcccaagtagctgggattacaggcatgtgccaccatgaatttttgtatttttagtagagacggggtttcaccatgttggccaggctggtctcgaactcctgacctcagataatctgcccgcctcagcctcccaaagtgctgggattataggcgtgagccaccgcacccagcccactttccaatttttcttttttatcctgtcatttttcacctggccagctcgttctcagctgaagtatgatgttcttggagaggtgttcccagaccatccaatctaacaaaactcctgtataatctctctcagggcagctctaattttccattccaaatatgattaccccaatatacagcaaattttgagtttctttttttaacacttgtgtttcttgataaactctaagcttcttgaggactggcactacatctattttgctataattgtaattaatacccaaaccttgcagagttcctggtacatagttggtgctcagtaagtactgttggctgaaaaattacttccactaaatggtctatagctttggtatcctctgcatcaaggctctatatctcttgaggaaagacatgatatttttgcttgtttagtatccccgatggtactaaacccacagttagattaggctggggattattaaccctggaggacagatgactctttttcatgcagtacatgccccgtgtactacagcatgtttagcaacatccctggcctctagatgccagtagcatcttccacaccctgttgtgacaaggaaaatgtttccagacactgccagatatcctatgtgggcaaaatctgcccctgacaccctgctgagaagcagtggattaagtgcttaatttaatcaatgttgatgaatagattgcaaggtggcttggcaatctctgggttctaaagagtccctcagactctgagagaaattgttccactacagccaaggtacagaacaaatatctaaaaatatctgtcagctcctatgagtggtgctcgcttcaagtgcttgaaactgatgccaatttggccaggagcctatgctaacttcttccttagtaattgttttctcaatagctgcagctcattttgaacatccttggaacagtacataaatttttatcttatttactatttcctgaactcgccaattaagtttccatcattgtaacttaaaaaaaaatcttcctgtccaggacatcctcctgagggtaagaatatgcacctgttttactgaagtgccttctgccagacagcagagaacccaagaaaagacatttctttttattttattttttgatacggagtctcgctctgtcgcccaggctggagtgcagtggtgcgatttcagctcactgcaagctctgcctccctggttcacgccattctcctgcctcagcctcccgagtggctgggaatacaggtgcctgccaccacgcctggctaatttttttgtatttttttagtagagatggtgtttcaccatgttagccaggatggtctcaatctcctgacctggtgatccacccgcctcagcctcccaaattgctgggattacaggcatgagccaccgtgcctggctaaagatgttttcttaatagcgaatatcctggttgaactttgtcatttgctacataccctcacatacaatgtctcaccaaacagtatgcatactgaagagaggggagacagggagacagggaagaggaaaaatagaggaggagagggagaaagggggagaaagggagagagtggggcagggaatattcagtggtcaaaaaagcaaaaaacaagcaattatctcctcaccagaagtttcaacatctgggctcagatgaacagaataggcaaggctgaaaaagttttatacttaattttactgaaaaattaactaccaggagctttcataataacttcctgttgtataatttgaaaataattgaaaattgtatagtgtattatatttttttttccttgggacagtatcattctgttgctcaggctggagtacagtggcatgatcttggctcactgcagtcttgacctcctgggagcaagcaatcctcctgcctcagcctcccatgtagctgggaccacaggtgtgcaccaccacacccagctaatttttgtatttttctgtagagatggagtttgccacattgcccatgctggccttgaaatcctggtctcaagtgacccaccaaccttggcctcccatagtgatggaattattggcatgaaccaccatgcctggcctgcatattgtgcatttgaatgtcttctacagtacagaccacttaaatacttctatttaaagaggtgatggtatgatagctatgcccttttcactgaagaaaggtaaaatatttgccaaacctcacacaatattagtgtgaggtactttcacccaggtcttctgattttaaaccatatggggtttttcccccttcagatcccagtgactcttaaatggaaaacatctaatactactgatttcccattttctgtcctgtgagttgtactctttttctctctcttcctctggaatatggtctgcctgggaagaggatgtttactgggacccctgtccaggaacatgtaaggattcctgaagagatacacattgcttcattatcagataccttggtttaagtgccttggctggattctgataggtgtgtgtgtaacccgcaataccatagagcatgaagtgaaaaaaatggaaattccctgcgctatttggttcaggagatgcctaacggtactacatagtaaatgtcatgaaactactcaaaagcattggataggtttttagttcttgcttctagcaaaaaaataaaaatgtataaataaagtcacacttttttctatagattgggagcaacagaatatgagtggagtgaccatgtatgtcctggttggctcaggacaatcctaatttattcccattgtttcaatatgaatatttatagtgcccattcttaaaagggttctagtttgatcaagttaaacaatatagtcatgctaaatacggcttgagtttcacaatatacctgattggtttaacatatcatcaggtttcagatttagtcacttttaaaatgggtatgcttcctcctcagaggttgctgatgacgatagaaaggttttagggagtaggtggtaaatgcctcctccttccaaagttatatcatcacttcccaaaaaagaagctttggacagacaccactgttacccccagtcaccactttacaccagaacaatgaccccaatgaagagaaatgcagacagtgagcacaagctgcagggagccaccgcccacccactgggactcaagaccaacattcacatccaaacctatgtctgtaaccacagtggtaagcaaacatgactagtaacttaaagcatggtctttctttaggttttcttcttcgggagcaatctcccttgctcctggatacaaactctggcaggcccccgggctttctatttattcttttgtaatagatagtcccagagtcactttaaatcacacgcatggtcttaatttctgtaaataaaatgtccggctgaagatagtaatcaaaatcctgtatacaactatattaaatccaccccttctccctcccatgtcctcatccctacacccaccctgtccctgaattcccccacccttttcaggctgccacctgcactgcagaaaggacgtgtggtcatctgctctttaatgagcctaatggagtttcttgactcaacttgccgccttgctccaggaaagcaagagagaaaagcgtgtaggaagtgagggctgttcttttgtggctgggaggtttccagcactctgggcctggcagatggtgaaagtgactctttttcttgggtgcgctctttagaatctcttgctggatctctgccttgtggtcttatgacctggatgggtgcatctccagtccaaatagtgggtggagtcacccttctcaactgcttgtcacctggcagctcaactctagccctcttcaccatgaggcctgcttgtccctccagagaagtctgttgaacgagacctgagaggaccccagcaacagtctccatggcatgctcctgggaaaacactcccatttttccagctccaaggcaccacggcaagaacatctctagctcatcgtcttgcaggtggtcagctcttgcctctccctcttcatttcccaggcaggcatcagatctcaatctacaaaccattttgattatctcagtcaagtgttatgttccagtttttaaagccccaaatttggagagatacaggtaaagctctcttgaagcccatacattcatggggctcaaagtgaggggaagactcctcctacccctatgtgatggggaaagaaaatagcccagaactctgatgcctttttctcaagttctcttcactcagctccttacatacaagacctacagaatgcctctgcttccctggtccttatcaggctccactgatgcaacaggaaccaaattcctgacatagggaaaatggacttcagagcataatttcatctagatatatcagacttacaatgttctctcactttctcctctcttaattccatttcaatattctttatctgactcctctatttgattgaagagcgcaaatcgtattaaacagaatcattatataatcatttaataacaaatgttattaaaaagaatcatctgcttaataactcagtgcaagggacacagggagtcgggaggaaggagaaagtctatctcacacatgccttggaaccatgacatccactgcattgctacccctatagaaactataaggactcaataaaaacaataggaaactataaactctgtcggtattaatgctaagggtccagtgccccaaaaggcaaaaccaggtaagcaagctgacacctatcctccaactattacaaattcaatctgaacaatgcttatttctttgctatgttgcctgcatttccagaaaagccctctctagggtctgacctcatataattcacgcaccttattcccataagggaaatctaagaaattgctttccatcgtgctgcatctcataccaagttgagaaatcccctctgatctgctgaacttctgaagtcccagaagtagaaaaacattaagaaatataagaaaggtcaaaaatctgaaaatgccacttgtaaatggacagtcttattgagcagacaggtctcctcaggtggtgaacaaagcttacattagagcttaggaaagaatgaaagggataagtttctttcagcactttaattttgagccaaggacaaagttatgaatttcagaggcgggttccaggtgacatacgctaaacacacaactaccactgagcactaacatagaacctcaacagagtaagaaatgacagggttgccttgctagggatgtgggagataagagcagctgacttctcaacatgaagactacagcagactctggcacctggatagatcttctgtcatcccctgaagggcttccaacaataaacaaacaacacaaatagacaaagaaaaaacaaaagcccgttgataataaagtcaaaactttgataccatcaaataacgaaaccagtcaaagacattttggggattttttttattaggcttcttttaagggtagctttaggttcacagcaaatttaagtgaaagtacagagagttcccatatgactcctgtccccctcccttgtacacacacagcctcccctgctatcaacatctaccctagagtggtacacttgttgcaactgatgaaccaacactgacctattattatcgcccaaatccgcagtttacgttagggttcatcctagacttatatattctacaagtctggactaatgtataataacaatgtgtccaccattttagtatcatatagaatagtttcgctaccctggaagtcctctgtgtttgatctattcatccctcccttcctgcaacccatgacaaccatgcagccttttcttttttttttttttttgacatggagtctcgctctgtccccaggctggagtgtggtggcgcaatctcagctcactggaacctccacctcccgggttcaagcaatttccctgcttcagccccccgagtagctgggactataggcgcacacgccaccacacccagctaatttttgtacttttagtagagacggggtttcacgatgttggccaggatggtctcgatctcttgacctcgtgatccgcccgcctcagcatcccaaagtgctgggattacaggcgtgagccaccaggtccggccaaccatggactttcttaccgtctccgtagttttatcttttccagaatgtcatgtatttggagtcatagataatgcagccctttcagattggctcttttgcttagtaataagcatttaattttcctctatgtctttttatggcttaatagctcatttctttttagctgaataatattccattgtatggatgtaccaaaatccatccacttaccaaaggacatcttagatgaattcaggttttgaatgaactttgtgtgaatatataagttttcatcaattcagttgggtaaaggcagcttgattgttggatcttacagtaagattatgtttagttttataagaaactgcgaaactgttttccaatgtggctgaaccactctgcatttccaccagtaatgagaatgagagttgctgttgctccacggcctcaccagcatttggtggtgtcagtgtcttggattttagccatcctaataagtgttagtggctatcattgttttcatttgcaattctcttacatggtgttgaacatctttccccatgtttatttgtcatctgcatatcttcttcggccagttatctgttcagatcttttgcccgtttttgtttgcttgcatgtttgtttgtgtttgattttttaaagaaagctttttttattattgagttgtaatagtgcttgtatagtgtggataacagttctctatcagataggtcttttgcaaatattttccccaatctgtggactgtcttctcattcttttgataaatggctttaaaataataatctggctgggcgcagtggctcatgcctgtaattccagcactttgggaggccaagggcagatcatctgaggtcgggagttcgagaccagcctgaccaacatggagaaaccccatctctactaaaaatataaaattagtcgggcgtggaggcacatgcctgtaatcccagctacttgagaggctgagacaggataatcgcttgaacccgggaggtggaggttgcagtgagccgaaatcgtgccactgtattccagcctggacaataagagcaaaactccatctcaaaaaaaaaaaaaaaactaccttttaattaaaaacaatttgctttagtgagaaatgcatgataatgatagtgtctgaggaactgctcagtgattgaaaggaacattttattgtattagataaatgatatggtaaaaataaagcaaagcaaaattaaaacatgcaaataaaattttgataatttttaatattatgaaaattccacagttatcgatctatctatctatctatctatctatctatctatctatctatctatctaatttgcattgggcaggagctactccaaaacatatggaggcaaaaggcaaaagaggaaattgaaaagaaaggaagcgtaagaacaagaggataggtggtatggaaggactttgtcaaaaataattgtccaccatcctcactttctatttttacagatgttggtgctgctgctagtgacagccctgagaaacagatgaacagggattcccaagtctttttttttttcaatttttacatttaactgcatggatttttttttttttttatgttaaggcaacctgattgcagtgtgaattaatgcttttcatcttgacaagaatggacaagcaagatgtattccttgtgtaactttcataagtatctcaggtttatatgttttcattctgttttcaacaaacttcagatgttctgatctatgcaaactgacaattcttttcctcactcacaagatatatttacattaaagaaacacatactttctaaaccatatttacttcaaaaattattttaaaaatagtacttttatatgctatattatatatcatatcttatgtacttaaaaatcattttgtaatgattgagtatttgcaaattaaaatatcaaagctctggcagtattgctcatttggagaagaggaagactcacaattctgcataaatgattgtcttctctattgtttgttttttttttgtacagcagaaaggcccttttccctatcctatctgcctctgccagaggccagagcagcctcagattttcctccagggccctttgtgggccagcactcaggctgccctctctgcatgattagtgctgcacaaggtatagcattcactccatgcttctggattcctggatgggacccacacttaactggctgtccctgcagcagaaacttactcaaattacactgacaccctgcttagcatgaaattagcttgaaatacagaggctaagaggtggcccctcctgatggtctcaagcttgcttactgatatgtaacctcttcatatcccaagacaaagtcagattgagtctctccaatgccagcagcaatctcttccctcactgttccctccacttaacaaaggcttttgagaagtaagaatattttagctcaaacaacaagctttcacttttatatctagataacctaaaatttgttcatgcagcattttacatatcattacttcaagtatatttctgtgtttttatgatgaaattgtaccttcccagcaaaacaacacaacagagaacaattgcactgtatatttgatggtaacactagagcccaacggagggtccattccatggagagataaagctaatgattttggtaagacttggtaaggggctgcaatgacaggtttattgggctctctaaaacagttctgttcctggacaactgtgtataaacaatttatgaaaaataaataatgttttatagactttatcagaaatttgatatttaaacaattctaagacactttggaagaaaaaaaagactgaaaaataatttcctagatggcaaatcacgaggcttatatcaaatattatccatcaatgcacaacacaggagtagattcaagatatggcaagtgcattcaatcccagctaaagcatagttatttgtatccttaagagttatgtttatcacagcattctttgtggtaatgaaagaatagaaatgacctaaatgataagcagggggttaatgtttttaagataaaaataaagtaaatccatacaagccattatgcagccattaagaatatgtgctttttaaataatcgtgtgccttgaataaaaagactaaagtcaaaaataactgagttttaatagtagcttgcttcctaaccagctatttaatactgaactcatctccttatcttcctgagcctcaactgtctcatctgaaaagtggggattaaaaaaaagtaactgcctgaatgggctgctgtgagaattaaatgagatgatacccttgaagtgcttagccaattataaagttaccttttattgaacatttactattattaggttgaggctcataaaactgccatttttatagttcaaatgtagtcaacatttgaaaatctcatatcgttaaaactaacaagacagtaaacaaactagagtataaagtctcatccataggaacaaacacaaatatagcaggtttttactctgaagtaaaataattattaatggattttagtagcattaatggattttagtagcattaagatggtactagatcaagggtctcaaaccatagccattcttcctccaaaatttctaaggaatatatatacacacacacacacacacacacacacacacacacacacagagagagagagagagagagagagagagagagaatgacaaatgtctatgttggttgtagtatgagtttatccatccagttactggagtgaaaaataaatagaaagaaaaacaatataataatacataatacaatactacatggctcagagttgtcaccacagttttttggaggtaggtacttggatgagagtgacaggatagaaaaaacctgagtgcatgatcctgtcatagccagaccttgagcctctaatgtaatactgtgtccagaattggtggcttcttggtctcactgacttcaagaatgaagctgtggaccctcgcagtgagtgttacagttcttaaaggcagcgtgtccggagtttgttcattctgatgttcggatgtgttcggagtttcttccttctggtgggttcgtggtcttgctggctcaggagtgaagctgcggaccttcacagatgagtgttacagcttttaaggcggcgcgtctggagttgttccttcctcccggtgggttcgtggtctcgttggcttcaggagtgaagctgcagaccttggcggtgagtgttacagctcataaaggcagtgtggacccaaagagtgagcagcagcaagacttattgcaaagagcgaaagaataaagcttccaccactgtggaaggggacatgagcgggttgccactgctagctcgggcagcctgtttattctcatgtggccccacccacatcctgccgattggtagagccaaggggtctgttttgacagggcactgattggtgcgtttacaatccctgagctagacacaaaggttctccacgtccccaccagattagctagatacagagtgttgacacaaaggttctccaagtccccaccagagtagctagatacagagtgttgattggtgcattcacaaaccctgagctagacacagggtactgattggtgtgtttacaaaccttgagctagacacagagtgccgattggtgtctcaatccctgagctagacataaaggttctccaaggccccaccagagtagctggatgcaaagtgtccattggtgcattcacaaaccctgagctagacacagagtgccaattggtgtatttacaatcccttagctagacataaaggttctgcaagtcctcaccagactcaggagcccagctggcttcacccagtggatcccgcaccggcgctgcatgtggagctgcctgccagtcccgcgccgtgcacccgcactcctcagcccttgggtggtcgatgggactgggcgccgtggagcaggcggcggcgctcgttggggaggctcgggccgcacaggagcccacgaaggcggggaggctcaggcatggtgggctgcaggtccccagccctgccccgcgaggaggcagctaaggccaggcgagaaatcgagcgcagcgccggtgggccggcactgccgagggacccagtacaccctccgcagccgctggcccgggtgctaagcccctcattgccaggggccggcaggctgctccgagtgcggggccgccaagcccgcgcccacccggaactccagctggcccgcaagcgccgagcacagccccggtttccgctcacgcctctccctccacacctccctgcaagctgagggagccagctctggccttggccagcccagaaaggggctcccacagtgcagcggtgggctgaagggctccttaagtgccgccaaagtgggagcccaggcagaggcagcgctgagagcgagcgagggctgtgaagactgccagcacactgtcacctctcaataccccacagaagcaaagccacatgtgagcatgcaacctcacatctcacatagactattagcagaggtgtcctattctcccgggaagggagaaagaggagtaggaaaaagaaaggctaaaaggtgtctcaaaaggggaaaaggaattaacagcttctgaccacctacccccaatacctattttttatctattttttgccttttagcaaataaactttctgtatttttccattttttagtgaaaatatatatacctatatatatatattcactgaattataaaattaaaattatatatataattttataggaaaaatagaacaaatctttttaaaattgcagttacatgcaattaaagcatgctgatgatgagacatattaaatcatccataagaaatgcacaggctctcataggtatgaaagcaatggctccttctgtgtcactttatctccatgaatatgcttcagtagttaagaactgcttcatgttcaagggtggcttagccttagaggagagacttagaaggggattatacttttagatcagaagagaatgaatttttccccagaacaaatgatttctaaaacccttagaaattgtgcattactcatcctttttctatcttctttccactatacattttatgtgggatccctgtggcagttaatagaaaaattcaagtcacaaaaggaaagaaagaaagaagggaaaagacctggggtatcagaattaaaaagagatgtgaattggcccattagggaaaactgagatctacagagatgtggcttatgtttactttccctccctactaacatggccttttataaaaagaaaagccctgtctcttttctttttccgtctctaacaatgaaaccacactgagagagattagagtgctaatcagcttctggaaaagcagatcaaccaaaaaacgcctacattgcaggctttctggttcattttccctccattgttttagtagcctgagtttatgggaaatcaaacttcgtcaacttaagctgctgttcctggctgaattttggagtagtcagcaaggttcctataacaaacaaatgaccacacacaattgtgagggcacaggcatgtgcacgtgcacacacacacacacacacacacacgtattaatcagagcacttggttgctgagatcccagcaagaaagatgaaaataaatggagtatggtcattaaaaatcctaaactaatatttcgaatatggcataaaatgaatgcttgctaacagagaatggatgggaggacctcttttgcttaagaaaattaatgatggccgggcgcagtggcgcatgcctgtaatcccagcagtttgggaggccgaggagggtggatcacaaggtcaggagattgagaccatcctggctaacacggtgatgagacatattaaatcatccctactaaaaaaataccaaccgtctctactaaaaaaagtacaaaaattagccgggtgtggtgctgagcgcctgcagtcccagctacttgggaggctgaggcagaagaatggcgtgaacccgggaagcggagcttgcagtgagccgagatcgtgccactgcaccccagcctgggcgacagagcgagactctgtctctaaaaaaaaaaaacaaaaaaacaaaaatgaattaaaaggttaagacagattggttacaaaatcaccaggaaaggtcactcctaacagactcattatgcttatgcttagggtaaacagtcatcagctaccctgcaaaataagtggcagggctgctgtatattgaatacaaattatttgcagaaccctcagctctccttgcttcattttgctactgggatacacggaagctggcattgtatgttcatgtgtgtatttatgtatctgagcatctcattataaattattatcttcacattcaagaaaatagccagctcacaggcacaacaccaacacaggagggctttataacatcgcatgcttgaatcaggtgcattctgtttcatcttgctttgttttggtttttttcttcagaatttggaaagatatgatggttcttaggagtcagaactttttctttttttaataatatggttagtcagataaggcttctaggtgaaacttcttcaaaagtccagggaacctagtgttctaatgcttccccactaactccttctgaaaccacatctgctcaaagccttctcaatcaagacatggggaatctgcccttcaaagaaaaggtaatttcagcagatctcaggggagttttgcaatcagaatttcctaagatacaactgtggtggaactggctatgaaatgtattaatgctgataactgtggttttataatccccaccaattaccacaaattatagccgtgtgattctggaaaaaccacatgctgtggagttgaatcctggaaaaatatacactggttgtctaatttccttcctaattttaagaagactcataaaaatccttgccctacccttcttctcctagaagactctcagggaccaaaaatacttgagaggcatttgtacttaaatcctatgtagcgagctccagaaatacttttttggctgttaattaactaattcaatgttgataagcctacttaatgtacactccagtaaaccagtacatacaaagaaacgtggtcctaccatcaaggggtttacagtagcagtaggacagaaaagtgatgaaataaagtcaacacaatggagctacaaaaacaactgcaagagcagaatctcagaagtcagaactcactgagaagagcatggaagcgggtggggaaaatacttggtaataaggacaggaaactgtttcaccatgctggccttcagtgtaaagtcctctgaaagctggcaatctccccaagtgcacaaatacagatgtttgctcgtttgtaactcctgaaccagagagccactagctcagaggcatcatcgtgggaaagccccctgcagttttcagagatgttgccttatgaataatggaaactttcaagaatgattttggtttaagaacagggataagtcctttttttagggttgtgtatgtcagcactctgccctggtaaattatctgcagacagcatagtctatcaaaatgaactcactgctgttcatttttcctgcctgccatgctgtgtattaactatcatccattattttaaaaacatttctggaatcaaaggtaagagcaaaaagaaaaacaaaagggtaataggagataaatgcactgcaaatgctggtcatacatgctagtaagacaggaaaaatatctcatggggaaaaacaaaagccaatttttccataacagcagtaatattcacagacttgaatgcttccaggaagcttaggaaagcacagggtttggggacgttgacagttataccctggggatgttctcatggggaaaggtgtcaagcagatcattagtcaatttgatcccccatttacaaagcactgatgttatgtgaatttttatccccttccatacacactggtagaagcatactatagtattaatatagtctacaaatatattattatttttgagaattacatgatttttttgatatatttgagtatatcctgaaatttttaaaaaaacaaagtagaaagcattgtcttgagtaaaaataacttcacatttggctgctgattgctcccctgataccatgcatttggcatcaaatccccctttcctgaagcaactcacagcactactgtcacctgtgttattactggaatcttaagttgttatttaactttgtcactggtgacaaagaaaaggtataccttgctgccttagagtgatagtgatctttctccccagttcccaccacatgtgtgtatgcctgtctccagctcaacttatgcttgcttcttggacaaaatgacaccttagcaagactcaggaaaatgaaaatgttaactatccaagagaaacaaagcaccataattccaagaaatccagaccaagttttgctctaaggacacccttgacaaacatgcaaaatgagcttgtctgctctgccttctgtagaatcagaagcaccttcaaggtgagcactcccctcgcagcaatggtaaattttagctggtttgtgccaacacagttgcaagctaaatgcttaactggggattagactccaattcaaaccactttccaggcactgcctcctcactttataatgttatagaatgattatcaatagctgtgattctgaaaccaatctgagacccgggcctctgcaatttaaagcatatcagtgatctctgtcaacattaattttccccatcctaatttgtatttctttcacaccacaaagggatctaagtttatgatttacctggacagcacgatcgtgttcaggtctaaatgcaaaagagattacatgtagatgatgaatttgcatccttgtaaatgcagaatattttagccatgacaaatggcaagatgggagaacatgttcactgaaactaggaagcccagaaataaggtatcagcaacactaatgagcagctcagtcaagcaaaccccagaaaaataatgggccaaagttcatcgattctctgtattttccagattaaaatcacctgggtagcttttacactacctgtgtcctgggctcagtcctagagattctgattcaattggtcttgggtggggccacacatatactattttaaaatgtcccccagaagatgttaatgttcgcaggattgacagccactgagtataaaatgtatttagcatatttccaggcttaggatcaatagaatggtagctaaaatataatcaatgatttattaattcattgatttattaaacaactagttaatgagtaccactatgtggtaactctggtgctacaaggccaagaagttgcaaactaaacacttactctcaaggagtccaatagtgaaacacaatgatatctgaacagacagttgtatccaggatgcccccccacccccagctatggcagaggaaagcacaaaggtcaagttttacctgctccaactcccaagtaaggatagctaacacccacagaggactctacaacttgtagagcacacggagcatcattaactttaccagatatcaatagcaacttcaactatgaaaaacatttttggctgggcgcagtggctcatacttgtaatcctagtactttgggaggccaaggcagatggatcacctgaggtcaggagttcaagaccagcctggccaacatggcgaaaccccatctctactaaaaatacaaaaattagctgagcatggtgatgcatgcctgtaatcccagctacttgggaggatgaggcagaagaatcacttgaacccaggaggcggaggttgcagtgagtcgagatcacaccactgcactccagcctgggcaacagagtgagactccatctcaaaaaacaaaaaaaaaaaaaaaaaagaaagaaaatttcaaaagtgaaaatataatagacattggcgtggatgtggtgaaaaggaaacgtttatacactgcttatgggaatgtaaattagtacagcctcttgggaaaacagtatggagattttttattttttattttatttatttcttttttttagatggagtcgcgcactgtcacccaggctggagtgcagtggtgcgatctcagatcactgcgagctcggtctccggggttcacgtcattctcctgcctcagcctcctgtgtagttgggactacaggcgccaccaccacacccggctaatttttttttgtatttttagtggagatgggatttcaccgtgttagccaggacagtctggatctcctgccctcgtgatccacccgccttggcctcccaaagtgctgggattacaggcatgagccactgcacccggccagtatggagattttttaaagaactaaaagtagatctaccattcaatccaggaacccactactaggtatcacaattcacaattgcaaagatatgaaaccaacctacatgcccatcaacgattgagtgtataaagaaaatgtggtatatgtacatcatagaatactactcagccataaaaaagaacaaaataatgtcctttgcagcaacttggatgttgctggaagccattattttcagtgaagtaactcgggaatggaaaaccaattaccatatgttctcatttaataagcaggagctaagctatgggtacataaaggcatacagagtgacataatggacactggaaactcagaaaagggagggcggaaggggaagtgaggaataaaaaatgacatattgggcacaatatacactactcaggtgatgggtacactaaaatctcagacttcatcactatacaattcatccatgtaatcaaaaaccacgagtaccccaaaaactactgaaattaaaaaaatacttacaaataaaaaaaagaaaagaaaataatttttggaatacccacttacaaatgaggaaactgagactcagaagcatttaggtattttatagttagctcttttcccagttagcttttacaatcagaagagctgagtttcagttatgtttctacctcttagaatgtgcctagagggtccttaaaatatttactcttcactgtaacctaattgatcaaattattattatccctaatatagaatatagaaataaatgtccaaagagatatggaaacttggtggagataatattctaatatttaccattttaagtcctctaatttagtagtcacaaaatacctggcttcctacctgcaaaatgatagtgggttgacctgtctgggtctacctgcagtcaaccaataatgagttataatggatacattttttaaaaaaaattcctagaagaaataggaacagcaatgttttatcattagcattccaaaatatgcaaggatacctgctgtaaacaaggcaaatatttggggcagcaattattagaaatgtagaatgttagagctaggttgaaaatcagtctgtctagtacaaattctttttcttaaaaatgagaagaccaagattctatgaaataaaacaatttgcccaagatcacacaattagtggcagtgctaagtttagaacacaggacatgctcacacctactctcaatatgcacagaacatactatttacttctcacaggattcatcaaagtgataatgtccctttttactgttttgattgtctttgcaaaagtttgagggaaattcaagtaggtgaagctatttcaatttgcatttagaatttctaacatttctagaaagtactttgaaacttgagaattaaatttaagaactggtagcctgtaaactcaaattacccctattatcatctgattggagcatatctgaatgttaactattctttactgcctcctgaaaatctgcaaaagtgatctttgcagtatggtgcaggaagctatctattcttaaatactgactaattgctgaaaatctcacttccccttttctctaatttttgacttggcctcaagccatcagttgtgcttagactttgggacacagcccttcaccagtctttttccttcctgtttccatttacatcctgactggtatctcatgggcactcagttgcataatcttctaaggcaaacaacaagatggttgctaactattccatggaatcctgttcccagaaacagcacaaaactgagatgaaatgcagtgaagagctactcaagtccaagacaggaacatagatttggttagacaatctcagagcaggctttttcctaaccctagtgcatctttcagtggaccaacaccaataccttctggcatcaagcagagaagaatgtatggaacatgccactaatggagggaactcacatttaatgagatcctactattcatctggagcttcaaatatcttcttccttgcaataagtctatatgagataaatatgtgagggaataagtttttgtgaatgctggcagagctactgttcaggaatttcctgaactctgatttcctccaaagatcaggtatggccttgatgatgagaagactggcataaagccctgagaaaagttgtatcttcattcccttaagaggaagcatcaactgcaaagactgctcttgaatataatgcaaggttcaactctaaggggataatggaaaacaaaatagttgacttctcagatatggtaggaaactattcttcaaggacaaaattactagcaattcttcatgaccactctacttctgataaacttatgctgtggttaaatactataaactcaatctaatcttaaactagcatatatgtgtccactccagtctaaaatgcagaagtactaataaccccatttaccagatgatacggtttggctgtgtccccacccaaatctcatcttgaattgtagctcccataatcccatgtgtcatgggaaggactcattgggaggtaactgaatcatgggggtaggtttttcccatgctgttcttgttatagtgaataagtctcagaagatctgatttttttttttttttgagatagagtcttgctctgttgcccaggctggaattcagtgacatggtctcagctcactgcaccctccgcctcccaggttcaagcaattctcctgcctcagcctcctgagtagctgggatttacaggtgcccaccaccatgcccagctattttttttttttttgtatttttagtaggagagggtttcaccatgttggctagggtggttttgaactcctgacctcaagtaatccacccttgtcggcctcccaaagtgctagaattgcagacatgagtcactgtgcctggccaatctgatggttttataaagggcagttcccttgcacatgctctcttgcctgctgccatataagacatgcctttgctcctccttcaccttccaccatgattgtgaagcctccccaaccatgtggactgtgagtccactaaacctgtttttctttataaattacccagtctcaggcatttcttcatagcagtatgaaaatggtctaggctgggcacggtggctcatgcctgtaatcccagcactttggggggctgaggcaggtggatcacctgaggtcaggagtttgtgaccagcctggccaacacagtgaaatcccatctctactaaaaacacaaaaattagccggacatggtggcaggtgcctgtaatccccactacttgggaggctgaggcaggagaattgcttgacctcgggaggcggaggttgcagtgagccaagatcaagccactgcactccatcctgagcaacagagcaagactctgtctcaaaaagaagaaaaaaaaaaaaaaaaaagaaagaaaggaagtggtctaatacaccagttgaagaaaatgaggtccagagagggcatccttaaccacagcttggacagattaggtatccatctcaactctatcttctttacaaggataaataattcagaagagaagaggatgtagaaactagggcctggcagggagtgtcaaatcaatgaagaaagcaggtccaggaagtagagagaagagggaccaaaattcaaaatctcaatctgctctagtgtacaggcctatttcaggaacttagcacatcaagttgatgtttgtcattatacactggcttggtagctacaccttgatctttgccctactacaacgagtctaataagaaaaatggcctgaagatattttcagtctgatgatatcctgtagagttttatgtttggagagatggggaacatggatgacttagttcccaagagcagaagtggcaaattgatggacctcaggccaccacgctagctagtatagctaagctaatcaggacgaccatggatacagccattacagatgcaccctgcatcctgcagtccagacagtagctgatctcacactattccttcctccttcccacatgcttcctggtgacaggaggagcaattgtatcatgtgcttagatggcccaaagaataagcaggcagcaaccatttgagtaacagttttgcggttctgtagattccataaaactactcaaataaacaaacaaagtggttattctaagcagagtccacaaatccctatgtcatatcagcatcagaacatcaacccctgacttctggggagctgccaaaatgggaactcagaggccagacctctattaacagtgcagcacttggtgtcagcaaaactctgactgctaaggttattgtaggctgggacatcctgctgcctagcaaaagtatagtctccatgttgtgacattaatttgttaagttttgaagagagagattattgggactgtgtttttgtaaccctaaagggaaaacgtcccatgtaatgtagaaggaagagaatagtgtaaattctgactcgtttttgaggtcagaagtgatagattcctaattgggagaagggcaataccaaatttaagaaaaataatctaggaaactgacagataatggcaaaattagaaagaaaactgacatcacaataaataccaatcaagttccaaagatttccggacatttcccttgccccagcaaagagaatgtattcatcaacctgcaggcatggctaatccaagtcttcgattatttcaaagggtatacgtttggaataatgcaatgaatataaatttcccaattaatttggtttaggattggagatggggaagacaaacttgtgaaattatcttatttctttcaaactcagatagttcacactggtctgactcaatgttctcattcaaaaggggcgatgatgcaggacattcaaagataaattcctttcaaaagtctttttaaagttttggtccccagaagtgatggcagaaataaatatacatttctgaaagaaaacgcagtcctgtgcctttcaggaattgattgcatctcctgcttctgcaagctaagaagtcataatcctctgcaatcacagattgtttgaagccaataaaccaaaggtgatgaccttgctaatacatcccagcaggagaaagaaataaagctgtgctgaggaataactcttcagcacaccatttccctttggaaggaggagaagagctgaaagcaccccagcctgatttatggaggagcagtactgtatttcggaaacttcacctgaaataagaaaaaggtttttctaaagttctccagtactattgctctcatcttcctcatcctacgatataatgcctgttgagccatggatactcgcttcagtgccacacatacctctggtggcctttgctcaaagttgagccaggtccgtagtggagacctgtgtcctgtttcctaaagtgaactgtcaggagacagcacaaggtgcagcccttgggactgggaattcaatgcgccagacattacatttgtatttgaacaaatgtacctctgctttagcattagataagcttccagcactcacgaaagcatcattacagacattcagcatagcagtgtcaagcaacctgctgaaattaaattaatatctgtcacctccctcaagtgcaatgacaatagattagagcaaaacatgacatttgagtaaactatattctgttaaccattgattacttgtgataactaatatgggacatgctttatatgaattaaacccacagatgacacagataacatatttttaaaaaatctcctttcctcattacatttaacttggcgcttcttgttactgaacatactactatgcaccaaggtctgtacttggtgttgggtatacaaaaatgaagaaggtagcatgtgtccttcgaaatgttcctggtaaaggtaagagatgaatagaaagtgcttacaattcaaaccaatacattcaaaaggaaaaatatgtaaaacagagcacatgagcagtaatttattctctgtgtggcttctttttaagaagccattcatatctatactattaaaagtaggcttggctggacatggtggctcacgcctgtaatcccagcactttgggaggccaaggtgggtggatcacctgaggtaaggagttccagaccaacctggccaacatggtgaaaccctatctcaactaaaaatacaaaaattaactgggtatggtggcacatggctgtaatcccagctactcgggagactgaagcaggagaactgcttgaacccgagaggtggaggtttcagtgagcctaagttgtgccattgcactccagcctgggcaacaagaacaaaactccatctcaaaaaataataataaaaaaaattattctctgtgtggatagagatggctagggaaggatcccacaaaagatggtccttgtggggttcaaagcctgggctctggagctcgactggttcagatctcttctttactgcttagtatctttatgaccctgttcgggttacctccctatgcctcagtttccacgtctacaaaaagggtataacgatagtaccaatctcataaaaatattttgggaatttgttaatacatataaagcacttgaagccatgcctggcatatagtaaattgtcagtataaatggctatcagtattattttgtaggcaaattgaatagaaggggaaaggcatccccagcaaagaccacagaagtacaagatccaagatttgtgtttgtctgttggtgttgtattattaatgtatgtttagtaggtgatccacactcaacatcagtgtcaccataagcctattagataaatatactttttctgatgaggaaatggagcacagagacttaaaaaaaaaatctccccacagtctcagagctagtaaatggacagagcctggattcctgcccagacagcccaaggccaaagcccacgtgctgacccatgacatggatggccttccaagggcacgtgttgccttggcagaacctataagtagttcaccgtggctagaacacacaatacccttcctttattgagaattttagtaagtgaaatgaacaataccaaggaatgtggctcccagtaggagagggattggagaagccaaagtaaggtcaacttagactccagaaaaccaaactctaaaaaatatatttttaactataaaaggaaaagaaattttggaatgggcttcagagtaaggagcagggtaaaaaatggtgactagcaagaaaaccagtattacttcagcctaatatctgagcgactcactctgtgttgacaatggtatcacagggactgccggttgtggttaatctgtaagtcttagttctgggaatagacagttgcctggagaaaatctcccataaccaggatggagaaggctgcttagtgttccccaaaggtgtggaggtgggttgtcactcacaaataactcagggatgtggggggaattgacaagtagatctagttgttccatataaatgcagaaaaatagcagtgccttctcctagagagctgagtgaatttcttaaaagtagcttttataaaaggcttttctgattaactccacctgctctgaccagttcccattcacagagttccccggggacaagacatgttccaagttttataatacaaaaattcacactcctctgggtattattttttaagtgttcttcaggctcttaaatatgaatggatcgaaggtcctactgtttcactgtttgtcctcctcccacctccggcttccctttcttctttctctatttggtcaagacctcttatctaccactcaagcccctcagttccccaacctcttgtccttcctcctggaatcataaccaaatgccttcttgtgtgttacacaaggctcactggaacaaaaaaagcacagtcatgctgaccccagggtgtggcttcatctggatctcagcattattcagcacagtgcatgccagctcctgagctgtccctctcctgtcttctcagtgactcttccaaaatgtcaagtcccatctcacgtccatctcccactcaacatacaaccaaatggcaggacaccccttaacccacatggctcaggaaagctgatttgtgggagtccctatcctggcatccttgcctcctctcttggtaaaaggaaagctcccctcggtccaccccttgccctccctgatctactacgactggataattcctccacctgaccttggattccataccttctctaccactcaattctctatcagttctctatcagttctattctccactaatttttctatattttcagtctcttttcactgatttctccctgggaaatgtaaacatggccaggtttgttctcacttaaagaaaggaaaatgttcctttagtctgtcacctcctttctacaaaatcacgtctcttccttttatttcccttcacagctccttcttgagagagctgtcttcatatcctgtccctattccctgactgctcatccactagtcagaggtgctcagtgggcatcactaggacagacagatgtaccttctcagccacctgttacccaaccttccctccggcacttcagctgagccaatgtcttctgcattgataaatttggtggctacttcacacatatttttcttacttaactatctgtggtgtttaatgttcttctcacttgttcctctgcctaatttttcttccaactttcaagcagcagcaactccaactcctcctcagacttctgtatgtctaggaactggggatctcctcagtttttctctcattttcttctgcacactctccctaggttcctatgaacacagcttctactgcttgagctcatgccttccaaatatgtcttcacatcagtccttctgcctggactccaaggccatgtatactttaattatctgaaaatttccatttgagttgtctaactctatctcaacctcaatctgttaaaaaataaattaataggccaggtgcagtggctcacacctgtaatcccagcgctttgggaggccgaggtggccggatcatgaggtcaggagatcaagaccatcccggctaacactgtgaaaccccatctctactaaaaatacaaaaaaaaaatagccgggcatggtggcaggtgcctgtagtcccagctactcgggaggctgaggcaggagaatggcgtgaacccgggaggcagagcttgcagtgagccgagatcgtgccactggactccagcctaggcaacagagtgagactccatctcaaaaaattaattaattaattaattgtctcttcacctcatccccatctcccattccaaaattgtcttcctccgtcttctcctagaaaataatctcaccatcctctggaatgtccaagacaaaagtgagaaagtcattgcagatatgtttctccctttcaccttctaactcacccaacaactggtcctgtgcttctttcccttacaaaatctattaaaatcacccccacactctatatgtcatactccatttttccactctctaaaaaggttggccccttctcatctcttacttcttgtttcactgactactttgttcatggtcaccagttttgttctttgccaggtgaatccataacatgacaccaaggtaattttttgtgtgtgaaattcatatctcatcaacccttttacttgccccagacctttcaaagatgcattagttcctctgggataaatgtcagaatacttagcacagaactgaccaattgcacacacagactgtattgtgatttagtgcaatttcctcaataagccatgctgccagcacctagaggcgcctgaaatatgggatgtactcactaaataatcagcctcccttactagtctaattcctactccttctttggattcagttcaggtctcttctcctccagaaagctcttccttccccacccagagaacctatggtacttctactatggcacttgacatactgacataatctctcatgtatttatctgtctccccaacaggctgcaaattacttaaggacaacaatatgatcttctttgtatctggatttataccagttagcatggatctatgtatgtacgtatttatacattcaattaatttgccaaatttcacctgaatacctttgtgccaggcaatttcctggacacagaaaataagacagacaaggtctctgccctcagcgagtttatattttaatggtggcatcagacaatagagaagtaatgaataaaatcattctagatcatgacacatgtagtgaatgaaagaaacaaagagagctatggtagaaagaagcaagaaagagccttcttttttttttttttttttttttttttttggagatggagtctcgctctgtcactcaggctgacatgcagtgatgtgatcttggctcactgcaacctctggctcccgggttcaagcaattctcctgcctcaaactcccgagaggctgggattacaggcatgagccaccacacccagctaatttttttgtatttttagtagagacaaggtttcaccatgttggccaggctggtcttgaactcctagcctcaagtgatctacctgcctcggcctcccaaagtgctgggattacaggtgtgagccaccatgtccagccaagcctacttttaatagtatagatacgaatggcttcttaaaaagaagttggtatttggattatgacctgaaaaatatggaggatctggtcatgctgaaagaataaagagactttgtgttcctagaaggtatgaaattgtgttctgaggatcttctgactttctttgtgcccaatacaggacactatactcaaatagcacttaattttcattgtttgattgcttattaagcttaaattttgacataaaaggacaatccaaaacagtaaatacataggaaagccttctgaggaactatgaggatgtggaaggtaactggatggtggtgatctgtatctcaagggacttcacagatgtagaattttaccacgtggtgttcataccaatgtactaaaatgggaattaatattctaaatgcttcctgaatctataaccaggtttgatatcagaatgtcagttgctttgctttctctagtaaaattttttgcctttgctttctcagcttatattggcaaagttattaggacctcaggacagtgtttgctttctgtgtatttcatctattacttgctaaaaggaaaagtggggaactcagcagggtgtcaatcactgaggcaaacaaggagagcaggggtgcaagctgaggccagactctcacagatggtctcacacatctcaggaaggtctatagcatcttttggatgaatacatgcagatccttatagaacgagctttcacatggtgagttctaagattttgttaaaatcaagggggctgaacaggaatgcctagagctctgtggaaataacagattcctgccttgaatctctgggcttttcccacttggcactggttatgctcttcttctttgacagcaatgtcatggaatttctcgaggtcacgtagcacattattcagaactgtatcacctacacataaggcagtaggttaaaaatttaggatagaaacaagtgtatgacataggcctggctttcagtgacactaaatcatttcataacatactcttcaaagcaaaaagcatttaatgatacttaataagaccagttctattttgggtatgaaccaaatgaaaataagacatggtcatagtctttggatttccaggttagtatgtgatatggtttggctgtgtccctacccaaatcttgtcttgaattgtagcccccataattcccacatatcaagggaaggatttggtgggaggtaattgaatcatgggagcgggtcttcccccatactattttcatgttagtgtgtaagtctcacgagatctgatggttttataaatgggagttccctgcacaaactctctcgcctgttgccatgtaagacgtggctttgctcttccatcattttacaccatgactgtggggcctccccagcactgtggaactgtgagtcaattaaacctctttcctttataaattacccagtatcaggtatgtctttattagcagcacgggaacagactaataatacagtatggaaacagacaaacatcacaataacttatgcatacattttaccctgcatttagcacacttctgtaactatccactgaaagtctgctcttaactagatttggggtttctgtaggacaggaacaattatttacttatatgcttattcccactgactatctagtacactgcttggcatggcatacaggtaggtctaagagatgtttgttgaacaaaataaatatacatctgataaccattataagtcaaagatacataattcactacaagattaatgagaaagaagcaattatttttgcctgaggagtgagggagaaagagagaggtccacagtgccacagtccaatacacatatgaaaagatgatcaccatcacttgtggtcaggaaaatacccattaaaatacactgagatcaagacatcactttcatccaaaatactgatttaaaagttacgtattgaaaattccagtcctgatgaaagcctggggaaatctgcaaactattattgcttgcacgtgtatgatttgttgcaaccttcttggaatgtaatctcgagtatcatttacaatacaaatgcattcatttttgatacaacaatatcatcttaagaattctattgtactttataaaggtaaaattaccaaagtaaaaggatatgtttacagatatgtttatcggagcactgtgtgtagtaacaactcttgacgaaatgaactaaagatctatcggaaaggtaatggagaagcagtgtagcacaggcattcagagaatagtcaggagccagctctgtctgactagctggctgtcagaccattaagcatgctactaaatctttctaagtcttacttctctcatctagaaactggagctacaggctgggcgcggtggctcacgcctgtaatcccagcactttgggaggccaaggtgggcagatcacctgaggtcaggagttcaagactagcctggccaacatggtgaaaccctgtctctactaaaaatacaaaaaaattagccgggcctggtggcaggcacctgcaatcccagctactcaagagattgaggcaggagaattgcttgaaccagagagaggcagaggttgcagtgagccgagaacatgccatcactcttcacaagagtgaaactccatctcaaaaaaaaaaaagagaaaaagaaactagagctacaaacagtacctattttatggggttgttaaaaggataaaagaactgaaaacacttcttggtatgtaggaagcaatacataagttaattaagcatgcagttgtttaattcgatatactgtacaatatgcatactctgggatgcttacaagcctggcccatttttttcaatgcattcatctggatagacacccaagagtcattggtaagtgaaataaatcaggttgtcataatccagtgaatagtatacttctattttcttaaacaaatgaaaaagtagacctatggtatgtatatatctgttgacactttttagttgagtcacaaagatatgaagagaaaaaaaacaataactcaccactacagatatcaggaaagctgaatctaggtggtatgtaagaaactatttacagttttttgaaaaaaaaaaaatgtatctgtgttttttctggctcattgtaatgagcatacattacttttgtgattttttttaaaaaaacatagtttagtaaaataaatgtaggcagggtagagtggctcacgtctgtaatcccagtgctttaggaggctgagttaaggggactgcttgaagccaggggtccaagaccagtctgggcaacaaggtgaggccccatctctacaaaaaaatttaaaaattaatctggcacagtggtgtgtacctgtagtaccagttacttgggaggctgaggctggaggactgcttgtggctgcagtgagctatgattattccactgcctcagtgacagagcaagaccctgtttcttaaaaaaaaaaaaaaattaactgtaggccgggcgcagtgcctcacgcctgtaatcccagcactttgggaggctgagacaggcagatcacaaggtcaggagattgagaccatcctggctaacatggtgaaaccgcgtctctactaaaaatacaaaaaaaattagctgggcgtggtggcaggcgcctgtagtcccagctactctggaggctgaggcaggagaatggcatgaacctgggaggcggagcttgcagtaagctgagatcacgccactgcacttcaacctaggagacagagaaagactctgtatccaaaaaaaaaaagaattttaattgtgtaagttcaggaaccacaaccagctccaagtgacacaaatatggaatgggagttacaaaacacaaaagaatctagaatccaaaaagccacaatccagaacacctccggatcctgcctgaacgcttgactagctcccttagactctggagaggtactaaacatttgtacgcacaggtgtgaacagcatcattaaatctgtgtgacatgaaggattctcttgcctggaagttatcacactctggttttattattattattttttctttttaggatgtgcatatagccttgtgtttgtagcagagtgaaaactggatttggtagcaaaacatctttcaaagcagggactaacaatctgacccaagccacccactgctcttcccctggacgtggcgtggaggagaagggaggcgttgggactcactcacagggcttgcagagggctaacaaacacacaggtgagttccctccagcctgaacctagggagttctccagagagcacaggctgccctcatccctacacagcctctgactcaaggccattattcacaaacactactggggaacttctcttgataatcatgatgcgtaatggccacgaaattgtgtctcctgagaaaatgggacagggctggctaccaatacagaatcacatcaaaagcctaacacattctctctccttaaattgcacttgctttgtgcccctccaaaagcaggttttgctgtttgagaagtacatacttctggagacctacttagaagcctgcttgtgtcccatgtggatctgagaacaggacactgaatttgagaagtcagccatgtcaggcaacctctaagatagacagacactgcaggttgtgtgctgctttaagagagtagacttccagctccttccagaattgcctagggctttctcaccagctaagcctctctcaacagagtactgattgccctagtataacagggaaaaaaaagatgaatatatttcttctcagaagtaccatattctagattttgacaatttatctatctcaacctttaagcttatcttgtaccaatatgataaaaccaccacgctctccaattctcaaagcttaatccactataaagtgaagacaattttaaggtgcagtgaattgttctgcatcaaatcatccccctttcctctcattttgactccctgagtgaagaacaacacaaaacgaaacaaaaatcaccaacttgctccaagattaatgtgtaatcaatgacaagaccaaccgggagcaaaagctcattaatttggtacagtgacatctcgttctgtcttgcctggtttgttgatatccagcaaggcttacagccctaggacatcactataaggtcaacagcctcttggcctcttgactaccctaccacctcaagggcatttgccagttgcccctttctgactcttcagctgctaaaacttgtaaagaataagggctcaattgaaaagtgcacgtatctacttgttggacaagaagccatttctctgtcacccagtatttttcaggagtaaggcaattgctgctcagaatgttacagcacgtagaaaaccctattcactctgtatatggtgtttgtacgtgtgtgtgtctgtgtgtgtatatatatacacacaatacatatatagatattatataataatatacacatatatttctataaaatatcctgttgcttgtttgggtatagaaagatccaccagaaggcagagctctggaagacagataagcaatgaacgtatggagttcagtaacatgtctgtaagtctataggctactacttgctaattgtgcgaccttgggcacaccataaaaatgaattaagaggatgtaataacacatgtctaacactcagcatcatgccagacacacagtgaatacccaataaaggtttccagtattgtcattattaccattatcattattatcactaaacgagcaaggtgttgggttcaaggactcaaagatgagttacgaagagaaaatatccacatgaggaaagtaaagaagcaacacttatctcatatttttattacaacacttatggttgtgtgaaagtctatttacattatatctgtcttattctgggatctggcatttccgggcggctgcttcaataacttattcaatacaattacataaggagggatacatgcaagtgtatttccctctcaccttgactgtccacagatctttgtccccctctaaaaaggaacatctggccgggcacggtggttaacgcctgtaatcccagcactttgggaggccgaggtgggtggatcacgaggtcaggagatcgagaccatcctggctaacatggtgaaaccccgtctctactaaaaatacaaaaattagccaggcatggtggcgggcatctgtagtctcagctactagggaggctgaagcaagagaatggcgggtgaacccaggaggcagagcttgcagtgagccgagatcacgccactgcactccagcctgggtgacagagcaagactccgtctctgaaaaaaaaaaaaaaaaacggaacacctggaggacagagcctatctgctgttgatctaggtacacacacaccttcccctcactggaccagatcattccaaggcataaaggagttaatcaatacaacactgttgaataaataaaagaaataaaatacaatataataaaattatctttggatgaccatgaagtctgttgtgctcactgctctgtttaaaaacacagttactgagcactagctatatgctaagtcttgtacttggggccatgggtaccttgcagatgtctaagacttgcctgaggtcatagtccccaatttttggcataggcaggttttctgagcataaagtactgaaacctccccaatagtcccatagacacttcttttggataaaaataggaattggcccttcctgtcttaaagcttgaaacttaacatttgtttcatctgagttccctcctcaggaaaggccctggaagcctctcaaaaagtatcaaagaagtaaaactcactagctcattgcattcagacaatgagatgccaggcctctcattttatctccttacccttccctagttcctgttttccaacacagttacatttcttccctgctatgttaaacccctaactttagtgagtcagggagatggatttgagactcatctcccatctcctcagctctagcacccggttaaagccttcttccttggcaataatagttgtctcagtgattggctttctgtgcagtgaccagaagggctgagattggatccctggtgttttggtaacagtatgagctggtgcaggagaaagtcagtttgtgctaggccacctagtttccctcaagcaaggctgtgctagacaactcagaaccataaggctttctcttcctgagccctgtcctctacccacccaggcctgtcccactcctcctctgtattaacatacctatggaggtttcctaaactcttgagtacgggcactgtgagctgttcaaaagtcctaccgaggtttcatatatgacacattatatattatattatattatattatattatattatactatgttatattatatattataatatgaagtattatacatatttttccaccttattctctgttttctaaattacattttcagtaaggtatgtgtcattcctattaaagtactaaaatgaccaggcgtggtggctcatgcttgtaatcctgagagtttgggaggctgaggtgggagggttacttgaacccaggagctcaaaaccagtttgagtaacaaagtgggaccctgtctctatcaaaataataataataaaaaattagcctagggtagtcgcaaatatttgtagtcccagctacttgggaggctaaggtgggaagatcacttttatctgggtgtttgaggctgtagtaagctgtgatcatgccactgcactccagcctgggtgacagggtgagattctgtctcaaatactactactactactaataataataataatttaaaataaataaaattaccagtttctaatatatcacatacctgaagtagtcacaccagtatatgacatatggcaaatgactattaggcgtatattttagaaatatattatgtatctgtgggtatagtgtgtgtgtgtgtgtgtgtgtgtgtgtgtgtgcatgcgtgtgtgtatacgcatggtcatctctcagtacctggaggggattttttccagaatcccccatgaatactaaaatccgcagatgctcaaattcctgatagaagatggtgtagtagttgcatatgacttactgaccttctccttggtatatttaaaatcattcccagattacttgtaacaccaaataaaatataaatattatgtaaataattgctatactgtatttttttacttgtattggtgatagtgttgtgttgtttttaaatttttttcccccaacagttttgatccaagatgggttgaattaacagatctaaaacccacagatagggaaggctgactatatgtatatatatatagtcatgtatcacttaatgaggtggatgaattcggagaaacatgaccttaggtgagtttctcattgtgtgaacataatacagtatacttacacaaacctcgaaggtatagcatactacttatgtaggcataaggtacaccctattgttccaagactgcaaatccatacagcatgttactgtgttgaacactgtgggcaattgtaacatcatggtatttgtgtatctaaatatgtctaaacaaaagagatacaggaaaaatacagtataattttatgggaccactattgtatatggtgtcattgactgaaatggcattacgcagtgcatgacagtatgcatccttcagtgaaattcatcttaagattgagaagccagcaggtcattcgcgccacactttcccagatttcacccaagtagactgctccttcagaagggaagcctgatactaatgggatgtgatgccattttttaaattaaccctttccactaagtttgaaaaggacattcttcttagactgggccatcagtaacaatgccccttcatggagagaaaagcatactgaacctgagcttccacagtctagggcaacctgctcctcaggccctgcaggcatgttctttccactgtgcaggtggagagttatgactgcgtaagcctctgtcccagtgagacaaaactgcattatctattaaatttctaatatgcagactatactttatatggaaaatgcactgcagaaaaaaatgctggcttttactcttatacatggagatccattagagaaatctatcagggaagtatgaagttgctcagagtcacagagattctgatgaagggttacagaattgaagcaatatagtaggtgcgggctccttaatgcacaaaaaattatacttttattaagtcccctaccaaacttcccacactttcagttacatccctgtaaccagggactatatccagaactggaagcttagttttcaggcttcaggctgtcttgtggcttgaaggttgggtttcattgggggcttgtccctatctgcctaggaatttgttggccttctactactatcacaataatttttcaaatgaataggtacaaatcccttagcgtagaggagctccttgaataccagcatgactgggcagttgggctaccatgggtctaaaatcatggatgggaagctcctccgagacccaatatgtttttctctttctacctacggcctgcacctcccccattttgagcctataaaaaccctgccctcagccacacgttgggactacccgccttctggtagggactacccactttgggtctcctctccactgagagctgttccgtcactcaataaaactcttcttggatgcaggacaagaacctgggacccacccaacagcgagtgagaaaggagctgtaatactgtagccttcctgtcctctgttggcgccaggcagctgccccacacaacgggaagtagcagtggcgctgggccagcctaggaggcatgggctagagcagagcagtgggactgaacgagctgtaacacgaatgaggtgaaacccacccccaccctgtttgctgcactgtggctggtgggaaggagagaagagctatgacccttctgggggcctagacctcggctccccaagccagggctgtgttatgctgtaacaccccctttgcagttccatgattgctggtgtccccgagtttttaaggcgccaccgcattcccctcgtccagacaccagcgcccaaggcggaggccccttgtcatacacctggtccagccacagccttgcacagagccaatgctggagctgcccaccccatcacagcagctggcgcacctggcttgcccttggcaggcatgagatatcaaccagtagtatgagctgagtgcagcctgatgggctaagtgggcagagcaagccctgtgggcacaagcaaaactcaagcagaggcactgccggctgtggaggtctctggctggcgaagaggcactgaaaaaatcctgtatcatttccatactctatatgtgtgaagcaatacagtgtgaatcccaaagataagggtgtgcatgagtgtgggtatgcatgcctgtgctgctggtgagctgcaggaccaccatggaagggaagttagtaaaggaatgttgccctgggccaggcgcggtggctcatgcctgtaatcccagcattttgggatgctgaggccagccggcagatcacctgaggtcggaagttcaagatcagcctcaccaacatggagaaaccacgtctctaccaaatatacaaaaaaattagccaggcgtggtggcgcatgcctgtaatcccaccgttttggatggctgaggcctgcagatcacctgaggttggaagttcaagatcagcctgaccaagatggagaaaccccatctctatcaaaaatacaaaaaaattagccatgcgtggtggcgcatgcctgtaatcccagctactcgggaggctgaggcaggagaatggcttgaacccgggaggcagaggttgcgctgagccgagatgcgccattgcactccagcctgggcaacaagaccaaaactccgtctcaaaaaaaaaaaaaaagtttccctggtagagagcctcgttctgcagacctagaggctgtgctgattcttctgcaaagagacttccagtctcacttctgctccaataaactcacaggtcagtgagacagtgcataaacacaacctatcatacaggttagcaaaagaatctggctgactaaaagaattggtctataaagaaagtaaagctctggcctgcctggagataaagcccagcgcatcactaaaggaaacagagaagaaagagagaaagcaagcagtgcatatcaccaggaaccttcctgccaggaaaaagtgggtgggacagcagtagcaggcatcatgcttaaataacacggtaattattagctccatttatctacatacctccaaagcgagctctctgtgatgctccccaggttatagtcatagagctttgtcaaaatgagaatcacctgaaggcaaaagaagaaatcatggttagtctcaaacaattacaatctcttagaactgaaatggcccaagggagggcttaggattcctttaatagtcacttaacataattgaatgaattgttacagcatttgccacactgactggggaaaggttggcttgtctttctgccttccactgaattgcttaggcctatcctctccccagctttctccctgtcaccctgcagcaagggttacctgctcctgcaggcatttctttccctagtgggtttagcgcttttagggaaggctggcagagctgccaaatatgcacacaactcaggtactcactgagcagatgcctgggagaaaggaaggtcaatgattagtttccagccctagtagctgggtgcattgagcagattacccaatgtgcctagctaccatctttttgggagacagcaaagaattatttgaaagaatgtcagtatgctcatttattaagggggatgaacagtaatgctatctcccaaaagaattgctgtttgaagttaaattaggaaataaatacaaattacatatctattagcatgtggtttttttttgttttttttgtttttttttttggagatagagtttcgctcgctcgtgttgcccatactggagtgcagtggcacgatctcggctcactgcaacctctgcctcccaggttcaagcaattctcctgcctcagcctcccgagtagctgggattacagttgcccaccaccacgcccggctaattttttgcatttttagagatggggtttcgccatgttgggtaggctggtctcgaactcctgacctcaggtgatccacctgcctcagcctctcaaagtgctgggattacaggtgtgagccaccgcacctggcctagcataggattcttaaatgttaattccttccctttgctctatgtgagcttggttttaactttcttctgacttccaatttctaggaaagccattaaatagaagccacattggcagggctaaacgacagcattttaacgagcaaatctatttcatggggtccagataattaccgtgtaatatatttcttatggaaccctccataagaaacagagaaaatcaaaaattaggaacaggtctcaggaaagaagccgtagaattgtggaatgctaaatttaagctatattcgctccacagcaaatcctcctccgaaatagaaagcagcactatttccaactttacccagaggaacctaaactatttcattctttcagaattcaacgaacatttattaaacatttattaggagcccaggattttgtctgacgccagaagagaacacaaagaaaaacagattccgtctatgagtccgtgatccagttaggacagaagcgctcatgaaagaaaagggaagttgataaagagctatataccccttctcagtcacaccaaaacccttcccgttacagctgctccggaagacagcttcttttggtgtctgcagcaatgaacagagtccacctggttatttgaaatacatgagcccaagcacacttgcgaagattccacagagcagtgtgtgttcctaaccactgatttctccaccttttacttgctcttcttacataagggaaaaacattatgggtttgctcagttttctgtcgaagttcgtattttcctcctggtactcataacctagaacatttggcccagcccagctgtttccaactcagcagaaaaatgttgacattgatttcctgaattcttctctgaaggccaagggatcagttctagccacagtaagcatagaacattctaaccttaaattccggggctgtaagctgctgaggaatgctgagtccaagttccactctactagcacagcgtttgatttactgaaggcacaagcatcagtgaacacattcttaactttttaatttcacagcaagcaaactggaactccctgaccttaggtttgttctgagttcaaggaaaaaaaaattacagtaacttaaaaacaggcagagatccctgagtacctgtcatctaaggccgcccctctcctaaactacagcacagcttccttccttccaggtcctgttcaaaacttgcttctttagcaaaacgtgagcatgtgtgaggtgcggggcaccccatggacacatcagatggcatgcctgtggtgggggcatatgcttaacagatccatgtgccaattaagtcgctctcagtgctaaatttcaatcaccgccatcccaggaacgctgatcagtggcagcagggtggctgtttgtttgaagacacagaatgatgttcctactccacctcagtacaattttgccgaataagcctataaatcccccaccaagaaaataggggtgtgggcataaagcatttctaggtagttgctctcctgatacaagaccgcagtaaactaaataatgaagttcagctggtcacaggctgtgtctcccattcttgtgatgagggaattcaaaggtgccccggagaaggaaccctttaacccagcatgtgatggtgtggagccacttgcacaagcacacagaaattgtttaagcaatcccagggcaggcgggcagggaggtagaaaccgctccctgcctcttcttgcagggctagtaaaactgaaatgccagtgatacactcaggcagtttatcaacacagcaccagaagtagagtcctttatgacatttgaaagcatatctgcttgaatcaatctatttaatctttctgttttcagaacaagagcaagaaagaaggcacaactgctaacctttagttttcaatcgattatttgagatttctttttcttttttcccttcactgcctctgtgcattatttaccatcttattactgaacaacgatgcatccttatgttagatatgttttgctgtttgtttgcttttctgtgacagcaatactatttcacaaatcagtttctgttaagggatccagagccaaaatcactacatttaaatgagaaaatgtgaaaaaatgaaattgcctccctattctggttttattctctgttgtttttgttgtatttttcaaactcaaaatggggcaaaatgaagctgttttgtttgctttcgtttttgttttgagatgggagtctcgctctattgctcagtctggtctcaacttctgggctcaagggatcctcccactttaacctccttagtagctgggagtgaggtgcaggacactgcgtccagctttcagtggaacttttcaattaagtgaaatgttgtatgtgcttaaataatatacacataatttatttttattcattcagcacacaattttcatgtatagaaaaactgagttcaagtgtagagtattcaagttcaatcaaaaagcaaagctgttttgatgaacacatatacatctcaaaatgcatatgaacatatatacccccacacaaagtggcatatccatcagcaccccatttatttctgtatcttgttttcattatacagtgttaaaacatccctgattcaaaacaagtggtcacaatatggtactagctttttaaggttcctctctaaatcttaggatattatctttaaatagctatgacccaaattatctaagacttgataacctccacctatgccataccaggacctctgcatccagttatttctgggatttccacagtgacatgcttcaagtatccccctcgccagtctaggacttgctgtcagcacatgacatttgtacttctttcactgtgactccttcttgccacatctatcgcttacacaacttttgggaggaacttcacttggtccatacgttttctctttttctttttcttttttttttttgagatggaatctcgctctgtcgccaggctggagtgcagtggcgtgatctcggctcactgcaacctccgcctcacaggttcaagcaattctcctgcctcagcctcccgagtagctgagactacaggtgcgccaccacacccagctaatttttgtacttttagtagagatgggatttcaccatgttgaggagaatggtctcgatctcttgacctcgtgatccacctgactcagcctcccaaagtgctgggattacaggcgtgagccactgcgcccagccagtccatacttagagagaggatgccagtgcccactcaccaagctgctgttctcaaatcacccattccttggagggtagaagggtgccagaaacagtgccaggtcaggttctgtgcaggaatgggagagggtccaagggagtgggcaagggcttcttctcccacagcactgagccacattttcataacccgggctcccaaactattagtgaccctttgctcaggcccttacaaagctcctactgaataattccatcaactctagccctcactccttctggatagggagttgagaaaccatcacaaaggactctgtgagaggagaatgtcaattacattcctcccttctagccccaacctctttctgcactgggttacagaacaaaagcattcacaaacagatgctggtatatggatgactaataagactgttccactgtaaattaccaaaagtcagtgaaaaatattcttttgtatcaaaacagtagggcaaaaagccttatttacaggtatgcgttgaaatgaactaacctgccagcagcataagacaggcagtctctcctatgccaattatcagtcatgtaacacctttgactatgacagcatggttttattattaacataaaatataatttagaagtgaaactccaaacatttaaggaacctgagaacaccttcctggtaatctggttctacatacagcaacttttgaaaacttgtgtattaactaagtagtagatggtagagaaccaaaatttttctatgcttttctaaacagaagcacaggaattttccatttcttttcttaaaaacaaaaacatagcgtcttcctctcttcatttactaaagaattcaccccacagaaagtgcgatggaagtgaggcaggagactggaggaacttatttcctggtcctggcagggtgaaatgaagaaacctgcagaactagcagatgacagcaaaggcaatctctagttgccctcactgctctccttagcgtaagacactcccaccagtgccatgacagttgagaagttccatagcaacacctgcaagttaccactccttttctagagatttgtgaatagcccaccccataatttgcaagttattaaaagtgggtataaatattgctagcaaacagcccatacactgctactctgggctctgggttagccctgctctggaaggagttgccactctgctatacattgccacttaacaaacctgctttcttctaccatcagctcactcttgaattctttcctgagtgaagtcaagaaccctcccaagctaagccccaattgtggggttcacctgctttgcatcaggaggttgggggggtgtcagtggatttgtaaggatacttagcctgcctactgctcatccaaggatgtcttagaaaatggggacatatcagggctgggcgtggtggctcatgcctgtaatcccagcaatttgggaggccgaggcaggaggatcacctgaggtcgggagttcaagaccagcctgaccaacatggagaaaccccatctccattaaaaatagaaaattagcctggcatggtggtgcatgccttcatcccagctacttgggaggctgaggcagaattgcttgaacctgggaggtagaggttgtggtgagccaaatcgcaaaattgcactccagcctgggcaacaagagcaaaactccatctcaaaaaaaaaaaaaaaaaaaaagaaagaaaagaaaagaaaaagaaaatggggacatatctcttcactcttcaattaataataatttgcattcttgttttcctctatgtccaactgtggaagcagtatcaaatctcaaaagaaacaaaagtatgggcttaggattagagtacacaatcccaaaatgtcttccattccttatggtctatatttccaaatcctgaataatgtagatgatgactaggtcctagtctataaaacagcactatttcttttgtatttctctcaaccactagtgattcagggatggcatgggctggtgcttcgtgtaacacatgggaagactccacagcacttagccatactaatggtcataattgctcttgcctggggtgggccatagtctggcttgggtgagcaagggaacaaccatattgaagatgccagcatgttgggcggtgctgatgctggccacctttgtcctgctcccaccatcttacagcaggccttagtgttttttcattgtccaagctccgatagctacctctctgcttatttcagcagcttgctggagaccaattgtttagacgtatttacagatcctgaggaaagcaaatatgggggaagagaataataaggagcctgaagagatttggaataatctttcatgagaatcaaagagttggataaaataagagagcagtgttcaatggccagaatttttttttttttttttttttttttgagacagtcttgctctgtcgcccaggctggagtgcagtggcacgatctcggctcactgcaagctccgcctcccgggttcacgccattctcctgcctcagcctcccaagtagctgggactacaggcgcccaccaccacgcccggctaactttccgtatttttagtagagacagggtttcaccgtgttagccaggatggtctcgatctcctgaccttgtgatccgcccacctcggcctcccaaagtgctgggattacaggtgtgaggcaccgcacccggccagaaatttgtttttgattgttttcttggcactccaattttagggaaaagcagcaaactcacagcactagttttcttcaaaatatgcatgttccagattgtgtgtctttggctaagtatttatttgactttccaacttaaacagaggttctcattcttttggggacccaagaatcctttaagaatataatctgatacaacttatgggcataaaacaataaatataactttaataatattactcatctcttgaatcctgggggggggccatacatccaagaataagaacttccataattttcagaaaacaagagctttctttagaagaactttcagctccaaaattctgcagatttaatttaataaacatttattaagctttgttaaaaggcaataatttaaaaatacatgctgtgaggatacaaaacaaggaatgatatttgatatgagtctctgaaagctcagtcttaggagaggcagacccatacacaggtactcacgaaatatgaggaaaaaagatgtgaagcaggagggaagtgtttctatctttcaaggagcaagtaagagagatgtaatcaagagatatttcttagaaaaggatgcatttaagacaaatcccagaagatgagtgtgattctgataaagacgagaggtatacaaagggtactgcaaggaaaggaactgagggagaaagctcagagagcattaagaaaaggtcaagtcttctggtttacctaaaggttagagtatgagcagggacccaacacaatatcagaatacagagataggctttggcactattgtggaggaccttaaatattaggctggtagtgtgctctgctcaaaacagaaaaggctttggaaccagaagacgaccagattttgatttttaattaattattttttttataggcaaggccttactctgtcacccaggctagagtgcagtgatgcactcatagctcactgcagccttgaactcctgagctcaagtgatcctcctgcctcagtgtcctgggtggatgggactacaggcacacaccactatgcctggctaatattttattttattttattttattttaactttttgagatggagtctcaccttgtcacccaggctggagtgcagtggtgcgatcttggctcactgcaacctctgcctcccgggttcaagcgattctccttcttcagcctcccaagtagctgggactacaggtgcgtgccaccacacctggcaaattttttatatttttagtagagacggtgtttcactgtgttagtcaggatagtttcgatctcctgacctccttatctgcctgccttgccctcccaaagtgctgggattacaggcatgagccactgcaccaggcctaattttttttagatatagggtcttgctatgttgcctaggctggactctaactcctggcctgaaatgatcctcatgcctcagccccacaaagtgctgagattacaggtgtgagccaccatgcctggccaagaccagattttgagtcctggtttagccaccagatctagtagaatgccgtttgcagcaagaaacagaatgctaatagtgactcaagcaataagtggttcattatgtcatatagcaggaagtccagagtttacgcagttccaggactaatttagcccaacaatgtcatcaaggacctaagcaatgtccacgtgtcccctctgacagtgtcagcactcagtgctacttaccctcatgtttgcaaagtggtcataacacttcttttcatcacctgaagatgtggctatactcagcagagtaaagaaaggcctctggtgtatacatgggtttttgtggtttttgttgtatttttttctacctagggaagaaactctttcccaaaagccctgccggcaaaactccctttaccctcaccaaccaggatcctgccacatgcccacatgcagttcaataaagatggagaaaacaaggaactggtatttccacttgacattttctatgatcagaggtgggttctgccagcaaagaaagagtggggaatggctgctgagtagcaaatactagggtgtaccactgtgtgattttcagtaagtcgcctgagtcctgaactaacttgtagcgtctatttgatgtctactctgtgtgccagatatcataattaagaaatttcaattatctgattgttttatgatgatgaaattgagccacagagaagctaagtaagttaaattactaagccagtaatttgaagtctaagtcacatcacatatggaatcctaatccctgtgctaaactttcctctctggtatcctgtctaatatgggcatgatgattactagaggcaaggcagaaccactgaaatgccctcgctttctgttcatttcaaaaacatttattggagccctgttacctgtcagacatggtactagtcacaaacccttctctcactctgccttcttctagacattgctggaatatattttcctgatcatagacatgcttgagtttttactctttactgacctcaagtcaatggcattttgtggtcattttaaaatttaattattacgttttttaaagttttgaaccctggtaaaatcctcttcaggaactgatccttccatttaaattactggagaacttggctgctgccggatcaggggttcctgacagcgaatgcacatgcagctaactgcagatttccacagatggttttacagtatcatcatttagatttaagtgaatgcataattacactctttttgagttatcaaaggggaaagaaatcaataatggctaagctggatcaaggtgctccagaggagagttgaaagggtgatagaaatacatatgcacgcacacaccacacacactcacacactaacatgtgaagtcaacagacaaaagtaatctggtctagacaaacatacttgacgaaatgaaaaaatggtagaaacagtggactaatttggggtacaagaaagcatccagaaagcagttagtggatttttgcctctgaaaagtatttaatccctaaatgccctttatattttgtagcagcccacacataatttaatgtcatgtttatttatgtaaaatcctctgcatggcactgaaattgagtgaaacagccactgcataccccttgaggaaattaaaaggcaagccaaccaacagtgttgcagacagagctagggacatacagataaccgaatcaacattagacacagcaaattgtagcacatggagagccctcgtgaagagcaaaaaactttttgtaaatttgctataccctcctgactctgtttctccacagagccagaggtcatttgtagctaagacataaaatctgcacctgagttgcaggactcttcctgtgccaggagctgccatgtgagaaatactgcagctctcactcaagggaactcatgggttttctccctttgctgaaagctaagttccttcctgctagtaacaaacccaaaaaataaaaataaaaataaaaaataagcttataataaggttaaaccaaactatcagactctagtcatagagtcaggtctttatattcagtaaataaaactaaacttgtcaaatccactagacttaagttgctttttgatgcaaatcttgaaaataggggacacatttaacctttgacaggttcttctatttcccaagttcagagatgctatccactcaaaaaaaaaaaaaatgcactccctccaaaatctattaatttcacattgccaaaccagagagtctgaggacacttgtcttgtttcctcccctgccacctccttctcccgttctttattttgaataataaaaagagcataattctcaaaatatatatccatatataatacatagctgaccactgcatattcttcttcctcttggtaaattattctgccttaaatgattttgactttttttttacattaaaccaggaaaataagggagatgctaaattaaatattttttctagaaaaaaaccaaatagctgcaccaatgtaatcccaaaagagtagcaagatgagataattatacaaaatgtgaggaaaatgcatattcaagacaagatctttctacatatggatagtaaaatagaaaaatgaaacaggcctacagacccaaagccaaggcttcaagacctgaaattaactggggccagggaatagggggagaagctggcaacttagcatggttgtctccagagctgcagttggaggaaaccacgtagcatatcttgcgcaagcccattgttttatagttaaagaaacaagcgataaatcctgttctcattcccctccagtgcttagaaggggagagagattatattcaaccttctttaagctagtacctactcaaattagctcacctgatacacagctgctcaaacacagaaaatgcacagaattctcagtttagagctgtaaaacaataaggaaatatttattgtattatcttctctctgaaagtctattaaaaaaaaaaagacaaaaaatgccgggtgtggtggctcacgcctgtaatcccagcgctttgggaggccgaggcaggcggatcatgaggtcaggaaatcgagaccatcctggctaacacggtgaaaccccgtctctactaaagaaaaaaaaaaaaaaagttagctgggcgtggtggcgggtgcctgtagtcccagttactcgggaggctgaggcaggagaatggcgtgaacccaggaggcggagcttgcagtgagccgagatcgcgccactgcactccagcctgggcgacagcgagacttcgtctcaaaaaaaaaaagagaaaagatgtaccaatacttaagagggatacaacccaggttttgtaggagcgagatggaagggaagtaagagctggagaaattctcttccaacttccctgatgtgatgatctgagaaagacagatttccatgctctcaaatcagtatctgtctgaattatagacactatctaaatattaatattctttctatgtgagaacccacacacaaagtgaacacactattaagcagcaaactgtgtgttaacgatgaggggcccttctgttcctatgcctttatatatttagcttcaacaggaagaaatgaagcaagtctttccatttccacttcgccatcttgtttttttatgctgtttattcacaggtctgaagaagtcaactcaattctaaaaagtattatttttcaaggttaacacaagacacttgcaggaagccaataaataatgctatgcatattactgtgttccaagtgtcagaacataaacctcaataagaaactggaataaaaactgaaaagaatgcaagcttttaactttttttttcattatctcctctcatttaccataaagtacaactaacaaaagcaacaagaataaaacaccagagagagtcaataagcaagtatcagatcttatcttttactatgggaaagtcttaatgtaggcaagggaggaagaaaaacattttactctcttaagaaattatagtcaatcaacaataacaactgacttctctattagcagatcttttgtttgccttgtctgagtgctaaggtgtggtgagacacaatttgcctaaaaggaaattcaaaacttaaaaaaaatctggcttgaaactaaaatttaggtaacatcttaaaattccaagtaaaatgtattaataaagaacaagactttctgttagggaaaaatcccacggaggttaagtgatttttatatattccttgtcttttagtcacagaaccaaaatgtttccatgtgattctagttctaattctttacaatggcatggctagtgggtgggtataaaaatttagcattttgttactcttttaaaagaaacttaaaattggaagggactggaaagattatctaactccatctaactccaaccacctcatttcacaaatagtgtaggttatacttttagaagaaccagttcctgaataaggaatatctgagagcaaaaaataatcttaatatatcatttgctgattttgtccctgaagcaggcctaggtacagaaggaaggactggattgggccagttctgagatggaagagttgaaagaagtagatctaggaccaggactagacccaggttttgtggggatgaaagttattcaatgttgagcttctctttaagaaaaataatacaaagtcataaagaaaacgagatctaaaacttcatatttactagcccaagaaattagatcacaagaaattaatagtgccttagagatagacatacgtttgttctgagatatgttcaggtggtttagcggaaatgagtatacagaaatgctttccgattccaccctggcttcctctctccacctggaacaatcgacacctcctcaaactcccagcattcaaaggagccagtgcccatgaaggctctgaatcttaagcttcattagcttcactgtaaattcaccttcagataggactccccattagatgctcattaagccttttcaatgaaactatccattttagcagtcctaggctatgaatcaggagatatggacctgagcccaggctccgctgccaatactctgtgacactaagaaagtcaatatactctatggccataccaccctgaacgcgtccgttctcgtctgatctcggaagctaagcacggtcgggcctggttagtacttggatgggagaaagtcaatttacttctttgggcttcagtttcctctatggctgcactacacgtttgcaagggtctcttccgattacaataccattcaatgcggaataccttggcctactctatcttcagtgttgccagtcttagtaggtactattgtcattgttcaaactaagaattctgagtagtcttccttgactctattatccccttcttccctccaaatgtaaccaacatctctttttttttttttttttttgagatggagtttcactcttgtctcccaggctggagtgcagtggcgtgatccctgcccactgcaaccaccaccttctgggttcaagcgattctcctgcctcagcctccagagtagctgggattacagatacgcaccaccacgcccggctaattttttaaattttagtagagatgacagggtttcgccatgttggccaggctggtcttggactcctgatctcaggtgatttgcccgccttggcctcccaaggtgctgggattacaggcatgagccaccacacccaaccagtctctaaggtttatatacctctcccatctaacctcacctcaacctgatctgggctacatcaaccaaaagaccgcaatgcttctgacaactctttttattttttttattttttgagactgagttttgctcttgttgcccaggctggagtgcaatggcgtgaccccagctcactgcagcctccaactcccaggttcaagcaattctcctgactcagcctcccaagtagctgggattacaggcacccgccaccatgcacagctaatttttttttttttttttttttttcagtagagatggggtttcaccatgttggccagggtcatctcaaactcctgacctcaggtggtctacctgcctcagccttccaaagtgctgggattacaggtgtgagccaccatgaccggcctgcttccaacaacttttacagcatcttatcttgctttcctcaggtcaccctttacactgttgccaccacgatattttaaaaaatagcagtctaaacatctttccacactccttaaaacatgtctgtagcctctcactgatcttaaagtttaaatttcaaaatatgacctctaagtaagaatggcctggctcctgtgctcatgttcaaatcagcatcacgccagtgccccatatcctctcagaattccatgtgaactaatatgtaatatcctcttgctgacctaaggaattccagtatttgtggatcgtctgactgaatgactgtggttatattgatgatggacttttccaggcattaacaacatgtttcagttacatgagcaattattgtaactagcctcttgagttgagtcacatcagaataccctgagaaattgcaatctaccagcattgccattttatcaaattccaattttaggaatgacattccaaatactttgaatttcctcttgaaagcttaggctgattaaaggattaaatgttacacataattcaatgctgtgtaactcttttgtgagggctgagtagttgtaaaacatgtctatgatctaatccaaaggtttattgattttcctgttctttcgttcaagagtgttagctttcatgcacagctctgtgggatttttgaaggttggccaggacactgcagagatccactttccattctgtcagtttcttctatctaggaaaagacagccctgggtcagtgcaaatataacagggtgcagattttgaatcaaagtctgaattccagatttttcagctatttcctctgagactctcaaaatctcttcttctgtgtaataggagcaaggccaaatagagtatgtatggtggcagggtgagggctaatgcaagaggttgaaagggctggattctggttacagagccaattttaacactttgtatgactttagttaattcatttaacctgtttttattattaaaggggactgataaaattagaaatccccaggccaggcacggtggttcatgcctgtaatcaatcacgcctgtaatcccagcactttgagaagctgaggcaggtggatcaccagaggtcaggagtttgagaccagtctgaccaatatggtgaaaccctgtctctactaaaaatacaaaaattagccgggcatggtggcatgcacctgcaatcccagctactcaggaggctgaggaggagaatcacttgaacctaggaggcagaggttgcagtgagctgtgatcgcaccactacactccagcctgggtgacagagcgagactctgtctcaaaaaaaaaaaaaaaaaaaattagaattccccttctaactggattatcactaattgactttatttttgatttgtgtcattctcctaagcattctgaataacataatctatccttctcaactatcctttacagcaatatgtcttacctttcttctttttttttttggccgtaaagtttgagtgacttgcccaagatcagctaggtgggggggctgagatttgaatctgaacagtctgagtccaaagctcagtgccgtagacaagagtaaacagacacctgctctcattacccatcatagctgtgtagagactcaccaagctgaaaggtttgagttgaatgctttagagatgaattactatgggaataaagagaaggggacaatctctagctagatgcaggtagggaccttttcaatctcttacaaccagctaggtgcttcacacacagtatgtcatttaatccattctatagcaatggggagatgttttttgttgctctcttacagaagatgaaaactggctggggcttgggtagtatgtatttaatcctggatcttcttggcttctgatctggaagtacggccttgaaggatggcttgtgctagctcttctaccattgaggctgaggggtcatctttgtatcacattcactgagatctccgtggattccacgggcagagagcacaaacccttgctcgaccctcagcaggtataaaacatgaaggggtcatgttcagaaaagaggagtgaagcttctcaagaatttacaacaagaccatctgtcttctcctctgctcagggaagactttcctaaactgaaaatcactccaatgtccccagttcaaagaaaggagatttccagtaaagaaggttaaggaaggctagaaacaaatgatacctctattccaagtgggaactctgttgcaggaatgggtaagtatgtccctgctgcttctctcactttataatcccttaatccaaaatcaagacaccagtgaaatttagaaacccaacaccctgtctgctccagaaaatgcaaatctcccaggaaagaatccacttgtttcctggccttgtgacaaggcttggggccattgtgaatcactctctgccaagaaaaagagccactgttcacaacatggaataagactgcaagggggtcttgtaggtgactcacagagcccctgggggcaggagagacaagcatgtctgctagaactgctgctgctggcggctctagaaaaaaaaaatctattttcttgaaaattgaacctctcctttaggtttccttccatttttttcccccttaaatcgtccaagattaatgtggcaaaaataaaatgccccacaggctgctcattttgacacttactacagcacataaaagtgaagaattagcatggaatgaataatttatttagtgttttacgttgttttaaacaaatcacttccatgaaagcaatgtgtattcaagcaataaatcactgtttagcattctgtcaggaggaaagataccacttggcagaattattgaatggcagtgcctggcagggaggcaggcacaataaagataaaggtgatgtccttgcaaaacaggaatttgtttggatctggagtaggatagggtggagtgagagtcagtcatgaggctttttcttccatttacaagggttaaatgagcacctacttgtgctactacatttgatgttatgactagcacagggtaacttgctatgacatcatagctactgttatttattttatgattgcaattactgtggccaaacatggggcctaagtgatggggatattccattgcaacaaaacaatgagttctatgctcttaaattgatccttggggtcttcagacaactttatataatgtgataagtattatgatagaagtgtatgcaaaatgcctagtagggagacgggaatctggaaaggttttataaagatggtttcactgtatccaggcctatttagccaaaaggctggaaaatgtgaagcatgttcaatacagaaggctttgtgagaccagaggaatgcaaatgtgaagcccagtgatgtttgggtggagagtgaatatggtgatgtggtacaactcagtgatggggaggatggcactgagagaagggtggcaggagaagcttaacaagagatccacaaggatgcagggtgaccttcacacgctctagaggctgtggcccctggataaattggccctagacaccagaaaccaaaaccagattcagtctccaaagcaagggtttgaagctattacttatcagccctgctaattaccaaccctgtctgcagcagaactacagtaggagaaactggctcaggtcaaaagaaagaaggaccctggtactcttcttaaaatcaagtcaaaggtagagctgctctattatcccagctttacgcagttttgagaatgaaaatgcaatccaaggttttgttaagggcggaaacaaaacagttccttgggagctaaactacctcacatgacaaatctcaaaatgtctctactttttaaattgtcaatgccacaaacaaaacctgaggtctaacattcacatcagcaatgcctgcagccctccatcactcctggcaactcctgacagttagtgcaggctgataattcctaccgcttacaacacagaaggccaaaggcttgggttttacacatctggaggaaaagcaaaaccctcccattctgtcaactacttcagggagtttctcaattatctaatttccatctgatttaaataataatagtaacagcatgcttccctcagagtttagagatccaaaatttcccaaccttaccttaaatggtttaaatgagaacaaacttccagtttcttttaggtagtttcaactttgccaacattttgctgaaagctgaaaacaacacttctggctactagaatgaaggtgacaggcactgagaaatgtcatgaatctgacgcttctcatcaccttaaccatatttgctgctttttaaaaaactgtgttggtgtcagcattttatcgggctcagagaaaactcaaaatgctgttggctacaagccagccagaaatgcttcacccttgggaagaaatgaatcaaggaacaactaactattgaaggtttactatgttcaaggaagagctggtagaccctgagggagaaaaagaaatgcacaaaatgtaatttctgccatgcagtaatttacagtctaggtagaatctgattgtcactctcctcttcagaaacactgaaggttcccttgcctacaggattaactcctgattcttcaataagacatccaaagtcctttctatatagcacatatttcctttctggttgtgtctgctgccacttcttgcaattctgcaatcctgtaatactgaccttcttgctcttctttgaaccacaatgaatgttcaggcccccagagctttctcaatttccaatacacagttaaaaggccatctcctggctgggcatggtggctcacacctgtaatcccagcactttgggaggccgaggtgggtggatcacctgaggtcaggagttcaagaccagcctggccaacgtggtgaaactccgtctctactaacaatacaaaaattggcgggcagtggtggcgcacctgtaatcccagctactcaggaggctgaggcagaagaattgcttgaacccgggaggcagaggtttcagtgagccgagatcatgcgatagtactccagcctggactctgtctcaaaaaaaaaaaaaaaaaagccatctcctccatgaagccttcccaacctcttttgacagggaaatctgttgcttcatctgttttttttttttttaattttcagttctggaatacatgtgcagaacatgcaggtttgctacataggtatatatgtgccatggtggtttgctgcacctatcaactcatcatctaggtttttttgttttttttttttttttgagacggagtctcgctctgtcacccagactggagtgcagctgcgcgatttcggctcactgcaagctccgcctcccgggttcacgccattctcctgccttagcctcccgagtagctgggactacagaagcccgccaccacacccggctaattttttgtatttttagtagagatggggtttcaccgtgttagctaggatggtctcgatctcctgacctcatgatccgcccaccttggcctcccaaagtgctgggattacaggcgtgagccaccgcgcccggctgccatcatctaggttttaagccgcacatgcattaggtatttgtcctaatgctctccttccccttgcctctcacccccaattggctccggtgtgtgttgttcccctccctgtgtctatgtgttctctttgtttaactcccacttatgagtgagaacatgtggtgtttggttttctgttcctgtgtttgctgaggatgatggcttccagctttatctgtgtccctgtaaaggacatgatctcattctcttttatggctgcatagtattccatggtgtatatgtaccacattttgtttatccagtcaatcattgatgggcatttgggttggttccatgtctttgctattgcaaacagtgctgcaataaacatacatgtgcatgtgtctttatagtagaatgatttatattcctttgcgtatatacccagtaacaagattgctgggccaaattatttctggtttctagatccctgaggaatcaccacactgttttccacaatgggtgagcgaatttacactcccaccaacagtataaaagcgttcctatttctccacagccttgctagcatctattgtctcctgactttttaataatcgccattctaactggcatgagatggtatcccattgtggtttggatttgcatttctctaatgatccatgatgatgagctttttttcatatttggccgcataaatgtcttcttttgagaagtgtctgctcatatcctttgcccactttttgatggggttgttttattcttgtaaatttgtttaagttccttgtagattctggatattagaattttgtcagatgggtcgattgcaaaaattttctcccattcttaggttgtctgttcatcagtgaacagacaatcatctgtgcttctttagtatcatgcttctattatgactgaagcaaattacttctattatttgtttaacctgtgtcattcattggatttttttttttttttttaatttgttcccgctgaattttgttttgtttttataatttcttgtgctaggacagcacctgacataaagaaagcaccagtatattttcagtgtattactgacaattacacaatatacaaatatgcatcttttaaatatgagccaatatgggacaaatgagattatttgtgctggaataccagcaaccttgacacatagtacggcttcgataaataatttgtttagtccaaatcataaatgtctactaaatatcataaagaatgttgaactgcaaattgctttgcaaaatggtagcacattcccaaaatgtcagagttcgagtgcgcatgatatgtttgtggttcatcattttttttgagatggagttttgctcttgttgcccaagctggagtgcaaggcacgatctcggctcactacaacctctgcctcctgggttcaagcgattctcctgcctcagcctcctgagtagctgggattataggcacccaccatcacatccggctgttgttttgtatttttagtagagacagggtttcaccatgttggccaggctagtcgcgaacccctgacctcaggttatccacccacctcggcctcccacagtgctgcaattacaggtgtaagccaccatgcctggcctgtggttaatcattttaaccagcctggtgggagatcagaatgatgttagaaaatatgactgaaaagatagaggatggcctttgtgagtggtctctaattccagactaagaaatccctaggagtctttatgtgtataataaagtatggaaaacgattatagatttttgagcacagaggtgacacatacagtactagaaatacaaagtttaatctgacagccatgtaaggagcggattagcaagtattaaagtttttcttaaaagactaaatagtggccgggcatggtagctcacgcctgtaatcccagcactttgggaggccgaggcaggcagatcatgaggtcaggagtttgagaccagcctgaccaacatggtgaaaccccgtctctgctaaaaatacaaaaattagccaggtgtggtggcgtgcacccgtaatcccagctactcaggaggctgaggcaggagaatcccttgaacccaggaggcggaggtagcagtgagctgagatagtgccactgcactccagcctgggcgacagaatgagactccatctcaaaaaaaaaaaaaaagactaaatagtaagtatttttggtttgtggaccacaagatgtttgtcattacttctcaatgctgcagttgtatcacaaaagcagctatagacaatatgtcaacaaatcggcatggctatgttccaagaaaactttatttacaaaacaggcaatgagccagatttgtctctcaggctgtagtttgccaactcctggtctagagacataagtggtagagaagacatttaagagtctatttaaatgtactggtataaaattttggaggcttggcccagggtggtgggagttgaaatggagccaaaaaagaaaagttgttccaggaaaaaagagggtgaataattgcatactttataggaaaaggtaagagaatgaacaatatctttttatggttttaaacaaagagaactgggagcataaaggcacctttgacaggcaaggtcttcttagttacccactccagaaaaacttccttaggaagtttgtaagacagtaattaaaaaagatatgcatgtggaacccagagtcaagataatcacagaattctagagaattctggtgctacagggggatttagagattatttagttcattttatattgtatcagatgaactgaccagcaaacaacagtggcctcaaatcatgtttggtttgtcctacaaattattagccctcagtatgtttctaaaataaagtggctcagttctcagcattgaaaaatatcagactggagtttttgcttctctaaaaaaacaaaaacaaacaaacaaacaaaaaacaaaaaaaaaactggaagatctggaggtactgcgcttatcttcccacataacaaaattagctggaagagtgtggcagctacctgctgcttgaaggatatgggctctccattcagtcacaggagccctctgccatcactcgtgtggccctctcaggcatttaagtttgtttaggctgatttcaatgaatacgctatggagtcagactgccaggctggtgccctcactctgccactgtgggaggtaacttaacctctagatgctccagtttcctcatcatgaaggtatagaacattgtcagctcctacctcattggattacgatgataatcaagtgaaatactgtatgtgaagcccagccacatggtagtccttcaaatgttagatattgtgattatcatcattatggtgaatgaaagctttttaaaaagttaaataaattgcccaagtccacattggcagttggtggcagaaccaaagactctagagcaatttccaaaaccctgagcatattccaccacaaatacattgaggattatttgtaaaatctaacaaatgcatgccctgaaccaagaaggaaaacaaacaaaaaaagcaaatcagagatgatgttgggccaatgtgtctaaccatttccatgggttatgcccaaacgtagcacattggaacaaacatgtaataattgtatgcctgtgatctactttttttgccaaagctacataaaggaattataaacatttattctaccactggtaacagtaaaaaccaggccacatgttaaaccaagtttgatgacttttagttgccttctatcttggagaacaatagtaggtagaaatactggcaaaaataccctggagcaactctgtcctgtttataaattctcagtccctgcctgtttcaaaagtggaggagaaaaagtgctaagtcgaccaactttcactaattagttatttctattaggtgactgcaaatcaatgacaagcaaacttctcataccttcaccctggcttagaaatttttctgccactcaccatctatcactctgcctgtaagtggccttgctgagctctgtctaaatagcatccagtgctcctgttatacatatttcctcttttccgcagcctacaagaaaatatgctggtggtagctgtttgtaatatgctgaaagctttataagaccaactgtaatgcaaaggtcatattttctaagctttatagattgcaatttgtaaggttataatgtcacatgctgtcaataattcaaagtggagaattataactgttaacaggtcatcaattcttcattcttctccttcaacactcattccccagggggctttaatttatttcgtttaagcttgattccttgaactttgaactgaaggtttcatttgtttatgaggaaaaaaaaaaacaactgggtgacacaatgcaagcaattccttaagtttcaagggatctgaaccaataaaaagatcacaatttagataggaatgactcagaaagtctattttccaggagtgtagtgttatagaaaatgtgtttaggttgtcagtatgcaagaagcttaacacttacccctccctccagataaataaataaatacaacaggaaggaaatgttgctgaaaacactgaatactgaaagctaaaggagtttcaatctgtttgcaagaatgcatttgtggtaattgtctgccaccaggagtctgtccaaatgctttctttgggagagtaattaaatctgaattctagtgcaattgtgagtgctgagcttgttgcacctggctcttttttgaggttaaaaacttttttgagtgtctgatgagagctatggatgcgacatacaccacttctaataaacaccaactacaaacaaaatgctgggacaactttctaaagttcatttatttaactctaggtaaagaacttcaattataaagatgcagattatctttctcatacaaccaacattctttcaaaatagagcacagaggcagatgatgtaatcacttcccttgggtacttataatctcagaggactcaaaagaataactgcatttttcatctttgaggattttttttctcgtctccaacaatagcctgaggcatactaaaaaatggccgtgctcaggaaaataaccaatatccaaaagaagaaagcaggacaaggctcctcatcacattgccaaggagcatataacagactgttttgttgtttgttcttcctgtccctctttcctgtgaatgtcctcccaactactcgatgctcctggtgtctattagggtttgaagtcttcatggatctcctaagagaagcccacgaaatagtgcaagcacaaaacatccattgcgggttcctgagtttctgaccccaacacccattcaaacatattgactttcattgtttttgtggagttccaagttccaggtcaccaagaatcaggcatccatacattagccgaggcacagtaattatttctgttaaggatttaggtacctaggagttctcaggtataatttaaaaaattggaacgtagtcttcgattagattgtgtagaaaaggttgaattagatcctttaaccacaagataggccattactgaaatttagtcaaagaaaatataatctttagactcaaccaagacttgatgcctatgattttcactgtgctgacttgtaaggataatattaatttgtatgtgtgtgtatatacatatagctaagtaaatattgacatacagaaattgctaacaaaattgtacttctgccttccatggtaaggatcatactttttcaacatactgtatattcattagccaagacagcttagcttgagatttcacagtatgttagtccgtgaaatgcagaaatgtaaacagagaactgtgcccagtttcaaggatgacaagctggtttagattttaagggggagtagggggcacatgtctttcaccaaactattaccatttccagaaatctattcgaactcaacatttaagaacaatatcttttcaaggcattcaaccgttaagacaaactctgttgccttgtttttcttacggatttgactttgccctcagttccttaaaggaatcactattacaggtaaaagatacagccaggatgattaagtatactagaaataacaaagctttggcttgctggctgcagtttactaaaactgcattccaacattatcagaatattagcagtttaaaattcacccattaatatgttgctcccctagtgttaatttctaagaataggaaaataaccaaataaagaacacctgattagtcctgaaggcagcctattgagagctttttgataccagagatcttactatattcaccttatatcacaagtgcctagcttcctggcacagagatttaataactgttgatcaaatgaatgatataccaaaggtgcttaaaaaaaaagacatgcaaatgagtgatttttaaatatttattttggcatcaatatacagtttatttcctcattatctcagaggaggttatatatatatatatttctataaatatatatacatctctatatatacacatatttctatatataaatatacatatttctctatatatacatatttctatatataaatatatatacatatttctatatataaatatacatatacatatttctatatataaatatacatatacatatttctattcttagaaattaacactagggaagcaacatattaatgggtaaatttaaaactgataatattctgatatatatatagttgcttgtattatttacagttacactctagtattattttcttatatactttacctcataggtagtagacaacctaatgtgtagaattctaaaatcagaggaaatcattcttctctttccacaggacaatgaggaccctatcagccttgcttttattctgtgatacaataattgaagagtcagctatctaagtaagaagtgcttcctatttcccaaggagctatttgtcttttcttcactattagaggtcccgtaagcaacactgcccatggtctctgaaaccagattttgcccctattttgtagccaggaatagtagccaggaacactaaggaatagtgttccctggtaaagatttaagttcaaacatacgctgccatctctgtgtctgattttactacaaaacactaaattgaagaacttaacacggaagagcagcaccagcaaaactggagcctaaatcacctaaaccgtagcaattgtgggaaattttctagcaggaggaccaaacagcataattcttgttacctttaagttgtctagggccttaatggcaacttgtaaaggtcatatctaacttggtattcagaagtagggtgataattaataagaaagctggtgaaatattttaaagaaaagccagttattaaaaaattgtaaatgcaggaactaatggcttttaccaattcctgggttaatggaagttaacaatacacgttatgtatcacaggacttgaaccacatattttaaaaggctgacatattttagtcaattataaaagggaaccataaagacaaggacgtcctactgaagtattatctcaataatcagaaagtcggattttaggaagatagcatggcatcttatgggtaagagtgattagtttatattttttacatatttcccacggacacaagcttatttactcacaaggaaattgcccaacagatgtctaaagcatttctgattcctttgcaagactttagacagagctaaacttaatttctcagaaattaaatagtgatttccatttttttttttttttttgagacagagttttgctctgtcatccaggctagagtgcagtggtgcgatctcggctcactgcaagctccacctcccgggttcacaccattctcctgcctcagcctcctgagtagctgggactacaggtgccctccaccacgcccagctaattttttgcatttttagtagagatggggtttcaccgtgttagccaggatggtctttatctcctgacctcgtgatccgcccacctgggtctcccaaagggctgggattacaggcatgagccactgcacctggcctaccattcttaattgtaaaagttactattatcaccaccattcatgtggtagtaaagagcatgaaattaaattttatctttatagacacacacttttatacttatttcacagctgatttcaatcctgaaacctcatggacacaggaatatgatgaaaacattagtaaacatgaaccaccttctcattaagttgttgaaaaatatagggcaagcaggccgggtgccgtggctcatgcctgtaatcccagcactttgggaggctgaggtggccggatcacctgaggtcagaagttccacatcagcctgaccaacacggtgaaaccccgtctctactgaaattacaaaatcagctgggcatggtggtgcacacctgtaatcccagctactcaggaggctgaggaaggagaatcgcttgaacctgggaggtggaagttgcagtgagccaagatcacatcactgcactccagccagggcaacaagagcgaaactccatctcaaaatgaatacataaataaataaaaaataaataaaatagggtgagcaaatcatgtagtcatagttctgtgattgccatgcatatcctccaatgacttttgagtggaaacattacatgaaatacgttataaaccaagttgaagttgatttgaaattacgaagtgtattttttctcttataaaatatatccttatgtcttatgctacatagaaaacccagaattacgcttaaaggcactctaaatgccttgaagaaaagaatggaaataggaaaggaaatgaatgtctacagagtgtcagctatgttcaagacaacacgtgaagtctattcatgtactattatttcacttaagctttttttttttttttttgagatagtctcaccctgtcaccaggttggagtgcagtggcacgatcttggctcactgcagcctctaacttcccgggttcaagcgattctcctgcctcagcttcccgagtagctgggattacaggcgcccaccaccacacccagccaatttttgtatttttagtagagacggggtttcaccatgttggccaggatggtctccatctcctgacctcatgatcctcctgccttggtctcccaaagtgctgggattacaggtatcagccaccgagcctggactcatttaagctttcacaacagccctatggttattggcaatcttatagatgatgaatatgtgacacagagtacccctttccccaagggttcagtcattaagtgtaagatacaggacccaatccttgtctatctcttcatagatctagtaagctccttccacatgcttgtgttctagtggtgatcatgatgtaacaattaaaagttaagaatcaacctcatattaggtgatagtcatgtcagaaatgaattgtggaacaatgaatactatgttttagcagtttacgatatggctaaatgtgggttcctgtatatctatcttaaatgagttaagttttttgaaaacaaatttggaaacttttaacatatacatgatatatatgtacatacagcatgtatattcatatatgtataacctatatatacacatacatatgtacagcaaatatatatacaaacacacgtgtaaaaaaatgataaaaatccccaaatttggtttaaaaaacttacatatttaagaagctcaacagctcaacaaacccaaagtaggctagatataaaggaaaccatacttagccataccatagtcaaactgctaaaatattcattatttccataatttattttagacaagactgttacctaatatgaagttgattcttaagaatatatatacaaccgtgtgtgtgtgtgtgtgtgtgtgtgtgtgtgtgtgtgtctgtgagtgtgtaacttttttataccccatctctctctttcctcactggtactctatgtacacagattgtaaattgcttgatatttttctcacaggtactaaagctctgcttattttttgagacttattctttctttttcctcagattggataatttctattcgtctacaagtttaatgacctttccttacacagtctccactctgtccattcaataaatattttcattttagatcgtatgttttcacttctggaatttttattttgcttttttcatgagagttgccacttctcttctgtgacccccatctattctctcatctttttctttaagcccttaaacatatttgcaatagttgctttaagtctttgctgttagctctaacaactgggctatcttcaggttggtttctcttggctacttttttccttgacaatgggtaacattttccactttctctgtatgactagtaatttttgattgttcatcgaaccttacggatgatgttgcagggaactggatcttttcttcttctgaataattttttcactcctaataggcttttaaaaaattactggctgataacctggaacatgcagaggcttagctttacattttctttggatgagactctttggattttcacttaggcttctggaaaattcctttattctggtacatagtctttatttgtaaagtgtgttttcatggaaggctcagctacttactaagctcctctaagatggcagaattcaaactccaaagtctgtttcccctgcagtgatcagaaactgaaatcctctctcagctctttcagtcttgacagtagtttctacctgctccttagaattcaggaatcagcaagtatttcactcagattttgaggctctaacttccatggcttcttcattcttgggacttctccacaatctctagctactctggaagccccacgttctacccatggacacctgtgtgcagcagctctcttcttggcgcatagccacccaatgccttacggaccgggcagtgccctcaggggagaaactgtataaacatagttcccgcctactgaggttctcctctttcatggattaaaacccattcagtttctgtctgttgctgatccctctccagtgccctcaaagatttttttcttcttcctcagaatttataattattacctgcagaaaacctggtaataagctgttccactatcactctggggctccttcttaaaataacaaccctgtctttttcaagttctgtctactttcttaaccctattttaaataagataataatttttattatattacaaaatcacttgttcacttatgtcctaggaagatttttcttttcttttctgaatttatccaaggtgaattccctcagggccaactttaacaaaaattgataaaaacagaaatatactgaccctgttatagtaaaggccatttcaccagactcatcttcctctctctcactatattacagaagaatataggaagctatcaatctgccatttctttccatgccctgtgacttttctgtattgtgaccaattaagccatcaacagaagtagtgggaaaggcagacgttgatcgctagctcacctgccaactttggacagcatctttattctatagagtcatgccatactcacttccacctggggagcaaaggaatctagccacttacttccaagttctaaaacgttggtggctttaaaattgttattttttcagatgtgtaacagaggaaggacagcattcatatatcagctgataagaaggctggtggatgaaaaatatattatctctcactaccactggctaaggtaagactgcttaacattagttggaattagagggttgagaattacagcagtctctcagttggacgtcttagcgtctgaaaaaatctgcctccttctggaaagaatcccttatccaggaagctactgggtcaaaaagtgagtaaatattcttactttttttttttagaattctgcaagaaggtcaccttttaaggctaatgtgggacagctcctagaaatcttttgactgcctttccagaattatacactcgcaggatgcctgggaattggcagagtaggaaaaatgcattaatatttaacactcatatagcactataaatggttgcaatgctctacaataaataaaaaatcaggtctcaaaatgtgactttttaacacaattgtaacactgaaatattttcagaatttgtaataaactcccaggggaaaaagccagaagtcccatcacttaaaactatagtatactaagcaaagtggtagagaatattctataaaatagaatcttgtactgatgagacaaggatcaaacgtccctaggaggggcttttttcctctaatgtaaatggtgttagaatactgcaagtgcctcccaggcacggtggctcacacccgtaatcccagcactttgagaggctgaggcaggcagatcacaaggtcaggagtttgagaccagcttgaccaacatagtgcaaccctgcctctactaaaaatacaaaaaaaaaaaaaaaattagctggtcgtggtggtgggtacctgtaatctcagctactcaggaggctgaggcaggaaaatcgcttgaacccaggaggcagagaatgaggtgagctgagactgcatcaccacactccagcctgggtgtcagtgaaaggctccacctcagaaaaaaaaaaaaaaaaaaaaaaaaaagaatactccaatgcctttcctaaaatttccttcgaggctgtctatctcccttggtagtaccttgattctgccaggtccactaacagcagtaaacttgatgtatgggaacttaactctcactccttttctctactagccatcttcaagcatgatctgttccttgtttccattcagcagggcacttttgacactttaaggtccactcacaatgtagttttcccagcagtctttctactttctaatcctcatcctctcccccttcttgcatagggctttctggttgcagcaacaggcactgtgtcccttcatttatatacatttatataaaccattccaaagcagaacttctctttatatactcatattttttctgtttttttttgttttttttttttttttttttttctgagatggagtctcactctgtcgcccaggctggagtgcagtggcgcgatctcggttcactgcaagctccacctcccagcttcatgccattctcccacctcagcctcccgagtggctgggactacaggcgcccgccaccacgcctggctaattttttgtatttttagtacagacggggtttaaccatgttagccaggatggtctcaatctcatgacctcgagatccacctgcctcggcctcccacagtactggaattacaggcatgagccaccacacccggcctacccatgttttcttaattcagcctgattcatgttgctgttaatgttaaaggtcatttattgaacaggtgcaaagaagggccaccttggaaacatttcttttgcaatgaaaatacctctggagtagtatagggctttcctttttagattacctgctcagaaacaagtagcaagaggagactgttactctcctaacatatctcatccagtcaagctctgactaaagcaaacatttgccctattctaaaaacaaggccttctaacagatttggaagtctactgctatttcaaatttttctttttttgagatggagttgctctgttgcccaggttggagtgcagtgacgtgatcttggctcactgcaaccttcacctcctgggttcaagtgattctcctgcctcagcctcctgagtacctgggattacaggtgtgaggcaccacacctggctattttttgtatttttagtagagatgggttttcaccatgttggccaggctggtctcgaactcctgacctcaagtgatctgcctgcctcagcctcccaaagtgctgggattacaggcatgagccaccacacccagccaactttttctttcttcagaacgaatgctggtccttttgtcatgacgtgtgatagtacaaatcacaagggcaaatggggaccaaacgtttgtaattaagaatgacaggacttaaggagatcggagaaaatgtagaccttcacatctcccattttccatttctacctgcatcgcatttacttagttaatgcataaggtctacttctgaaaaattgtgagtacactgttaaaattaaacagacaaaaaccaccaattaaaataaaatctcattaaaagaggttgtaacttaagaaaatgtataaatacttcttttatttgaggcacactactcttttgcaaaatgaatgattttaaatttgtgatttcacagttataatgcagctaaaataatcttgcttaaaggaaccttcatgcctagccattggttactggaggtcagttcttccacatcatgttgaaaagaaagctgccactttttcacctgttcagtattccatgatactaactaatctgacttatgcttatgttcacccatttgtcaaataccaggtacagcatagaactttatgttccattgccttcgacttacattttatatttgacacggaaggccctcgggatacaggagagctttccatccacaccagtgcctattcagcacgtgttctagcagccagagtgttatttcagctttcatgttttctggttgcagaagtcaaatggctcagtaattctccccacagtgacatgtttgacaagctggataggaagatgacacccacatcctggcctttctattcctcaaataaatgaaactaaaacataaaacaatgagagcacttctagttggatttaactggtgagctggcctgagatgtttgaaagcccacagatctcaattatagtgggcaattcttacttgaaaactgattttctctgaacagatcttctccatgtgagtcctctacttatgcctgtcagcttcactgacaaaagtagttatgccttttgaaacagagtcaacagaaccaagaatgggtaaatccatgatttttggctttgaatatcactaataattatctgtttttgattaaaaaattattactcctggagcagagctggattttaactccccggtacattacaaaaatcactagaagggggaaagggaaaagaatagggagaaagacagtaaagagaaaaagacagacaaggaaagaggagagacaagaagagggaggatgaagttgaggttgtataaagtcatttttgcattttccttttgcagcttccttttacaactatgtaaacgtctcattaatttctacatttagaatctgattctgagcgtaaaagtaaattactcttttggatcttttttatctccacttccaccagtgacagatctgaaaaagacgaaatattttatgcaattaaactttgcatgttataatgtgactcgttgtgaatattgcctcaaaaacttaagagtgaagagagatatagaaaataaaaaggtgaagactgagcaatcaacacaggatcacaatggacaggctgttggatgcttgtttgtatttacttctcggtacacacctctctcaagcactgttcgtcatgagcttaaaagcacaggcatggtggacaaaggagcccctgacttccgtatattcgtcccaatattcacagtgctcagacttcctctcctagtcatgagaatgaggaagtggagtggtcttctggataagctcaagccaggaaaagagaggctggttttggacttaaaagcaatagatcatgacagagtaaaaaaataccatacatttactaacattttttccaagatggaaaacctataggtagttcctaatgatctatattgcagaccccctttttctagtccactctaaaatccaactaattctttttcttttcttttaggagatggagtcttgctctgttgcccaaggtactggagtgcagtggcacaatcacagctcactgcagcctcgaatttctgggctccagtgctcctcccacctcagcttccctagtagctgagactataggtgtacaccatcacacctggctaattaaaaaaaaaaagttgtagagatgggatcttgctatgatgcccaggttggtctggaactcttgacctcaagcaatcctccatcttagcttctcagagtgctggcattacaggcatgcaccactacaccaggccgagctaatttctttcttcctttctttctttcttttttttttttttttttttttttgagacagagtcttgctgtgtcaccaggctggagcacagtggcgcgatctaggctcactgcaacctctgcctccctggttcaagcaactctcccgcctcagcctccctagtagctgggattacaggcatgcaccaccacgtccagctaatttttgtatttttagtagagacggggtttcaccatgttggccaggatggtctctatctcctgacctcgtgatctgccggcctcggcctcccaaagtgctgggattacaggcatgagccaccacgcccagccgggcctggctaatttcttacagggctttcatgtcaggtttagatactgtatctcgagtcaacattctaagcaactctttagatgcccaagtagggctggaaaccctacccatacatgtcttttcaggaaatctttgtgcatgggctctgacagtagactcctcacttgtttgtgacatcagctttacacaaagctgcactggtggtttttattacatctcagtgcaaactatattcacacttgaatatcactctcaaagcatccctgctactttttatcagtcccattttacaggtgagaaaattgagtagcaaagagatacatgacttaactatcaaggacacaaaggacatgatagaggctgaactctgaattagaatttttgacttccagaagagtatgcaggaatttcttttaaaaacttattttcttaaagctaaaaactagatagtattttattcattctgtaacaagtattagctcaaatcaggtacagtatcatgccccagtgttcacagttgaaactgtcaacactttgtttgaatgtatacatgagggaaaaaaaatattcttttaaaagttgaaaagcaacaaagtaaattttatttttccaaggatgtaacataaagaagggaaattttcatatatagaagggaaaatgaggccaggtgccgtagttcatgcctgtaatccctacactttgggaggctgaggtgggcagattgattgactcaggagtttgagaccggcctgggcaacatggtgaaaccccatctctaccaaaagtaccaaaaattagccaggcaatgcggcccatgcctgtagcctcagttactcgggaggatcgcttgagcctggaaggtggagactgcagtgagccaaggttgtgccactgcagcactccagcctgggtgacagagcaagaccccatctcaaaaaaaaaaaaaaaaaaaaaaaagaaaatgagaagcaaacaaattcataattcatggtcttagtaaaaacaataaacccactttgctattaatacaagcccattaaaactaattaaatctagtcccaaggactttcaggaaacctgcatgatactgaaattctcttacctacaaaattgatttttggggggtcagctctttatgtaaaatgactacagcacgacaaaaatctgtctggaatatgctgaatgtcttaaaaattaggagtcaaagaaagtaatataatcaggtatctgtttgtctaccagtatatgttactattcagtatgtaattcagtgctaagtaatccgggaattaaaaaaataggattataccatagaagtatcaaataaggatggcatagacacaaatatagcaattgacccatatttaagccaacagacagtttggaaaaggactctgaaaccattttgttcttgaaaatgctatcaatttaaatggcaattttgattttagcagttgattaaaactatttcagacagaagtatatgccactgagctgtttctgccctgaagtaaaagtaatggttcagattcaatttaaattttgctggcaaacgtgctatttagcattacttgaatgtgaaaatactggtgaaggtttaacaactcaggatataacattctgaaatggtgctgaatatttttgaagagaaggagaagatgaagaggcaataactcattgagagcaaactggcttaagagttgacatttcctagaggcaggcaccaaaatgtattttgcccttccaccgtttctgcatagaaagcaaagtgaatctatccgtttcctcataaaagttaaatggaaaccttgtcaacagaatgactattagtaataactgaacgtcggaaaataaaacatacaggagagtggatattagcagttaaaaagtaagaacagccggccaggcatggtggctcacgcctgtaatcccagcactttgggaggccgaggcaggtggatcacgaggtcaggagatcgagaccatcctggctaacatggtgaaaccccgcctctactaaaaaaatacaaaaaattagctgggcgtggtggcgggcgcctgtagtcccagctactcgggaggctgaggcaggagaatggcgtgaacctgggaggcagagctagcagtgagccgagatcgcaccaccgcactccagcctgggagacagagcgagactccatctcaaaaaaaaaaaaaaagtaagaacagggtaacagagaatagaagaacagccttagaaatgagtttgaataaaaaggtactacatctgtctggatgggcaggaaaagtaacgggatttgttcagcaggttgtattgttttgtttttttctgctatgctctggcatggattatcaaagtgaagctacccacaggttatcctacaagttgggaaggtatggggaaaaaaacgtcctgcgtggctgtggaattttgccttcacttcactgggtgagatacatgttcataaaagttatccgaagtgttgcttttctaatgcatcaaattgctcttttcttcctaagttagggctacatgggaagttgagcactgacattgctcaaaaaatattcgtcatggtagaaacagtaagcaattgcagcagcagtggtagtgacagtagcagcaacaataataatacaatgctaagtgataatttaaaaaaaaacaaaatcatgattttcatacaggcataaaaaggatttgggtcaaagattttattttacttataacaagggaacctggcaaatgttgtgaccagtcaaaggagaagttcaaaaagcaccactttttacagattaaaagaatgtagaaatgaggccaggtgcggtggctcacacctgtaatcgcagcactttgggaggccgaagcgggtagatcaggaccaccctgtgatcatgttcaagttcaagaccagcctggccaagacggtgaaatcctgtctctactaaaaatacaaaaattagccaggcatggtggcctgtaatcctagctactggaaaggctgaggcagagaactgcttgaactggggaggctgcagtaagccaagactgcgccactgtactccagcctgggcgacagagcgagactccatctaaaaaaaaaaaaaaaaaaaaaaaatagaatgtagaaatgaaatgtacaaatgcaggcaaaactacctggggtcaggggagtcaactgagcctctatacaagggaacagaatttacttgtctatagctaaaaattattttgcactgctatcattcatctacaatttaaataattataaaatagctttcatagaatcagataactaccagaagggtatgctacagacaaaatgcatatttttctgctgaggcacatttttctccctataccagtgaattatttgagctcaaccttggcccctaggatccttagaaatcagttataaccacacatgaaagtcaaatgcacaagttctctcagacattatcctgaccaccacttgcctttcgtcgtaccaaaaaaatcagaagcatattgttttcagccctacaattttcccatttgcaaatgaggcatcccaatgatatcacagcaggcaagaaaagtgctgatcattctggatgatatgaccagagtgtgtcgcctgcataatgtgattagtgctggtactctttgggaagatgagacagcccaatttgtaagagacttaaactcaatgtttccaatactcaggaaaccttgcttagtgcctatcttgcagttataaagtaatatccatgtttttttttctaaaaatgaaaggaaatatgtctaaaatcacaagagaaacatatgggactcaatttccattgctatttttttcttggattttctcttcatttagggaaaaggaaagaggtaggaggactgcataacattctctttaacatcctttttttttttctttataaagctgcaccagattagcctggtcctttaagcccttacatatagcgctgccattccaaggcaggtaccacattaaattattctctgatattctttctcctggtaattttaactcccctgaaggcaagaaccatccattacttacctttagactcagcaccttgtctggcccacagtgggtgtcttataaatagttggtgaactccgcctgtcccctgagccacactctgtgtgcctgccctcacctctgtgtccctgactgtcactgcctctgaacttacaactcattttcccatgcttgcagctttgatatgctcctgacacttcactgctgccacagattctcttattttgaccaaatgcttttctctttgacaacatctggactatactaaattacttatgctgctacagaacaattctccccaactcagcccccagtaaaacactgccccaattcatctcatctctaagcatgttacactcatccacatagaagccatgttgcaagtcatctgaaggaaaactataaacaagaccagacagagtttcctttacttaggaaacctttcaaagtagcatcagaaatgagagaaatatatactcctctactaatggctttcctaaaatgtttatatagacactgtggtttcaagggtaagagtataacctggccattttgcagaaaaacaacaacaacaaaagacagtaaataaattcaaaaccatgcttctccttggtgaaccacttctctccaacacactaagtagcattctttctccactgtctcccaagctccttctccaccacctcccagtaaccgccctctcaaatggccacttcccctagtgggaggtgcatgggtagggagaggaaagaggaaggactttgcattcgtgaccatatattctggttacttcccagattcagcagatttgttcactgtctgcttctaattaaggagaagacctcacttaaatgcaacagacgagcagccttgcaaatagaagaagagaagcttaatgtgcaaagcctccttgtgcgaatgtcaggccccataatttcataaacatattctaatacatacattcacatgtttatatccgctgcttttacataattcgttggcctcttatttaaaagtgcctgagctaagggtagtgtgtaactattcatgcaaaataatagctacaagaataagctcggcttctgaaagctcatgcctttgcagtgtcaaaataacagcactcatacagctggcttgattacctgaactactagggtcattcacgatggcctttcttgtcatgaggactcccaacctctggcttctttcatttttttgatgttcaattaagaaacacattttgtttttgcaaggagacctaggtaggggtgggataatggagcaaatggcacaatttcatctcacactccttttattcttaaaggtgcactttaacatgacaaccagtcttaaactattttaaaggctgacaacttgacctggaacaaaaataagctgtattagatactttcagatatacagttaatgcgaaaccactattatcttttttacattaagagaagggcagaatgccatcccctttcatttctccagtaaatcaaactgaattattcattagcacgaaatgtttccaatccaccccctaccacatacacacaccaatacctcattttaaaaaactggtggttatatctcctctaaaaataacctctctgatacactgagctccaaaagtttaggactttgcaaagattaatttctgtggttagtaaagctaacagtctctagagtagaatcagactgcaaagacaagaaatgagcaattaagaagtatgtccttgtattatttttcagttctcccatttgttgctgactacagaagtttggcgctgaataattcttggaatctgaggttggtcagaggtgactctaagtaaattcttcaggaataagtagtaagaaaacttctaaagtaccacattttgccaaatgaagacaggtcctaaaatgccttccaagagcctgcattaaaatatagatttacgtaattcaggtttaatggaaaaaaacaggtaatgcccagcacttctaacaactaaaaacatacacacacgaacatacacacacataaactggcaaatatggacacacacaccactgccaccaccaaacatacatacacacacacagatgcacacacacaaataggcaaacatcatttgtcttctctaagatcagatctctgggcactgaagtctgtatttcacatggaatctcattttccatcttctactctgacagttttgcatctgctgtgtcctgtttcattaacaggagctcatcagagccacatcaaaaagtgaagatgcatggttgctattaccatttatagcaccatttgtttcatttaagaaaacgtgcttagtccctggccttaaattacacagaagaaacaggattctggagttcagggtacacattttttctctcatctcttcactttgtcagaggagaaatcactttgagttgacttacaagacaaactgtttccatttgcaccagcagaagcttggctctggcaaacaataatttagcttcagggacttctgagccattctagtttccaaatcaggcactagcctccagattatacctccttaattcaggttttacaaattcagccaggggctgggctcaaatttacttcctcatgatgaaaacgggatttctgaagtgtaacaggataaggggaaattttattatcttaataactgataccagaattcttcttaagagtaacattggatttggttgaaaatatacctggatcatggtttgttgtttggaaaaaaaaatctcagcagatgtcagctgggccaggcatcacaggagggaaagtttggggtttctaggggcaagccagaaagaatcaggtgaggagggaagcagagaagtgggagaaggggagaactcacctatgatagggcagaaaactgtactcccagtgacaccacatcaccctctccccatcagcaattaagtccgcagaattaacaatgatttgaaataaataattttttaaaatgttgttactgtaaaaaacagagagaagtttgtaccttctgtgtgcaatgcacacccagcagttgatgtcaaagtggtcctgagaacatgctcccatctttccccccaaaaccggctgaaatgttgggaagatttttaggtatgagtccatttggctgggcacaatggctcatgcctgtaatcccagcactttgggacgccgaggcgtgtgcatcatgaggtcaggagatcgagatcatcctggccagcatggtgaaaccccgtctctactaaaatacaaaaaaaaaaaaaaattatctgggcgtggtggcacgcgcctgtagtcccagctactcaggaggctgaggcaggggaatcgcttgaacctgggaggtggaggttgcagtgagctgagatcgtgccaatgcactccagcctggcgacagagcaggactccatctcaaaaaaaaaaaaaaaaagtcaattttacctcaaacctgaatttctgtatgcttcaagctaatacctggcttacacaaaatggaggtttcaattagtttttacaggcaagaagattgaacaaataaatacaagataataagtgatattcatatatctaagatactcttcaacatatgggctcaaataaatataatatgaggccaagtatgaagtgtgagactaggggtgaggggaaggggcaatgccagtttagggaagggtaggaaaggaagatatcagtgactattttgagagaacactagaagatggatgttatttgtagaagcaaaaatagtgggagatttaatagagatcatgtaaagaatttttttgtataaatttcttgacatcttgccactttgggttgaaggataataaaaatgttttcctaatgactaccaggctagtctctggagtgactagcccaagtcttgaacagaggagctccttaatgttaaattgaatcccaaaatgaagctcagcataaaaataggcagagaggcaggaaggggcagagtgtagacaaggcatttttaaacgtgtagtttgcctggaatttaagatgtgtgacagggattgttgtaaagggaatatggttatgttgggctggtgccagatgtaaaggtctctaaaatgaaatgtcattacctctttaggcagtggggagtgcaatgggaggactcttggccagggaaatgtaggatgaggcacgtttcagaccaattactccaacatcgtatacagaacagaggggggtcaagtttgctggtgaagaagcctggtagaaggctttttagtaatctacttataagcaaagacatgggggttcaatctgggataggagtaataggaaggaaggaagtaggacattgtaagagatagaaataaacgatttagcaacctccgtctcccgggttcaagcgattctcctgcctcagcctcccatgtagttgggattacaggcacgtgccaccacacccagctaatttttatatttttagcagagacagggtttcatcatgttggccaggctggtctggaaatcgtgccctcaggtgatctgcctgcctcaacctcctaaagtgctggtattacaggggtaagccactgcacccagctgaaataaactgtttataagcaggtatttgcttcaagtcagcttaacagctatttattaagcatcttctatgttctccggcaaaggcagttaaacctggctctaaaaggattcacaccaatctgttattattggttatatgtgagatttgaattgaaagagaaggaatttattaacttttctttcttcatatattttcctttcctttgggttcttacagtagtaatgtgtcacaattatgattctgaaggaaaaaatatccaagaatacataaatcttaaaaaatgtgttacacagcaaatgaacacagcgaagaccactgaatttgtatgccaaggacaagaacggccctgagcaaattaaaaatcatcctatctcattattaaagcaggcccaggagcatcaccacaaaaggtgttaagctattactttgtggttttgaatatagccctaagtaataaagccatgattcaatttaaaatgttacatttttcatgcttctcattaagccaaactaatatctctctcaataattctgaattagtaaggtcagaccgtattggaactaaaaataattatggaatgagtgaatcttcccagtctcctttaattactgtgtcagaccaggagcctgggaaagctcctacctgagactaatttaggaagctttgagaaacagccactcttttgggccattagatgccttgtctctctcactgtgagcaactgtctccagcccacatagcacataatgaagcaaaaactatagctaatgagttctcatttctatagctcccaaaacctgggagaatgtaagaacacatagcatagctttcctgaatatgctatattacatgaattgtatgtttgctggaattgcatacctgcaaactaagataattgtgcctagaaaatccaggctgcattccacacagagaatgtcgtatgtgtccaccaagaggcaaccggtaggttccatgattgtctcttcataatggaacaagtctgattttaaaacctagaggaaataacaagggttatttttaaacacagatgtaaaagtgccagatgccttttgtcctactaattgctgacatgcatcattcaaggtgggagttgttactgagattccattaggggactgacagtcttacagaaatcagctttggtttgtatcactgggcccactcattactataaaaagttgttctaggccgagtgtggtggctcacacctgtaatcctagcactttgggaggccaaggcaggtggatcacctgcggtcaggaggtcgagaccagcctggccaacatggtgaaacctgtctctactaaaagtacaaaaattagccaggcatggtggtgggtgcctgtaatccccgctacttgggaggctgtggcaggagaatcgcctgaacctgggaggtagaggttacagtgagctgagatcacaccactgcactccagcctgggccacagagtgagactccatctcaaaaaggaaaaaaaaaagttgttctacaataggtacttagcagcataagtaatatatttgcagctcatatcagcatccttccaatggggtagcaatataagaatattttgtatatttatgtatagccaaagtatgcatgtgttgtgtgtatagagagaataataaattcccataagtgtgtgtgtgtgtgtgtgtgtgtgtgtgtgtgtgtgtgtgtgtagtaatccacagactcacttcctcttagctatctcatacaacaagaatattaatcttttaaataagggcctaaggcagaatattggatctaatgcattcttagtgtctatttcagatctaaaaatctagccataaaaatgcaccatcatgtcatcatgttgtactgtaatccttagggtaatgacattatctgcagtgtcggtctaattctggatggagtctctggccttgtgaaggaggctgcctgagatgaaggcatctcacagagaagatcctacctctggctcaggactagtgtgcctcttgttacataattaacatggccctgaatagttgggaagaaggaagggggcagggaataacagaaactcatgattcaaaagcaatccacaacaaatccctttttaaagcagagaatacggctgggtgcggtggctcatgcctgtaatcccagcactttgggaggccgaggagggtggatcacaaggtcaggagatcgagatcatcctggctaacacggtgaaaccccgtctctactaaaaatacaaaaaattagccaggcgtggtggctggtgcctgtagtcccagctagtttggaaggctgaggcaggagaatggcgtgaacccgggaggcggagctggcactgagccgagattgcgccactgcactccagcctgggcgacagagtgtgatcccatctcaaaaaaaaaaaaaaaaaaaaaaaagcagagaatactactggcattgtatgtaataactcctgatatccaagtttgtattcctaaacaggtctctacaatcatttttcagttcccttctttggtaattcctgtattagtctgttatcacactgctaatgaagacatacccaagactgggtaacttataaagaaaaagtggtcagtggactcacagttccacatggtggaggaggcctagcaatcatggtggagagaaaaagaagagcaaaaggatgtcttccatgggagcaggcaagagaggttgtgcaggggaactcccatttataaaaccacaagatctcgagacttattcatactgttctcatcagaacagtatggaggaaatgacccccatgagtcaatcatctccacttgaccccacctttgacttgtggggattattacaattcaaggtgagatttgggtggggacacagccaaaccatatcatttcctgattaaacctcgtgatttaccagaagtggctactcttctgggaagccctccttacaatactcttctataggtccatactttgggctgcaggctggcatcattaaaaatataaaacttttcatctgcactctagtcgaggcatttttaaaggacaaaattataaattcccataaatatgctggtatgtgtgtgtgggtgggtgggcctgtgcgtgtatgtgacagtgaatttctaaagaaagccaaagcagtgaccctacaaaacaaaagcagcaagtcatccagccctgattaaactttctccagttgcctgccaatatggaaagatattttaatgtaaaccactgaaaaacaatatgcctatatagagtaagagccccggggtggtcacagctaagaaaattccagctacagcaatcaactctaaggaaataattgagatatggtcaaagatctccgcataagggaatcccatcacggcattatttataatagaaaatgaaaagccaagagaggcttggttgctcgcacctataatcccagcactttgggaggctggggtgagagatcacttgagcccaagagtttgaagctgcagtgagctatgattgtgccactgtattccaggctgggtgagacagaacgagactttgtctctttcgggggcggggggtagggatgggggtggagaaaaagctgaacactatgtaaactttaaaaactagagattgttctaaatacagaaattttaaatgtggaatcatatagatatgagaaattatggttttttttgaaaactttcacaaataaaggctgaagataaaattttaactgaaagacaggaattttttaaaaactgcacaagcattatgttctaaaagttgtattcccttttttccatatgaatacctacatattatgtacactttataataaatgttaacataattatctcttggtaaaattctgcacaatttattttccttttttgtacttttctgtaccctatgtattttccacaataagattattttactgttgtaatcatggggaaattttatttaatgaggtgggaccatacaatattttaaaatgacaaaaataggcatatgattctcacatattttgtgatattaaaattatatgaagatttcagtcccatttttattcgtttgttgacacctaactataactatccaaatgagaacctataattatttggaatcaataaatatttcaatttctataccaccatgatagaaaattatatcaattgcccattcttgattttgtggtaatttgttgaggactgaggtgtgtcatctttaggctgtattttgacccacctccccttcatatttccctacattgtccaatttaatacatatcacagcacagcagctttatttctttatgcctctcctattagattttgagttatttgaagactgaactctcatttatgtactcaatacatacttattgacaccttaatataccataaaccctattctaggtcctcctggtagaacaatgcagcaggagagagggaggcatggatgacaaaaagctcttaacctatatccttgtgtctgtatcccagctagccctgtgcttagcacctgacaggtactagaaaagcagctgttcaatgaaagaaacaaggaagacagggaggaaaaacaggtgtattaaatcagagcaacaagagaataaatagatggcacagggaaacactatttaatataagtaatgaacaggtgaaagaaccccagaagggtaataagtagtaagtcagaactgtttctttctggaaggcaaaagaaattggactttcaaagaagagaacatgaaaatagtaactttccaccgggcatggtggctcacgcctgtaatcccagcactttgggaggccgaggcgggcagatcacgaggtcaggagatcgagaccatcctggctaacacggtgaaaccccatctctactaaaaatacaaaaaattagccggatgtggtggcgggcgcctgtagtcccagctactcaggaggctgaggcaggagaacggcgtgaacctgggaggcggagcttgcagtgagccgagattgtgccactgcattccagcctgggtgacagagcgagactccgtctcaaaaaaaagaaaatagttactttcatagtacctcccacagaactgcagattcttctattattctcattccttttaaatttatattttcatttttcaatgattataaacaaatttacatactcaaatgcgcttatagcaaatcttaacattccagagacgaagtgttaattttttctaggttaagtcatttcccttgtatctccatgtcccgactagacctacgcttagcatctagtttgttctcaattttgtagtaattagtttttgtgttaaccttggtctaaaacttcccctgcaatccctgtgtaatcatttgaaatgtcttcaaaaggttcattgactatgaaagtggtaactgtgtgtggtgattaaagacagtcacacattctttggcctcctcccaaggcagagagggggtctttgtcttgtcccttttaactggtgcaggatcttgttttgacaatagaccacagtaggagtgacactgtgccattttccagatgaggcattaacaaactgttagcttccacttctgtcttttggaacactctgccttaaaaccgagctgccatgctgtgaggaagcccaaggaaccctttggagagaccctaatggagtggaaagatgtcccctggctgagtttccaggcaacagccagtaccatcttaccagtcatgtgggtaagccatcttgaaaacagatcctccagcccccgctgagcctctctagttcacgcctcatacaactgccactggcaagtcctgcccaaagtgaagattcatgaccaaaataaagatatgttggagttttagccataaagttttagggtagttggtaacacagaaataggtaagtagaacattctggatgaatctttagaaaacattataaaaactcagacctgtgtttgtccttcacacatgagccttctagtagagaatacactaactacacttcagcacctctaggccacatcccattgaataccatgcgaggctcaggcccaattacgcttacttgatagctgtgcaataacaaacgaacatacaacatattcttcacttgttcttggccaaaaggccaggaggtgatgaatatacaacatactcttgtagaatttcagtgctgatctaaatttcagctcctcccatgataatattataaagtgctttgtatgttgtctaaagatttatttatttgtctattgtaggttaattattcacattagaaatggagtattagtttaataaattcttttttaaaaaagactgtgatagcatcaattagattcaaaatgagagggcagttttttctatactaacatcatacgattcttcatctagtgccagtgacaacttcaatagtacataaaatagtagagttgccagtatttttcataaagccactcaaaaagacagtacaatttcattggtttccatttttaaggtgatagaagtccaaaccctcaatgtaatttatgcagtacaattatgcaaagcagtgttcaagccaagtcacaaggtcatttttatataaaacacaaatatacattctaaattttctctgggacaactaaacatgtaaatgttatttaaaagagcgtgcaaagataattcaaataccttgattaaaatgcagttgtagcatttaagataaatggcttcatcacatgaaagatgttcccacaacagacaaaaagttaatgcctctaatattgtcattgaaataagtagattgatgaataggttgtgttaaacggtacaattagaaacaatatttgataatgtatttcagagatggagctaagaaagtacattctgcatactggataaatttgcttaagtctgggttatatgagaccatcagaattcaacagcactcaaaaatggttattatatgggccgggtgcggtggctcatgcctgtaatcctagcactttgggaggccgaggcgggtggatcacgaggtcaagagatcgagatcatcctggccaacatggtgaaaccccgtctctactaaaaatacaaaaaattagctgggcatggtggcgggtgcctgtcgtcccagttgctcgggctgctcaggcaggggaatcacttgaatccgagaggtggaggctgcagtgagccaagattgcgccactgcactccagcctggtgacagagcgagactccgtctcaaaacaaaactaaacaaaacaaatggttattataactctctattttgtttgctttggtaagttctggtcatacagagataccaggaagatttgttatttggttaaattattccacgtcgatgcaaaaaaaattctgaagggtctgaattagtttttcaaatacatgatcaagtatggcaaaaatgcagtgacatctgcatatagacgttgaaaaagcaacaacaggaaaaactgtaaaatgttgtgacccttataaaagctattccccagatattatcaggctgtttttgtgtgttgcatggagtagcaccattttcaattacagttgcttagacaatacaatatatactgttcacaaatcacagacattttagaattatttgggcagagagttccagatttttattttttaactgaagtgttcagctcttctgatcaacacgaagggcaagtatgaatgtttaaattgagaagagaaatcactacttttctgtttctccttaaaatagaatatagtttttagtagcaaaataagcataacacaggacacaatgttattgagtttaggactatggataaaatatctggaatgacattcaaagttaagtttgtactcaacatataaagcaaataaattcttctgtttcatgtagttgctgggacaggcaccaaaatacgcaagatttaaaaacatatatataattgaaaatatcacaatctcataatatgcacaaaagtattttctgacgaaaatgttagacttactaagaaacctgttttttgacttcctttaaattgctctttcacctattgagagatgcaaataattattatcagagcgacaaagaataggtgcatagggagacaatacgtaatataagtaatgaagtaaaagaaacccaggagggtcacaagtcagaactcagaagtgtatctggtaccgattcagtatggaaagaagactagtagaaaaactgaagtatatcttaagattgaaatttgaactgttgaaaaacttatgatgtggaactatgtatggaagccagtatagtctcagttctgaaaaaagaatctaatcactgcatcaaacgtatttctaaaattagtaacagtcatccacaacacctgttttcaaatgtttgttcatcaatataacttcaatatttgaagccatggagtttgtaagcacatgaacttatacatttgttaaatgaaatgctgttttaatactttctaaaggatggagtaggggagatttcacaaaagatttcatttataaaattggttccctgctaaataagtttgaaaacccactgggccagaaaatttttcaaacagtcgctctgcaggacagaatatgaaagaaaatcccagccatgcttaatcatgctccactgagttgaggcctagttacttgctcacaaggcataactttattttttttgtttccgtagtttctctgaatgagttcttccattttatggaaaagaaaatgccattcagttaaacatcctgcatcggtgaacatccatcactcagttcatctcccctgcagatgtgtttctccaccgctttgtgacgtcaagctgcatcaggcgtttgccttatccacaaagcacaaaacttggaccatcagcccaactcaggaaagttaataggagctgattgaacaactgagctaaccgtggggcctgtgggtcattttgagaggcctcagatctctgaataagttggcggtccccttccttttgtaagaccgagttcataagcagcttccaatggagataacaggcaatcgcagtgtctattggcagaggtgtcctgcatggcttcttttccgctatagtgaatgtgtcttgcagataatttcagtttctctcacagagctttcaaaccagatatcaccccactgagacaggaacacagtgattttttcacatgctccaccagaaaatgcataagtcaactgaaccacatggagccaagccttgtgattcttcaacatgctgtaagatctgcctagacggatgaaggcaattcccacacactgggatgagcaggaggacaggaacctcagaaggaaagaaaataataataattctgccctaatcaccaagtaatgctgacaggtgactgataaatagcagcttcctttatggacctcttaactttttggctgtggacaaaataaagccctctttcttgggtctgttttagacccactctccctttcacagagcattatccacagcattgaaaacttgtcagttcgtattccttaaaccacttttcacttcttatgccaatgccgcctcctatgggggaataattgaaagtctgcaatggaatgtagtgattaaactcatcaagagcagatgataagaaacacgaccttccacataaaagggagaaaagcatgtttgtctccagacaaattcatgcaaacctcaaacaattgctctccttctcttgtaaatgctgtgtctttgcttctgccctgcaagctacccaatgatcactccattagatgctacatggactcttgttcaatcattaacagccacaaggtttacttcacagctatccacaactccttgcagaattccaatgctccaaagaactggacaagttacctcttgcaaaactggagaccaatgagatgcctagagatttgtcagataatacaagagaacagacagaatgtttcaccttctccttacaattctcctacttatttttaacctccccaaacaccaaaagccatttgctgtatatgggggttctctatccccaggctgttttactgtatgccatggagatcctaagtaaagaaccagctaatttgccatacctggaatattctgggttataaaacactagatcacaaggttgtctatttaaatattgatatatcacaattttatatttgtaaggactggtgaaataaggagatctttatttctaaaagaaaagaaaagcccacaagtatgtttactgttttatcatttttttagtaatttttaacatcagaagcagttcctcgaagataacatgttcaaatgtgcccagacaacaggtagaatcaactgttattgcagcagattttttttcgtgagttcctccaagaccttgtctaagactgaaacagggacatttttgcttagttgcaatttcacgctttccttccattttccaagttgtggtttagcctcaaggaatagccttgggtatcaatccagtctcatccctcacaccctcttcccatctttatggctagacatttgagatatgtcagcagaggtttgcagaactgcagtgtagtataacaattaaaagccaaagtgctggagttgaacaggcttgaggaaaaaaaattcacacagggatgctcacagctcataggatttttggtgggaataatggacatgatacataagtgtttgataataaataataatagctagtattcatttagcttttattatgctagcactttttatatattaacttttattttcaccatagctatgagaaagatatcatcatcctcattttacaggtgaagattgagacatgaagaggttaaggaacctgcacagagaggtgaagttacttgtccagtgtcatagaactagctcatggaacaatcagaattggaactaaggtaatctgcctctagtgtccacatgttccaccactactttgtaaacagaacctggtacagaaggactgttaactcactgtgacccttttcctccatcactttcttaatcctatagttccccacagataccatgggatttatcatctttatacttttatttataacattgtgcatgttttggctagctcctctctttccccatttccttaactcttaccaaatatgaaggatgcatcctaagctatgaactccactaagatgtctgcacctgtctcttccaggttgagttgcttgtttctcttctacacctccttaatgccacttcatgtcttggcctcctattatctgtcaatgtgtccaattttctcccttggtggagttccttaaggtcgaggaaacagcattcaattccatatccctaggggcttgtagagtacctggtacacagttggtagctaattaatgttgaataaataaacaaatagaaagtctgaacactgccccttggcttttggcaggctcccttcacaaaactaaaattcacctgccttaagtatgtttggaagaggtagggcaagggatcaagctactaggaaaagttgggtaatgtgggtcacatttaaccgagtccaggtttcactgaaattcagcaagaaaccttgcagaagttaaaataaatggcgtggaaaggtttcagatctagccaggaactccactgagcactgagatggaacctgacaccaagcagaaggtaatcagatctgggttaacctggagtcacacacagatagccagcaggagactcactttttctttgagtaggctaataagagaccattgtccattgtattttatttcattgctgttctctcccttcctgcagtatcagtaggattaacatcaataatggggctgtctttgtatttacacattgtaattaagcctagatgaaacctaaagagctctttagggatatttattagcatccagaaccacctcagcttgtaggctacctttggccagtggttggaagacagaattaaataaaacatccactgtgcaatgacaccataaattccctccaggactcctcctgccagcgtgtctgacctcctcatgctacaaggatacagaaccaggttgttgaagattttgtttctaacaagcttatcatggtttaaaaggtctgtaaaaatgagtcacccaagtgactcttgactctagttcctgctaatttagaatctctagattgccacagagaaggcccacccagttatttctggctacccttggagggggcttaaaaagagagaaaaggccgggcacagtggctcatgcctgtaatcccaggactcgaggctgaggcaggcagatcacaaggacaagagatcgagatcatcctggccaacatggtgaaaccccgtctctactaaaaatacaaaattagctgggtgtggtggcgcatgcctgtagtcccagctacttgggtggctgaggcaggagaattgcttgaacctgggaggcagaggttgcggtgagccaagatcatgccactgcattccagcctggaccagacagagggagaccctgcgtcaaaaaaaaaaaaaaaaaaagaaaagaaaaaaagagagagagagagagagagaaagaaacaaaataggggagaaggaagaaaacatcttccagctttttttctggcctttgcttagtgttgcagggcatcagccctcttgtgggggccactgtccatttttgtggatactttagagctgttaaaatgtttcaaggtgtcaaaagtttgcaaagttttctatggcaaaatgagaaactaggaattgccaaaatgcttctttcctcctttaggtcacagccaaaatggaaccgaattcccttgctttctgttatgttatagcagcagttctcaaagtgcggcccctggacctacagcatctgcataacctgggaatctgttagaaatgcaaattgtctggtccaataccaaaatttaaaaatgctggaggtggaacccagcagtctgtgttttaaaaagccctccaaataactctgatggacattcacgtttgaagatattttacagaatttctagagaaaaaaagttttacttttttaaatttaccttttcaccacataaacttattgcatacaatttgatgagtttgaatatgtacatattcttaaaccacattcttttctccctctaaggatgctgatatgaattcctaaaggaaggaatagccaattgtggttggaatatggtcaggatcacccttcccttgcaactactaagagaatatattactgaatcaatatcccatgcttagggtcaggatgaattctttgcaaggaggctcctcagacccttgtgaacactgacttctctagggcagctacaacctttcaccagagtataccctatatctaaatcaccggtagaaacagattacgcttaaccctatgattccatgaaggaaatcattcattcaacgcattctacaaatatgtgttgagcacctactgtatacatagtactgttcttcccttgggatatgttagccaacaaagccaagacctctgctgttgtggagagatagaaaatagatgggccttactcagtaagtacattgtatggtatgtcagaaggtgacttgtgttattgccatcacacacacacacaaatagagcagggcaaggaggtttaaagtgatgttcttaggtttcattcagaaggtggtatttgagcaaagagttgacagagatgagggagttaggcatgccagtaactgagggaaaagcatttaaggcagcgggacagtgagtacaaaggctcaaaagcagaaacatccctgtcttggagagtgacagttctggaatcaaaatactgagaattgatgctgtatatgaaaacaatatccatagtcacaaataatttcaaaatggaaactataataatacaatatcatgcaacacatggcctcctggctctctcaatgatctatagtcttcaacaatgaggacagatgttttgcaaggactctttccccattatctccttgagaacatttgatgaattagaagagttcatttgtataattttgaataaaggtgacagatttgtaaagatctcaaagaagcaactttggaatagaaaatacctaagtcaaaatagactattaatataagaactacatattgggtataatgtaaatgacttggatgatggggacactaaaatctctgactttatcactatacatttcacctgtgtaatcaaaaaccacttataccacaaacctattgaaataaaacaaatgtttaaaaatagactattagcaatcaattataaattaataggaaaagacaattggccgagcaggtttaagaatgtcataaataataaaaatttgagagagctacactaccagatatgaatatttttaataaatctataagacagtatggaagaatagacaaattgacaaacatggaagaacatagaactcagaaattggctcacaagacatacgtgcataatatatgacaaaggttgcactgtagaatagtcagaaaagatggctttttctataatggcactgagtcaactggatacgtccatatgggaaaacagaaaatgaatcctgactgttaagttacactacacacaaaaatcaattcaattagccaggtgcagtggtgcacacctgcaatcccaactattcggggatgctgaggcatgagaatcacttgaagctgggaggtggaggctgcagtgagatgagattgtgccactgcactccagcctgtgcaacagaacaagactctgtctcaaaaaagaaaaaaaaaatcaattataggtcgattgtacatttaaatgtgtaaggcaacacaatgagatttctagaagatcatataaaacaaaatctttgtgaccttggagtaaacaaggatttctttaataggacacttaagcactaaccataaaagcaaaaacatggtaaattgactattttaaaattggaaacctctacccaacacaagaaaccactatcagagtgaaaagggaaggtatccagtaggagaagatatctgcaatccatataagtaatagatgactcataccataaatatataaagaatccttcaatcaaaagaaaagatagcctaacagagaaaaaagagggcgaacacaagaaattcacaggagagctaaacagctaataatcatttttgaaatgtttaatttcattattctttaggaaaacacaaacgaaaatcacagtgatattctgtacatactaattagactagcaaagaatagaaagacatgaaaatattgacttggtgaaatgtggagccactggaactctcctacatggctgatggaactgtaaattgcattaactactttgcaaaagtgtttgagagttaacattaagccatgcttactctataacccagaaattccacttctagatgtaactgacaaaaatgcatatatttgagcctaaaagacatgcacaaatgtttgtatcagcactatttgtagcaactaaaaactggaaacaattcacacacccataaaccatgaaactgataaattaactctggaatatttatacaatagaaattataaagcaatgaaatgagcaaactaccgctacacgaaataaccaatataaataaatctcagaatcacaagtctgtgcaaacaaaacaaaaaacagacacaaaataatagtgtgtataattctatttacaaatggaacaaaaacaggcaacaacaatctacggagttgaagtcaggagtatagttagctttgacagaaaaggcaatgatggggttcaggattcactactccaaaatatagtaccatgacatttgaggaaacaacaaaagcaggaactcactctctgatcttctattgccttcttccccaaagcagaccacagaataattttttttaagttttaaattttttatttctatatattttttgagacagcgtctcactctgtcacccaggctggagtgcattagcacgatctcagctcactgcaacctccacttccctggttcaagcgattctcctgcctcagcctcctgagtagcacccaagtgcgtgccaccacgcccggctatttttttgtttgtttttttgtagttttttagtagagatggtgtttcaccatgttagtcaggctagtcttgaactcctgatctcaagtgatccaccagccttggcctcccaaagtgctgggattacatgcatgaaccaccatgccctgacacaaaaaaattttctgaccttcctctgaagcagctcataagactctcatgagacaggtgcccaccctatacccagaggaaatgaatgtccttatctctaaagacacagtggcacagagaagaatctgaataaactggtcttgctaagttccccctagttgattttcattagatcacatgccctttgtccaagcacacttctccacaactctccacttttttttttcggagacggagtcccgctccgtcgcccaggctggagtgcagtggcgcaatcttggctcactgcaagctctgcctcctgggttcatgtcattctcctgcctcagcctcccgggtagctgggactacaggcacccgccaccacgcctggctaatttttttattttttttttgtattttaagtagagacggggtttcaccgtgttagccaggatggtctcgatctccttacctcgtgatccacccgccttggcctcccaaagtgctaggattacaggtgtgagccaccatgcccagccaactctccactctttattaaacctaagcataaaaaatacaaagggttccctgtttctctgagttttcattgctgaaggctcctatgtcatataaaacttatattaagcttgtatgcttttcttttgttaatcaatttttttgttataagtgcctcagccatgaacctagcaataggtaaagaaggaaaaaaattaaaaaaaaaaacaactttcctctccaacagcaggcagcaggacaagattttctggagctctaggaatgttctgcctcttgataggggtgatggttttatagaaatgtttcttttataataactttttgaacagtgacttcatgatttgtgcacttttctgtatgtacgttacactttaataagaaagaacgtttttaaaactgaaagaaaaataatctaggcttttaacagtaccgtttggtggaagcaacactaaaccaaataacttgaagttccagcttctaggctcagctctgctattcaatagctatacaattttaggtaactcactttaacaatctgagccttgtttttttgcatctgtgaagaggatcccagctcatatctcagctgtaaatattaaatgagattacacttgtgaactgttttgtaaactcctaagcatcacataaatatatgatgcagactagtgggtaaactgtatttgtagattgtagatctagcctgtagccattatatatggcctgtattttttaaaaaataaacatttttgaaaaatcagatgtcataaacattgcttttcaagttactattaaatattagacgatcatgcagtccttggctcaaattcctgatgacaacagctgagtaaaggttgagtagtgtctgtttttcaatggaccatgtactctggctcagcatagtccctatcattcatttttattgacagaatgactaccacagaaatatgagttgggaatccacagaaaatgttattgctaggatttttaaaagctcgtctaaattagaaagctcaatcagattgcaaagttccagactgaacttttagttcaggatctgctgagaaagagagagctcattcactctgccatttctttcctgtgatgcatagttcagtctctgcaggctccttctagcaggcaacccatttaatgccctaaccgtccaagcaggggaaatgccattcaatcaaaaggtataactataatttcagaaatgccaaaggcatgctcagatgggctgtacatttatttccaacagcaggtatctgtcagacgtgcacttcgtgaggtgtgctgtactgagcccattggggcatgactatctctgtccttttgaaacttacaatctacttagggaggcagctactgcagagaagtctgttggatagacaaggaaagtaaatgccagagcaagagctgcaaacagagtgagtgctctggggccccaaggaaggaacaatcactgtgaactacagaaaatctgacaaggagttttagaagcaatgaaatcattaaacatatggacctaaaattcaatgagccaaggccatcccactccttcttcctaggcagtgaccatgaaaggcaatgacctctgagatgaagtcaatttgggataagtgcttttacctcaaattatccaagtcactgtgcccagacaagaatgataaaaacaagatatgaataggactaatgtctttaccttttatgctaaccaaatgcacagcctctaatcttaggacttcactaatggccttaaaataaaaatgttcctttctttagaattgcatgtagtaaatagactgcagtacagaatcagaacaaactcaaaatgagtaggcctgtagaattctgttcaaatctgatacccaaaagtgttatctggaatatctgtcctcttcagcccttggggaaggaggaagagggaatgctggcatccataagtttgaagaatttaacttttgttcgtatagatgttagcaaactaaagacacagaacaaagctttagggagaaaatctgcttgatttagcatttatagctgtttttgtggttaaacataatctattaacagtgatcaatatgcctcaaaaggtgctttcagggaattctgtttggtgatttattgtttgaacccaagccctcatgcagtgtgggaaaataaatgggctgaatttgtgtgtcctgtttttcttcctgttatagctttccctactcatcaagaaacagacctttctaaagaattttggaggctatgaaaaatttcagacttgattgggtggtttattcagaggatgttattttaaggaattttggacaacacagagcagcaatccctaaactttctaagcaaaatattttttttctacagcactaaattctcaacttaatcaacttcacttttcctgtctctatatacattgtacacgcttttatttatagatatagagcattcatttgggtaattaaactttctccactttttttttaataaagaaggaaacaattttaaaaagggagaaagtcttgctatttattgaatgtctattgtattcctgatattttgcatacaaagagacaggcatagggtttgggtgcacacatgaatacactgcatgaagcaacagacttgcatttgggatcatactataaatgcaaactgtgtgtgtgtccctacagtagttacacctgggaaggaagaccggctatgtggaaaaactgttcgtgaatttaagaatatgcatatttggccaggcgtggtggctcactcctgtaatcccagcattttgggaggccgaggcaggtggatcacgaggtcaggagatcgagaccatcctggttaacatggtgaaaccccgtctctactaaaaacgcaaaaaaaattagccgggcatggtggcgggtgcctgtagtcccagctactcgggagactgaggcaggagaatggcgtgaacccgggaggcagaacttgcagtgagccgagaactcgccactgcactccagtctaggcaacagagcgacactccgtctcaaaaaaaaaaaaaaaaaaaaaaaaaaaaaaagaatacgcatatttatcccaacccctcctcccaaatgcagggcagttttagagatttcatgtttctttgtgaccttcttgatctaaaaattcactaagagcaagtatgttagagtcaggtaggcttagtcttgatacctaattctatcatttcaaactgttataggcaattgataaagtatcttccctaagagttaaaatatctttcaatgaaatttcaaactttttcactagcctgatcaattatttacatggcttcctgaagttccatattaaccacattttgctttggtttaagcaaatatcatcttctactttacgtgattggtggaagctgtgttttataaatactttatattaagatttttaaataagatgtagtgatttaaaaaccagagaaatgatattgtcacaaacatggaagcagaatagctctgccaactcctacttgtggagatcgctctgatctccaatattgagcaattaacatttgagttatctttccatgagaagttttgatgaaattttaacggccctctccctcatttccaggatggaggaggattgcaggggctgaagggaaggaatacggaggtttcagaacccacaagcaagtggttcttggcataccctctgccatatgcaaaatttgggcatctcttctctcttctatttaggatgttcatttcttccaaagaactctggtgaaggccgggttaattaacttgcattctcattagaacaacacaaatgacgacacacactggtccggagtccagaccaatcttaaatcaagactttaagtggaaccatgactgaggtccagtggcagctgtaaaggacaagtgaaagattatttagcagaatttccgaatgttagctttagaaacaacccttaattaacaatcattgaggtcccttatgtgctaggtcccatatgcttggcataagagatccttaaggcaagctccttggactcaaggagttcacaaagtagtgagctcaagatctcctacagtcattagcatgtctaacacctccactgttatgtctaacaataaggcagcggacacaggtgatagagcagtaccaaacaagtgacttaactctgtagtcaaggttaaacactggtgattagatagttcaactccaccttcattttgcctgtgggttaactgtggtctacagaaatgcataataaattgaccagtcagaagaacaacacagcagtggttcagggtttagggtaaagaaagcacttgaattgcttgttaaaatgtggatttctgggtcttacctccaagattctgattcaaggtgtaagatgggaggagctgaaacacactgggtaatcctccctctgctacagcacaacacacttgaggcacttttcaatagagtaaaaccccagtaaatgaaaggcttcggctccatagtgggaggcctggatctgaatctggatgtgacacatgttcagagacgataagtggtcagtccaagttcacggtgcagtatgtgttcagtagagagggagtcataacaactacttgcagtgctattgtgagagttacatcagataatgcatgtaaattgctgagtccagagcctgtatgtatgtaattctagccatcattagctgctggccacatggtgtgctattgcagaatcaggacccaaccccagggctttttattcttagtacactgctttttcactgccacacaaggatttccaggaaacactgacattcctgcatcaaaccgaaacgatcaagggctctccctctcaggctaataacttttctttcatttttctgccactctgtccccaaaccacttctctggggattttaactggttgtattcattttagcactgcagaattttagtcaatatatacccttatttttcatgcaccaaatttaatcccataaacatgtgctagagggcacaggtatccaaaaaacacaaagcagagcttgtgacataagaatttttatagtcttagaaaaataacacaaattcaaactaataattcaagatagtacacgattacatattaatatatagtagagaccggaaggactaatgaagtttaaaacaaggagaggtcaatttgtcctaaaatgggaggaaaagatgtcaaaaaggtcatggaacctcagtcaagcaaggaaaaatagaggaatttgctgttattttgaaaaatttcaaatatttacaaattaagagaaactattataattcttacttcctaaagctttcaaatgtgtggtcagaggatcagccacatcaatgtcacctggaaggtcttagtttatttgtgttgctctaaaaaaaagagaaacaaaaagaaaagaaataaaaaagaaaacctaaggctgggtgacttataaagagaggttcaggtcatttgaggtcaggagttcgagaccagcctgaccaacatggtgaaaccacgtctctactaaagacagaaaaattagccgggcatggtggcgtatgcctgtagtcccagctactcaggaggctgagacaggagaatcgcttgaatcccggaggtggaggttgcagtgagctgagattgtgccatggcactctagcctgggtgacagagcaagattccatctcaaaaaaaaaaaaaaaaaaaagaagaagagaggtttatttggcccctggttctgaagggtgtgcaagaagcatggcaccagcaccttcttctggtaagagaatcaggctgctttcattcatggcagaagggtaagggctggtgtgtgcagatcccatggcaagagagggggtgagagagtgagaagagagttaccaggctctttttaacaaccagctctcatggaaactaatgagtgaggactcattattaccaagatggcatcaagacattcacaaggaatctgcccccatgatccagatatgtcccattaggtcccacttccaacactgggggtcaaatatccaaactgcggcactggaatttggtagaaatacagaattccatgccaactctagatttctgtaacaggaatctacatttttaataagatcacatgatttgtgtgtaggctttgagaggtagtagcataatgagcacaaaagtacctatcacccagtttcaacaagtagcaatacctggtcaatcttgttttatttgtacctctgcccattttctccccttatttttggattattttaaaggaaatcccatatactctatcactacattggtaattttttcacagagtacatctttaaaagacatggtcctttaaaaaaaatggctgcaaaacatttactgcacctaaaatatagtagtttatgactattattaaatattacagaaggatttagacagttaagggagaagacaatactctattttggaagaatcagcagagatttaactagctggcttggggctaagggttagtattatcagtactagagtgttgtgaagctgaataatcaaccacaaaatcacctgatgtgaaacacagtgtgttaccagtaatattaattatgtccaatgacttctgtcaggtgttatatcaagggtcacacatcaaaatctaaaaaatgaaaggcacagtcttataaatgggttgcttaggtagtaaaaagtactgaaaatgttaaaacctttaaccctgcaaatggttagtctataaagaaaaataaatttctaacactccagctgaaagttctagctaaaacagatttagaactatctgcctgtcaaagtctgaaagaaggaatcaaccccaataaatgctagcttgggtataaacagttcttgaaggctcaagcagactccagctaaaccttgtaacctctgtggcctttcatggatagtgcctctcttttgaatcaggtgactgaaattacaatggaagcctggacatgaaataaactatcctggaagctatttagagggttaaactagggccagctgtggtgctattgtttcatgatgtttagtgtatttgcatatagagaagatgaagcaaatcagatacactggatacaagccccaaaacaaaataactgatgacagggtaaaacaaaatggtcaatttctgtttcaagggtactccaaagagaatttaaaaactttgacacgttttaggaagataaattcagatggtcaggcaaaggttaacttctggaggacccttgatgtcaggctggggagctggaacttaattccacaggcagtaggaaccacgggagtcttttatgggataaaaacagcacttcaggaaggtgcatctgacaacggcagtcagcaagcgtgagagcccacaagtgggaggaccagcaaagggattgctgaaataatgctgacatgaagagataagccctggaatggttgaagaaggtcaactgaatgtcagccttgagagctacatcagcctcccttcacacaacacaaaagctcttgtctctgccatccaggaccccatgaattccaacctgaaaatccaccataggttgcaggattgagatccccccacacacatcaaaaggaaatcacaggcatggaggtaaggaatacatgacccaaatctgcagattttcaaatgaatttgggttaaatttcctttacacattggaatgtttcagaaagtttataacaagatggagaaaaaatgttgttcacctggatttctttaggtgagcagaataaagcatttattaagaggaataaatttatttgaaagagatgccctgattaaagcttgtagtagaggctactcctaaaagaaagtttttgggttttggccgggcatggtggctcacgcctgtaaccctagtactttgggaggctgaggcaggcggatcatgaggtcaggagatcgagaccatcctggctagcatggtgaaaccctgtgtctactaaaaatacaaaaaattagccaggcatggtggtgggcgcctgtagcccagctactcagcaggctgaggcaggagaatggcgtgaacccaggaggcgaagcttgcagtgagccgagattgcgccaccacactccagcctgggccacagagtgagatgccatcaaaaaaaaaaaaaaagttttttggttttgttaaagagaaagagacgcagagaaagagagaagaaaaaagataaaagaggagagcaagtgtcatgggggaagcggagctgtgctgagtgtgatgtgacaccctgccatgccatgacccttcacattgacagtaaagccaccaaattacaagataattgacatgagtcaacttgtacatctctgggtataaaccagttaaagagcggattgtcaacaaacctgaaacctagcctacatgtgcaattaaatttctgtaagtcaaatatgagagcattgcttaaagggactctctaatgcgtctttaaaaatatgaataaatcatgccccaatttatctagttggtaattaaggtgcttgactatcaggggtatatgtgtatatatatatataaaaatatatatataaatatataaaatataaatatatatcagatatacatatatatacatatatatatgtatatataaaatggaatggtcctgtaacttctctctgaaggcatgacgagaaagagaaagcctggttatgtgattcgtaaaatattcactgtttaaaatagaatcaggggatgggataggcaaggaagatttggaagccctccaggatctggctgagtgatgtgcctcctctcacctggataatgatgttgttaggggctgactgagggatgagtagggtgatggtggctctccattcctcactaatgtccccatccgagcatccattttctcatttatgatctccttgacaccgactctatttacatgacattgggattaatcagccaggagtttttagctgcaggaatcaggcaatccgtgtaactcagcgtggcagcgtgacattatcaccagctaagcaatattcgctctgtatgatcaccatctccagggaacttgctgtgtgataggacttcaggtgctgaagtcataaaccattacactcatccccgagcagtcgtatgacacctttcctcaaggacagccatggaaaaccacactctggatccagcctgatttatcagcaggatcagcaagggcaccgcagaagtttcagtcatcagctgctgcagggaaagataccctttctccacttctgtggcaggtccatatatacagaattacttgagactccaaacacaaaccattatctctgtggcaaattatctctgtggatttctgtcaagttacccctaccactgtatcacaattactcgttggcctgcctgtcagcccccaggagaatgtgaacaccttgatgggaagaacagtattcacagttctctacctggtgtctggcacaagagaagtcctcaaaatatgtatggtgaatgagtgaaagaatgaatgaatgagttttggtgaatgagataatggttattttatcaaagaaagaaaacagaagttggtgttaaatttgcttctcttcttgtcgtattttatcgctcatgaattgaattaatgagcagttcttaataggaaggaggtgctttctagcttaacttctgccaggtaaatcagtggccactgtatcttaagctggtaaagccactcagatggttgaaaaggaattccagcgtttacactaacatatattggaagaaagcattaaatagtttctcacatgactacccttaaatgctcaattccccatccttttcctcttgtgaaatgggcatcagggaacagaaagaggctcatattcaaacacacttgggttagactcccatctgcaccacttcctatttctgtaaccttgccagacttggtttcccaagagcctctgttttcttatctgtaaaaccagagtggtaatctagaccacatgcaattttagtcactacaatacagtgtaagtgaaacgctgagtgtaaagtttctaacatattgcctgggacttcataggtgctcattagtaagagcatcattttaatcaatcggttctctttagagagattagcaatatttggtttgtgggagtaatgggctatattggttaaatcctcaggaaccccttcataattcaatcaagcactgttgtagaaaccaaccaacaatccaaccatggaaacagtgttttaattatgtgctacatctgctggtgtaccccaaggttttcatctgtaagcaattcagtctctcattatctctctccttttcactgaagggcatcacagattgcatatgcttacttctaaatcaaggaagaaggaagtagatgtgtgacccctgcaagccacttaatctcgcttgacttctctttgttcatcattaaaatgaatcagttggactagacaatctctcgggtcttttggctcaatggtttgtgattataggaaaggagtactcatagttcctagataccaaatcattaagtcagtccagttaaaaactattaaaccaactgaagccaaataattttcttaactttgctttagtgggaagattactatatagtaagcccatagcatgtacagatactttgctagatgctctctcatggaatgtcaatcaatagttatacttccatttaagcaaattcctagacaaacctgactttatgtttgtttttataagaggatgttttggtcattcactggcacgctagcatcattctgtaacactgggaggataccataaaggcatttgcatgatggccaatattctctttcactagtcagaagaatgggtttacctgttttggagcacattcgtcaaaagaattcccactaaatctacttatgtgggagctcccatcctcctcaccatacacttctcattcacgcattcaactgcaaatatcagtcttggtattccttttcctgcaattctccataaccacagtgtgtagcaaacattcagtaaatgttagctccctcccttccagcaaaatcctaagagtgaaaggagagccacttcattttaatcctattgcctaaattctcaatgcatcattcaattaatccaacagacatatattgaaactttattttggtaagaattaggtactctagatacgggagaaggtaaataaattaggccattgatactttagacattacaattaagaatggggaagagacacaaaccaaatacacccacacacacctacatgtatatatgcatacaaactcattctattttctcactcctatccaagttttaggttggcagccaggccctttatctttcttgtattagggacttactagtgttgaaaacataagccacattctaggtagagggaacagtgtatgtgacatctctaagtcaggaaggaacatcacagcaatgaaagagttgatggcagatgcgtttggaaggcagagagtggaaagtagaggagcctaaagtgagccttggagggacagacacatgcagcaagcagtgccatgtcgcacaataacttagaggttctaaaagtattttaaccgtttttctacttgaaaaaaaattaaagacatcaggagtggtctactccatgttgctttttaagttttaagaacatctcttttgttgggtcgagtgccagtctccacattcaatacttaagtaccaggtgaccgcagagaagcataataatagcattattaaaagtaacagctgtcatttattgagaatgcctaaagttctaagctaagtactctatatccatcatctaatactcatcttctatctacaccctgaggtaggcattatttttgtccctaagtgacagataagaaaatgcagttaaatatcttgtctgaggtcaatttgtaaaccccaatttgtatgattctaacttctctacgcttttgcctgtgtcccacactttatgtctcagttctccacacccatagctctgctatctggacaaaggaaaatcacaaatacaacaggtgtaggcacatattcataagaggttttaaagctgaatttcacagaagtaaaaaaagcaatttaacttggtgttttctttgtttggaggcatattaaaaagttaatgaaaaaacacagtagtggcaaaactcacttgattttgaacaggaataaaacttttctcaattaatacaagtcatcattttaaaggcaggcctcatttttacattatgccgagtttaaaactgaaaagattttttaaaaaccaaagaaagggaaatggaaataaagaggaaagctatactagaaggaaaactgattggatgacaactaagaaaatgacaaaatcacaaggacaaaaaaggaacaggacaaacagcagaagaatgaatgaaaagggtcccactgtagagggcagaggagatgccaactcttctgcaattcacccaagtctcagaatttcatgcttcccattaccgttcttagagaaaccatcagattaaaaactactgttcacagttctcaagctgttcttttctcagaaactggtttgtttctgaagggacagctcagcctatgtggagggtattcatgcagacggaagcagaggtctacatataaaattagacaaaaaaagtcagaagtttctcatcttggtttgaaaatattgatagaacaatctccttttttctaacccctggaccatgagaattattacatgtgtcaatagtttcttctttcatttatagctaagctccttcatttggtttcatcaaaaagtaactttctagtgatccttttcaacccttgccagatttttttttccatttctaatgcatttttttctagccatggcccacaataatcaccaaattagcaatctgaaagcaactgatcatgcctatagccatttcaagaatcaatgcctagggcttggaggcacagagtaacatcacttggcaaaccgccttgaatgactatttccattcttattgaaaaagactgacttttctgcaaggtttctgttacgttagtagaaaagaaaaacattgcattaatagcctcaaaatgtgaatgacaaccaatttgtatctctcttttttttttttggtgggggggaatagggtctcactttgtcacccaggctggagtgtagtgacacaatcatagtgcactacaggctggaactcctgaacttaattaaacagtcctccctcctcgccctgtcaaagtgctgggattacaggaataagccaccatgcctggccaaaatgacatcctctctgagcttacctctctaacacttcaaaccatatttgtgttccacactaaaactcagcatcttttctgcttctctttagctcccattcccaacttttcttcactaggaccctgtgtttctgctttccaaagccagaaatctggactaacactgacatgttattcttctccatatgttattccatcatgtttagaatcccagacatatgcacagtccggcataccagtggagtgaaaagagtgcccataggactcagtggtagcatttgcaaccttttgatagagccaagaacagacagccttactgcttctctgtgggactaagactctgaaggattgcagtttgaattggatctgttgccctaagctgcattccatatatataaataaataaaagacacgtagacacacatgtccattagtaagaactcttgttgcaacaattaacaggcatcagctgggactaatttaagcaagaaagggcaaaaaaggggaagttattacatttataaagaggcatggcatggatcaaaagccttgagggctgaaattaggacataaaaaccatcaagatccccgcagtgttcattgtccatgtttttccttgatttctctttgcttacctgcatttttttcctttctttcgctcttcagttcacattctgggtagaccaggtccaccctggaactcctagagtttctgttttctgttagttacagaaacagctgctgcccctcaattctacctctagtttcctggagtgggaaatctgatatcaaccagcaatgagttagaagagctgagtcacttgctataaataagcctgctgagaacctccccttgttgccctatggatatgtggagatgtctccagaaaagaggggtcttgtgagttgggcgattctccacagcatctaatgccgcagggaaatgacaacagagctgttattgctgaaactgttcactgaaagaggcaatcattcagggctgaaacaacacaattaaggctccttcccaccctctcttcactctgcgcacttaaactacatgataccctcacacttactgctgcagtcatcaacctagcaacaagaattgactactgcaaggatttttgccacaatcaccactgaacctgtccaccctgaaatctgcctgtacaacgagctcaccatcttcttttttaaaggacggcatatgtatttagtctgttctcacactgctataaagaactacctgagactagataatttatgaagaaaagaggcttcattgactcacagttctgcaggttgtacaggagggctggttggggaggcctcaggaaacttacaatcatggtggaaggcaaaggagaaacaagcacatattctcacagccagcaggaaagagaatgtgcgcagaagggaagtgccacacacttttaaatcagcagatctcgtgagaactcactcaccatcacgagaacagcaaaggggaacctcacccccatgatccaatcacctcccatcaggcccctcctccaacactgaggatcgcaactcgaaatgagatttgagtggggacgtagagccaaatcatatcagcatgtttctaaaaaccagtataatgtgccatgctttcccgatcttatttttcataaagcctcagtctcacagctataaaaacacaataaatagtatgattcttggcaggggcatagcataggctgagcaaagtgtctgatctctatagcaaacaggtgatgatagagaactcaaacagaaacatattcatctaaaagtaaacaccaatttctctatgctaagctcttactccaattaaattagcaaattaccacataacagttcaataagatagagattcccttgttttacagactacagatcagagagattaaatactcccattaacagtataaagaaagcggctagagtttagctagctagttgttttcccctccttgaggcttatcgaagtttttgctgcttttcttaaatcctcacccccattctcttattttcagaattctgccatctctagtacaagtaagtgggtttctgcttccaggagaactttccagccatgtggggtgagggagcctagagctggtgagcctccacataaagaaatacagcgttaagcaaggcagctgcatgtggcacattaatcactcctgatgctctgggagaagtgagatacaattataagccagctaatcccctagttcgttggtagtggggtgggaaaactgttaatcagcatcacaaacacatttggaaagaggcttccaatagacagcttggagagaacagagataggctgatcaattcaacaggaaaatctcttatttgtcacatctggaagcaccctggttaagtcttaattagattgggtagtaaagaagatctcataaacacaaatggtggggaggggtagagagggagctgaaggctagtcagtcaatacagttggccatgctccaagtatcagaaaagagcccagagtcaggagcacagacactgcttcatcagggaagtgtgcgtgagaggcatttgtgcgctttccacctttctttccttcatatatcaattaaaaaacaacactaataggccgggcatggtggctcatacctgtaatcccaacactttgggagaccgaggcgggcagatcacctgaggccaggagtttgagaccagcctggccaacatggagaaaccccatttctattaaaaatagaaaaattagctgggtttagtggcaggagcctgtaattccagctatttgggaggctgaggcaggagaattgcttgaacctgggaggcacaggttgcagtgagccgagatcccaccattgcactccagcctgggaaacatgagcgaaactccatctcaaaaaaaaaaaaaaaaaaaaaaaaaaacaatgttcatagaagaaacaaagcctctctgcagctccatctaaaacctaaagaatgaaagaaccatctctcccagcaggatgaattagttggacattgactcccagcctttttcaccagaactccttttacaatttttccccataaacggtatgttttattttcgtaatcaaatataaaataatttaatctattcactcatttttaactaaattatacaagaatgctaacctgatctctggatcatggtgatataatcaatgtaatcattatccagttgaagaaatatctaaaagctggaatgacttggctattctgtataatcaagaacacaaatgcatgtacaattttaattgggcatctgtaatataaaaaagcttagtatattcattaccaccttttttttaatcccaagaaatttctagattagatggaatacactgacccagatccagatgatttccaggccccctacatctttttagatgtggagacttatattctgtgccagtgtttttctaaggcaacttagagcatttggtccagtgaagcttcaaaaaaaaaaaaacaacaaaaaaaaaaacacagaaaaacttcacatgtaacattacgcatggttctctttggaggaaagcatagtgaatcaggtgctgtgcttctcatcaagaatgtgacttcccattacatgattaaatgagagtaccttcacctgaaccccgcagcttagtgccctaccattcaagcaacgccataccagcagaaccatgcttttgcagaatggagtgaaaaaactctcatatttatcattagtaacaaattaaaagtgaatcagagaactatgtatagtgttaaatcatctggagctccacggtcaatcagattttctacagatgaggcatagggctcactaactgattgcaaacatcacctacaatttgggcttttcctcttctaacttgctttgcctgtcaatggaaaagctcgtatctcacttaaaagctatttcacatttgaggatcattaaatcactaatgtgttttagaacagactaataggtaaagggacagcacttctagaatacttacactcttaagtgctttacttgaatggtctcatttaatcctcacaaatatcctatgaaatcaaccttataagtatagttcccattttatatctcaatattatatattacaaacaatatataaaaatatatattatgtttataacatatatataatatatatagtttgtaaacaatatatatattgtttgtaagtgcagaatcaggatttgaacacagacagtgtgattcttgagcctacatatttctagtatcccataacgttgtatttgctaggagtagagagaaattaaaagcccatctgtatgtatagtttcatttgatccagcctgcttgaaggggaaaatgtgaaaatgttttaacactttggtcataagaaatgttgagttattagatcctttcattttgatacagcaataaaaaataatatgaataaaaatagtataacaactattttctcatagaatttacattgtaggtattctaagtaatctacagataatttaatgtaatgtgtataggttttatgcaaatagtacaccatttacataaggacttgagcatctgcagattttggtattcacggggtcctggaaccaatctctcatggatactgagggacaattgcattcgtgagatagaaatgaggagtcttgaaccagtgccagtattctctatgctcccagacacatataatacagacctatgataattgaggagagagttgatgacactggcataagtgaacttaagtcctctgcccaccaagcctagaggtgatctcatcaagctatttgggttgattggcccaaagagtcattgcatctccctgagctggttccatgggactgttcttaacagagatttcaacacgtaagagctatacctgatagaacaggctactgcctcagatccaaagcactgagacctttttaagcagcgcttccttctcatcctgcatctcacgaataccctctgtgaaaatatctgtacccagaccaccacccaactctcatttgagtgaaggaaatctcatggttaagaaaatgccaaattctaaaacatttaattggatgctataatcatcctccttatcgttcaggcttctatttataaagaaggctccattcttgcttgttttctatgtgatcatttatgttttaaattaggaaccaggctgggcgcggtggctcatgcctgtaatcccagcactttgggaggccgaggcaggtggatcatctgaggtcgggagtttgagaccagcctggctaacatggtgaaacccctgctctattaaaaatacaaaaattagctgggcgcggtggaacacacctgtaatcccagctactcaagaagctgaggagggagaattgcttgaacctgggaggcggaggttgtagtgagctgagattgcgccactgcactccagcctgggtgacagactgagactgtctcaagaaacaaaacaaaaaattaggaaccaaatatatgaagtcagtctaccaaaaagctcagtgatggtgagatgcttccatggtgacacaagttatgtaactggctgtgaagtgtgtgagggcaggctaccgcaagctcctggggaggagcagtaggccaatgtactcatttcagaactgcatacagccctgatagcttaataagaatcaaacaaccataatatgtttgcatttctatctggctcccggactcaaagaaacttgaataaatattggcacattttataaatgagctgtgggagtggggaaacccagcatctttctcatataaaatcagttccaggcaaaattgtggagaaacttggtgcaattttcagaatactgaacattatattgtttttcctgcaaataactcatccaattcttataatatccctttgaggtaaacaccagaaaaggatcattagtcccaattgcttcagctagagaggctaataggagaaacttgctcatcaagagccaaaccaaatttcaaagggagaaactttctatgtgctttgttttgaggtcactttattgatttttatttatttatttattttgaaactaggactcactctgttgccaaggctggagtgtagtggtgcgatcttggctcattgcagcctccgcctcccaggttcaagcgattcttgtgcctcagcctcctgagtagctgggattacaggcgtgcaccaccaggtcctgctagtttttgtatttttagtagagacagggtttcaccatgttaggctggtctcaaactcctggcctcaggtgatctgcccgcctcagcctcccagtgtgctgggattacaggcgtgagccactgcacccggccctttatttgtttttaattcctccatgtagttatttacagccaagtgtcaccaaacaaagctatagaggaaaaacggagattcatcaaagactgaattgaagcttcataagcttccctagatggggaaaacgaaaagaaaaacaaatttctcctacagctgtagaaaacatgtaggaaaaacgtagggagaagcagctgagaaggaaaagcaagcaagcacttagccatgtaatgtatacgggtcctaaaatcagacagaggactgtcgtggggtgggtggggggggagagacagcattaggagatatacctaatgctaaatgacgagttaatgggtgcagcacaccaacatggcacatgtatacatatgtaacaaacctgcacattgtgcgcacgtaccctaaaacttaaagtataataaaagaaaaaatcagaggtgacttccagctctgaatcggctgcctagtaactatgtggtctcaggcaaactgcttaaattctctttgttttaaactggtaaaatggggataaagaggaaagtagacactgcccacccccaaccctgggcagggggcggggggggaggtggtagtggtgaggactaaatgagataatgcacatttaatattcaatattatactctgtcttttaatccctgctcatagattagcaacaattagttcttttttggagactaacagaaaagttaccaaaaccgaacttcaaccaaagtttatggcatgataatctttcaatcctgaatgctaataaaaatgccaagggatcacctttagagttaatgcaaaataaagaggagtcatttacaaagcaaaacataaataaactactaagcacaattaagctaagtaatatgaaagtaatctaaacagtgtaaaattaaaaaaaggatgactttctttgtaaacaaaaaggaaaaagaaatcacgcctgtaatcccagcactttgggaggctgaggcgggtggatcacaaggtcaggagatcgagaccatcctggctaacaaggtgaaaccccgtctctaataaaatacaaaaaaatagccgggcgtagtggcgggcgcctgtaatcccagctacttgggaggccgaggcaggaaaatggcgtgaacccgggaggaggagtttgcagtgagcgtagatcgcgtcactgcactccagcctggcgacagagagactccatctcaaataaagaaaaaaaaaaaaaaaaaaggatgacaaacttctgaaagtatgccaaactaactgaaaattctggccctatataatgttgccctcttgtctgtcctgtagaaacttctaaaatgtaaatgtgccaagaatattttaatattctttagcatgagccaaagtcacttaaatgttctggtctgattctttcctgcttctcagaataactgagctcagcccaatctttctggaaaagcagcaggaagaagcatccttctttcctctctggctcccctgcgggatcagctggaagggatggggagcctctcagtctcagcagtcaccaattaaccacctcctaagagctcagcagctgatctgttttttaaagagactagacatcttccaccactgcaatctatgttaaatagaactagacatctgaccacaataaccgaaggttaaataaacatttcttcacagaatatagtaaaataaggctacttactaacaactaaggccccggaacagtggttcacgtctataacctcaacactttgggaggctgaagtgggaggatcacttgaggccaaaagttcaagaccaatctggacaacatagtgaggccccatttctacctaaaaagaaaaaaattagccaggctcctgcttaagtccaggagttgacgccgccatgaatcaggatcacaacactgcagtccagcctgggtgacagggtgagaccccaactctaataaaaataaataagtaaccactaaacctagtaagacagtggcaaagtgataacatttatatccttccaggattcccaagttactgttatcaccgcactaaccatgctacacaataggcaatgactccatagagtaacaccctactctatgatatgtgtgttgctttaactaatggcccagggttttggggtttttttagttttcttcttgccatgttaatttctctgggggcttatgctcagatcagtaggaacgtcagcggcaattttcctttattgactttgggttgcactccacatttaattatgccagataataactgcagaaatactatatggaatccaagtcacatatccagaacacagggacagaacatttgtgaattcaccccttatggtatttggcccaagactcaaggacaaatttcttcactgagcagctgagatgtcacaagtaaaataccctctaactttagtatgtaaagccaatctttagtttataaagacaagaaaagcacctttctgaatttaggccagtgacaagaactctctaagcctcaatgtccccttctgcaaaatgatcatgattaatatcagcatgcatctcataaagaaaccggattagggttgttgtaaggattacataagatgatgtatactgaacacttagcatagtacctggcagagtagccaaaaggatttggtagcagcagcagcatcattagcacttaaaaaactaatgagactggtgaaactctctgaaagttacatggtatttaccagcgttggaaatgtcaataccttttaacccagcagatgtatctcctggtatctatcctagagaaataatctcatacacagcccaaagagcatgtaaaacgctgttaatataatacttgtttgctataacaaaaaaatcctcaaataacttaaatgcctattattgacaaaatcattaaataatattttattgtacaatgtaatactatgcaatagtgttaaagaataaggtagatttacatgtactgacacacataaaaatctctaagatgtattattgctaagcaggaagaaaaatgcaagttcagaacaaatgtgtaataggaaataatttgaatttagggaaaaaacagtaaaatacgatatattttaccacataaattcccacatagtgatttacccaggagagcacattggaaacagggtctctcttgctgctgcagttaagcatttgatgatgttgtctatctctgctactttctgaaatgtcctggccaagaatgaaatatacttagataaatgttgagttgcaaagcaagaaaggacaacttctaaaggggattaaaaaaaaaaaaaaagaaagaaaagcgagaaaggagatttctgataacttcagcattaggatccaagggggcctgaagctaggtctatcagcttgacattttagttacaggagcaataattcctctagttacggagtcagttttagtcccacatgtgatttttaatttgcaattgaaatacactcaaactcccagttttttttccttcccctacacccatggtttttaaacatttttgttcctatattcaacagaattttatatagaggcccagtatgtaaatccagctatctagtgaaaggtgaggaagtgagaacacagacctcagaacccttagattggtccgacagaggggctaaggcactacatttgaaacaaggctttcagagcatgtgtctctgtttcctagacaaaccaattagtgttaaagtgcctcgatttctttatcccaaatgagaataataatatgttccctatctatcttttaggctttgataacatgaaaagcacagctcttaaggcattttggaaaaatgcaaatctttcttaaattaaaaattcttgttccagtttcaaaactgagtccataataaagatttcattaaccttaaaatgcactatttcaagcaaagagatggtagcctttaaaacttcacagtgctgtcaaccctaaaatacagcaaactcttaagcacatctcctgtaattatgcttgaaattatcacagtaaataaaaggtgatgacaaatcagacagccacggatctcctgttgtggtttagaacttgtatctataaatttcattctgtctttgagtctggtgtaatcatttctggcattgtagaattatccagcagcgcaacaaaaacaagaactatggaatgacaataataacaacgaatagctttacactggcaggaaagggcctggcatttaccaaattctaaaacagaattctcaaagagactcacatcatctagatttataaagagctttggggaacatctagaatcaggctggtaaataagttttctctcttatgctaacttggatctgttgggtagtgactactttttaaggccatcctacttccacatgaatgtgttgtgacagatgggcaatatcttccttgcacatggacaaataaaggggtggctctcatgctgtgtacagggaacccctgattttaccagcggggaagtgaactatttttttttttttttgagacagagtttcactcttcttgccaaggctggagtgcagtggtgcaatctcggctcactgcaacctccgcctcctgggttctagagattctcctgcctcagcctcccaagtagctaggattgcaagcacctgccaccacacctgactaatttttgtatttttagtagagatggggtttcaccatgttggccagactggtctggaacccctgaccttaaatgatccacctgcctcggcctcccaatgttctgggattacaggcatgagccttgccggaagtgaactattaaacactgacacagctcaagaaggccatgttggagcttctgtggttatcccaagaataaatttatttgttaagatatttaaactagatttctcaatttatcccaaagatcccaggcttctaattcattctttttcatgctctgtcacccattcaaatacactattaagctaaaaaaattttgtcagaaggaaaaaaataatgaaagagaattctgtaagacaaacctttttaatcataagaaaacacttccagggaaatgttaagacctctctctggatcctcagtcattaagatctaggctgggtaaaaaaactggaaagcatctaaggaaaaagtaaaccccgttttgccccatgtcttcagggaggaggacatagcaatgggaattttaacaagacttttctgtcacgggttctcattcaacctgcaggttttatgttggaaggtaagtcttacaatgttgattccgccgtctgaatgattaatgttctcccttgccagataaaacgatgctctttttgtggagatataagggaaacaggcaataactgcattgagttttaggaagaacagctctccagcaaacaaagcaatacagtttttctgattttctttaacattatttaacaagttaacgagtcttggtactcattctggtgcgctccttcccttcctgtcaagcttgctaagtatctaatttccctattgtcttcagctgttcaaggtcatcatggcccccaagccaccctcctccctgccacaatctggccctgtcctatcccttcagcctcaagtttcaccaccaccagccccttctgccagccctatgatgcctactaaattcggcaatggagtgtttcattgtgggatttcatgattaatgcctgtctaccccactaagataaaaagctccataaaggaagatctgtgtctatgttcaacacatagtcattgaatggaaccaaatcatctttccgaaagtcctgctcacttcacgtctaggtttttggtaatgttccataaaagtaggacttccacagcttgtccatactgatattctcctggcgggatgtgactttccttgctggtgttcccattcttgttcacacgaacaacaggttgcctacaaccatcaatgtcaattcttttctaatttttctcttctctatcctgctggaaacaacaaaaaaagcctgtgatggagaaccatgtataatgaaatcaggagatctttctttttaaccatttgttttcaatatttttctggtgatcttcaccttgattctcaatatcaatcttatctaaccaaataaatgcctagtcatcacctcattaaacaagaaaacaaggaaaaggaaaagaaagaagtcaagatatcctgcatgactaacatggccaaattctgtgtttagccttaaggattcaaaatataaataaatacataaacacacacacatgctttcccccacaaaagaaaactcacaaataaataagaaatgtgccctgattttaaaaaaacaagcaatgtaatttatgaaataaacaaataaataagaaataggtcctgcatttaaaaaatgtttcattctaatttgtaaaaaaaaaaaaaaaaaaaaaaaaaagttggcagggcaccgtggctcacacctgtaatcctagcactttgggaggccaaggtaggtggatcacaagatcaggagtttgaaaccagcctggccaatatggtgaaaccctgtctctactgaaaatacaaaaaattagccgggtgttgtggcgggcgtctgtagtcccagctactctggaggctgaggcaggagaatcgcttgagtaggttgcagtgagccaagatggcgccattgcattccagcctgggagacagagtgagattgtgtctcaataaaaaaaaaaaaaaaaaaaaaagtgacaactaaacaaatgcaatgatgtattataggtgctgcatcagatagatggaaaggggtgtcagttttatattgaagggttaacacatgctgcaggagatggatggcatttgacataaggctttaggaatgcatatgaaactgatagtgccctgaaagatagggagtttaggccaaaagagaaggatgcgcatttgagtaacttcagatccttcagtctggggtatcaggccttgagagaccaggaccgtattatgaaggaccatcaatgccaggttaaagagctggactttattctgcaatggggaactgctaaaggggagcgatccaatcagacttttgttttaggacagtggctataagcttaagtgtgcataagatttacatacatcaaacactgagattctgatccaaaatacctgatttcattataagggtcctaagaagctgaattttaattaatcctggtggttttcaggtaagtagtctgaggtccatacttttcctaaatttgctgcaaataggaaattgcagctgccactattgaccagaatgaaaaggtcaataaaatgaatctgacctttcccaatgttcctactgtacaactgggaggtattttcagggtatgcaatatctgacttgaacttcatatttgtagagtgttacagggcatggacaacttgggcccagccatgcattctggttttcaattcagctcatcaccaattctccacagaaagggaaaagggtcaacctatccattaggcagagtttgcagaatgcctaaggcacacacaacagttttaaggggccatgccaatattttaatttattttaaagtcaggaaaaaaaattttaagttgagaaaaatgtttaaattaataacatggatatatatttatgtgtgtgtatgtgtgtgtgtgttatgtgaatatatatcttcttttttttttttttttttctcagttgtgttcttattctgtcacccaggctggaatacagtggcataacaacagtgtactacaactttgaacgcctgagctcaagcaatccttcacacctcagtctcccaaggaggtgggactacaggtggatgccaccatgcctaatttttttttttcttttttgaaacggagtcttgctctgtcgtcaggctggagtgcagtggtgcgatctcggctcactgcaacttctgcctcccgggttcaagcgatcctcctgcctcagcctcctgagtagctgggactacaggcacgtgccaccacgcccagataatttttgaatttttagtacagacagggtttcaccacgttggccagatggtctcaatctcttgaattcgtgatccgcccaccttggcctcccaaagtgctggagttgcaatcgggagccactgtgctcggccacctggctaatttttaaattttttgtctattttgttcaggttggtcttgaactcctggcctcaagcaatccttctgccttggcctctaaaagtactgagattacaggcatgagcgactgtatgtggccacattaatatgtttattgataaatatatttaacatatttatgtttatcaataaatacatgtaatatatatttctgtactactaataatatatctatataaatacaatcaaaatatatttttatggataaagagaccccaaatgcaaaagtgcctaaggtctacacaaatcaacatacaacccagaaaggatgggtgagaaaatgcagaggtttaaaaactctttacacattgggcactgacatgagcctcatgtacgtcagagggtgggaaaagaagtgtatttttgatataaacaggaggcaaagaatctgaaaagaggaagggctttgattccaaagaagggattatttggctttctaaatttctgtgttagttgctgaaatctaaaaacctcccagaaaaatgcaatcttgaattaggataagcctctcatgaggacccaaaacactgggtctaccagttagcatagaaggtatgaaagagcataaagcaaagaaggcttggtatttcataagcagtccctctatcatgatggtggctacatatttggatttcataaagtttccaggaaaggatcatctggcattctgttttgttttgctgtattttattttattttatttatttattttttgagatggaatctcgctctattgtccatgccagagtgcagtggcacaatctcatctcaccgcaacctctgcctcccgggttcaagccattttcctgcctcggcctcccaggtagctgggattacaggtgtgcaccaccacacctggctacttttcgtatttttagtagagacagggtttcaccatgttggccagcctggtcttgaactcctgacctcaagtgatctgcccacctcggcctcccaaagtgctgggattacaggcatgagccaccatgcccagccagcattctgttttattttagataaagtccagatgtcagtagaacaagtcattaaaaacaaaactaccatagtggatgtcgataagcccacatgacattatgcaaccctttccactttaagattgtctgtacagccctgataggttattattttgttactgtcgctttaactcacttttctaccagaaattttattattaggcatggtatctattttacgtaaggaaaatgggttattctgattatcagaaaaagtactttacatatttttgttaaagttgctcttatattcaaacttctcactttagcattcaaagcccttcaacacttggctacaggctaactccacactctgttctcacttttactgcactctagccaaaacggaccatttgtcaccgcagtgcgttgccaatattttcccaatgttatgtccctgctccagttgttccctgaaaatggagacccatctttacccaagcccatctctcatacccctgtttaggaagcttgccgggtgcgttggctcacacctataatcccagcactttgggaggcagaggcaggcagattgcctaagctcaggagttcgagaccagtctgggcaatgtggtgaaaccctgtctctaaaaaaaaaatacaaagagtagccaggtgtagtggcacatgtctgtagtcccagctattcaggaggcggaggtgggaggatcacctgagcccgcgaagtcaaggctgcagtgagccgagctgcaatcatgtcactgcactcctaggcgacagaatgagaccaagtctccaacaacaacaaaaagactttactctctggctacctggatggggcctttccttctttctaagtcttttgatactgttttgtacctttcttattgcctcaatcattttaacaccatattttagttatgattaggtattttctgtcttgattatcagactgaaagtaagtgcattacagagagtgagctttagtatacagcaatacatataagtggtgctcagtaatgcctgacaaggtctttgtaacaacataaattaccttagcatgtcatctcactgtctttccacttactttgcctcatttttcttcatggtccttaacactactttaaatcctatactctacgtttatttgttaatttgtctttcaattagggtataaattccaccaaagtaggagggcattgtttcattcactgcggtagccccaatgactaggacttttccagggatgtgatatttgcaaagtaaatatttttcaatgaattatttaataatatctaataagtacttataaatgaatattttatggcgtacgtgaagatggaaaacgtctcatgaccttcagagttgagctatctcccctatggaagcttacttaagtgtacctcttcacacccattcacatcgtaggtgacaccattttttggatggagtagaaaagcaatctgtattcagcccaaaggaaaaaccatagaagggacagaaccaaaaaacagaagggtggcttttatgaaggagctattttgacacagccacatgacactaaggccatgtttaatgacagtagcggtaaatttgtgtttcagaaacctgtactaaggactctttaaaaggagaatagcaacacattgagggcaaaagagagtgtctgagagagaagcagacaattattgcggcactactcacaatagcaaagacttggaaccaatccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtggtgggaattgaacaatgagaacacatggacacaggaaggggaacatcacactctgggtactgttgtggggtggggggaggggggagggatagcattaggagatatacctaatgctaaatgacgagttaatgggtgcagcacaccagcatggcacatgtatacatatgtaactaacctgcacatcgtgcacatgtaccctaaaacttaaggtataataaaaaaaatacaccccagggcaggtggtgagctctgctgcctgaacccaaaatttcagccatctaagaaaatattttgtctgctacatgcctgggttgggacctgtcgtaagtttaagtgctaaaacttcttcattgttacatttctattactgggaaactccagcttctttaaataagaaaactttcccttttgtttttcacttagcattgaagtttgtctttaatgtattattcaggtttgggcaacgattaattaatcagaacccttttgtactgggagactagaactaagtcttggctaaatcacaccagatgctccaaattagattctgtcaagtggatgacggtatcaaacattcttgttaattatgcagtaaaaattacaagaggctaaagatgaatttggatttttaggagtaaaaattttcctggtgtcttggatatatgtacgatgctaccaaaattccacctttggctaatattttgtgtgaagagagaataattattaaacgaaacgtaatatatctcagcttagaagtttcgcttcaagcccatttaatgagggatatcagtgcataaaattagtttttccacaagtgtacatgcatattccaagtgtttcaaggaatctggcccactaaaacatgatcctgtgagaaaaggtctaatcagccaaaaaccttaacccttaactttaaaaattagcctaagggggagattcagtcaaaacagatatatttgttagttgtattcctgaatctcaggtattagcggattcagtttaatagctgatgcttacacataatggttagatttctttctcttttttttctggcaacttactttctagggctgacaggtttttacagaaaatggtcacttttaaacacctgacagagaaaaatcacatgtgagaaatgaatcaatcaaagaacaggagtgtatgcttcagacataaggaaaattccttttccacaatcagaagcagctgattcctgtgaggagaagactctaagacattgctttctgattctgaaggatgtattttgattgtagaacagttcaatagaaaccccagtgagaataatggcactctatttaggctttatttccagaaccttctagtcctgctaaaagtaggcacaaaatggctttagtggcacctctcctcaaaactgaattctgtatagaatttaatatgccacaagttcatcttgtcagcagttgaaccaaagctcctgtgtacttccaagaaatggatcaatggacacttcagtccattcttacagcacagaggaaatgggactgggtattttctttttagaaccaaaagtatcaaccaggccttcttaagtatatatatggttttgcaggctagagagtgaagctctctactatgtcaaagaagagtgggctgaattttcccattgctcaggcatcatccctccctccacatctttacaacaatctagatgagtcttccttattcattcacatatcctttcagtcttttattcattaaatcgtttaatatatagtatgagccaggttctgtgtgacataaagttttcttccttctttccttcctttttctctccctccttccttccctcccttccttccacaaataacaattgaacacctacaatggatcaggcactcttttaagtattaggcatacagcagtaagcaagaaagtctagaatattgttctcaaggagcttatagtttagtggatggcagcacacaagtaaatagaaacaataaatgagaacatttcaaatttcagacagccacgtgttatgaggataagaaaacaaggcagtgggatagagagtgcctaaagttgatgtaatacttcagatctttccaaggagctgaaatcttaccagccataaaaatatctagtagatgagcaattgtccaggctctgagctgagagccattttgtcaagtccatagtacagaaagctcagtatgtgtctagaatattgaattggaacctgaaagatgtttacaatccagtgtggaggttcttaacatgtttctagttgtcaacgccaatgggtgtatgaagaaagtttagacagtttctccagaaaaacacccatccatgcttctaggcacacactaagtatttactatattaactcagggggttcatggatcttttgaagcccatttgtataagccctggagattcatggactcttgtcagagtggtagaatgatttttagtgttatgatgctgctcttaaaataagattgaactaatttgtactggcttgcatgtctgtgccaagcattttcagatacattaataatttaacatttataaaatgaaaccaagaattccagagatgcagtgagttgtttaagacacgctaattcatgaaagggctggtacttgaacccaactttttagatgctaatcctaccttgccaatatcctcttcctgacttaaggactaagaaaattgttggcacagacttttcagtgacataaatcatctctgtgtcctaccctgccttggtcttatggactactggtgttgcacagaactgttttgcaaagtcaccctaaatggacttttacagtctagcctcagcctaggcttggatcttttgttattcatgcttcaattgttgctacccacacctaagaatttagaatttagtgtcatctgcaggtttcattagcaagctgcttattacagctcttccaggtcattaatgaagctgttaaatatgtctggttctggacttccctgtggaggcctgctggctacttacgagagactcatttatcatttctcagcactgggaatctatggacagcctcagactcagggatgacactccagtccaaatcaaggatcattttcagatttcaagatatgtctaatcaagttgcatctcaggtaactgaaccttgagaggtatcactcactgcttctaagaaaagtggccatataaattatcaacctattgggattctttttttaagttaaaggaggtataattacccaggacaacaaatgtgatgaaaccctacaggctaaatcaggctgaatgtcaccttagttctccacatcttcagattcaagtattatttactgagcacctactacttggtaagcacatttgttaagtatcagcactttaaaggataatgcagacataagttaaattccaacctccatggtcacagaaacactttcagaacaacgacattacagaaatcttaaatctgcttctggactcccaaggatttattttcctcttcttctcatatatctccatgaattcttattctgctacctgtcaacttctgttctataatgggaattttttttcattgaaatttgtaaattatattctagtgaaataggcccttattagaacattagtgatagaaaaaggcctgaaatccatatttgtagaaaatgatcctttctttctcattgtgttccatagaagattcacagcaatcaaaggaactcttctctttctcctctagccatttttactgaaagccatgtagctcgctattactttaaggatgtaatccacacaaatcaaatatcagctactttctgaatatggcaaaaccatgagtcaatgatatatctaactttggaatacatttcctatgtgtaaatcaaaagcctacagtccaaaaccatgcttttccctcgcttatagccactcaattatttcactctactgtctaagaaaccctgtcccaagtcaaattctatttaaactctttaattgtgatttccgctagcagagtactgatgcattagtctctccaaatatgtaacccctacttaaactttaaaatgcatacctccggggaaatccactttacacacttatgatttattatattgaaataagaacagcttttagcaggctttttgccattactggaagcctttaaaatatttagttcaagaacaaaacaatccacgggtcacaatttgccagaagtaaatgatgataggcaaaggttaggtacgtagttgtatataaactgcagagtgagcaaacacatatttattctttaccagttgtatatttcttcttcaattagaatttttagtcaattgaaaaaaaaatgtctccaactggaaaaaagggttgacttgtatctttgaagagttacaatatttgaaactcacatatggatagcaatacaaatttttcccactgagttcactgaaaacgcttgcaaaaatctgcctggggtaaaagaagaggcaaatcaaatgattcagaagcaaaatacgtttcattataaatacaaataagcagatgccctggtgtcttgtgaagattttgctttctttccttcactgctaggggtttccaagagctccttcaatcatatagtttacctcctgctgcacacaccttgtctgcatttctgaaatgcacatgcctgtctggcaaacagcactcgtttctatacagagtccctatgggggtaaaatcaccattgaagtcagtagttttgaacctttattgcacactttagaatcctctatgggaataaaaaactgctgatacctggaacccatcccaaacagattcagattgaattgatcagtaggacccaactatgagaatttttaaaagctctccaggtgaatctaatatgtatcaagtgtcgaaggctaccgattcagataaaatttatttgtaaatgacttgacaacaagtggttgaaaacgaatatgcagtatgattcagagaggggaaactagaagtaaaaatattcgcaacagaggtgatgcaagtgaaaatgtgaacaacaatgcaaatattttaactactttaacatttttactgtgataggttggtgaggcagactctggaacaatgcagaattctaactataataacatttttttaaaaaaggtatatgtaataattgggaacttttgttggggggtttcctgaggaagcttcagctgagatctaaagaatgggaaaaaatggaccaggtaaagacagaaagagtccaagtagagagattcccatgtatgtatcacctatgtgacagaaaagagctggacacgtttggtggacagaaagaaggaaagtctggctggaactgagggcaaaagggctagaattttaacagggagtcaaggataaccatggaaatgtcacattcagagccttgctgaaagtctaacttgacagtctggggcaggcagtgaaaaatgggtcatctaaatgctgtgaactctactccctgggacattcattaattaatagccaaacagcaaaccacagggcatgagctatgctagccaacaaccagagttgtctaagttgttaaattcagccccaacatttattttgacctgacgtgaacaaattatttaccatctctttgctgcatctgtataatgcaattaatagtgaactttcctcctcaggcttactaggtaaagataaagtggtatcacatttgttgagccctcatcaatacgacatgcctaataagtgttggccactcttattagaacttagaagagcccatcagatagtcagagacacagacatgaacacagatacctctgatccaacagagaatgtgctgaggaccagggggagctgaaatataatgctggaagagcacagagtggaagggattaattttgaatcatgggaccagggaggtcttcatggagagagaaggaggtgtctgggagaagccttgaagagcacaccacatcaccttcctagtttcttctagtttattttgcctacatcaacagctcttttatccctgttactttccgtgttctaaacaacatcaaactcaacatcaaattactagtaatctctcatgttaagccagaatttagaagagaagcagagatctggcacaggggaaacaggcattgatgtaaaggaatagatagtgagtttaagttatacaggcaggacttaatacatgtccaaagttttcctaggttacttgcaatgacgatgactttggtacatttttattacttacagaaagataattttaaaaaacactttaaaaaagcaaagccagtcttgtatttttacctttcaccagtgggcagaaaatattgctctgggcacatgagtgctgttgtaagtgtgctctgcaggatttgagcaggtgatagaactcatccattaatacacaaagttctgcactttttttcctaccagacagcagcaacagccatttgattcaaagggaggggagacccaacagagggacaagagactagaaaaataatacggctgaacatttctaattaacacctggagttaccttgtggtttcttcagaaatagagacgagatcaggatataccaggcaccagtctgctaagagcacagactagctcagcatgagccatgtcaggacagaaacgaggagacatattctgttcaagggagtttctatcagagccagtccataactaccttttttcttctgaatactgaagtcacctaaggggattgctttgagagattgcccttctttacagactcccctttggcaatttgagctccagccacgaagaaacaaagctatttaatttcagaacccagtagtttctttatgacatttggcagaaacaaaaagtgagaagttgtagaatgagctgcttgtagacattggttgttacagggtaaaagtgtcgggggggcttcaatcacaataaacgtcctatcaaccattataaataatgtgctcaggaatgagaaaggacctcagaaaggagcctagatgaagcaatgtacttttatggtttagtaagctgagcaatagggcaggactctagagattctaaactatcactatgccctgaaagaacaagtcatttactgaactctgctcttttgcctcattgggaaagcatgaagcacgatcactgccccaccttgcagggtgacgcagaaggagagctaggagccatccatgtgcaagacatagatataatgtccttctcttgccactgagctttccttttaattttaattgttctctgccaatttctgagaaagagaatgaggtgtcatgtattctggaggcacagaaacttggctttgcagaaggcagcaacttatgaggacagaggaaaactatctcttatcatataattagcacataaccatcgatagctaattcaaacacttatggaaagcaaaataacatttctctttctcactcaaccacttataagtgataaaaagcaagaggacaagaaatggggagataagttaattcaatttgcaaatgcaatggtaaaacgtgttctctgctcacccaaacttcttccaagacagacagagaaagtcagagttctgtgtctaactttactataattttacagtaaataaccctaacccagtaatgtaggagaggttcatgtcaccaataggccaggtaatggatatatttcaaacaagacaatttaagctgagtttatgttcattccctatttatgcctgtccccctttcagcgtgccctggatggctttcttgtcaccgtgtgcacggagactttcctgattggctttaacatccagttcccgctttctaaatcctcaattgcttgaccactgacctttccctgtcctgaatgttatcactaaaacttcaaagagcatggctaggacacacaaagaagtaaaaaacacaccactagaggatgaaagactagaaaagaatgagatcagcactgttgattcttaaatcatcagtggataaccactttatgaaagagatccatccccagaaaaaaaattattcataaaatgagtttcttgaacacaaatcttacttacaaggggccatcattataaattcagcaaatgtattatttcttatacacacagaaacacacaactcagtatctaggtttagttcttagagaaaggaattgattaagataaagccctgttctttatatacctggcattataaaactctatcagtctctgtctcttgggagtcatatcctcaaacctggggctcgcttttcccaatttctacctctgcaaacaagggcccaattgcattcaactccaaacccaaaccaagtaattctttcttatgttaaactaagccagatagagtttccacacttgagctgtcactgggtctcctctctcttctgttgtcctctctccttttctctccctctttcctgccctctctaaatctggtttctaacaatgtctaatagaactgcattatttgatttgccgagcatttttgttgctgttgatggaaaaagaacacatatatccttttcacaatgcaactgtcaaaggacagaaataacaaccttcctatagtggaaatatgtccacggaccttgtgttttgtttccttgtttagagaggagtctcactattctccccaggccgcagtgcagtggctactcacaggcatggtcatcgcactctacagcctcaaattcctggcttcaagcaatcctgtggctgcagcctcccaagaaactgggactacaggcatgacccacagtgcctggccttactggccttgttttaaagatatgtaagagacctaaaatcaacttttaaaaaaaattttttttttattttttattgagacggagtcttgctctgtcgcccaggctggagtgcagtggtgcgatcttggctcactgcaaactccacctcccgggatcacgccattctcctgcctcagcctcctgagtagctgggactacaggtgcctgccaccatgcccagctaattttttgtatttttagtagagatggggtttcaccgtgttagccaggatggtctcgatctcccgacctcgtgatccgcctgcctcggcctcccaaagtgctgggattacagccatgagccaccatgcctggcctaaaatcaacttttattcaacatgacagagaactagggatttctggttaatacacattctggctaatatataatttttatttaaatagccaacatggattgtcattcaaaaaacctagaacgtgttagtatattattaacaaagaaattaccttgactataattttcttcgatgattcagaaggcacttcaggctgtcttactatctcaggaagtaggaattcccagtgcataatgcctgagtttgaatcccagccctgtcacccatctgtatggtcctgagcaagttactcaccacttttatgcttcagtttccttatcagtaaaatgggacaataatacttatctcatagggtggtgagttagaatatagaactgtgcctgtcacatggaatccaaaaaataaatgttagcaatcacaaatactggaattactaaataccattatatgaaagtactggctgacatgaaattttcatttatagttccagttacctaagattttattttcaggtaatacaatttaaagcatttcaaatcttactctgtttgaatatcaaatggcaataaggtaaacacaattttgcaactttttcgagaaaactagggacatcaccaactaaaaaagcacattgctaatagcgctgcaccgggtttttatcacgtgctaaaactcttccctataatgcatcttgtgatggaaaaccaataagtaatttttatattttcattgatctgaatttgtttctatgattagtgttcatataaaaattccttagcataatctaaatcatctctaacacaagacataaaaacctgtctttgttgttttctcactagaacctagggttacaagcaggccagccaacaagctcaaaacaagggacttcactccacagaactagaatgaggccaaaagcaaatcccacgcacacattataaagacactctttcagcaacagtgacaaatgcaagcattctagtttcgctgaaactgtgacatgatatggctatagtttcctacacaatcttatttttcaatgttctttatttcaagataaggaccttgaaacaaaagcaattactttgctttgttttccactgtttaaaggcattatctctggttgagacaaaggctctatgctgcctggtaactgcccagatgacagaagagatgcacacaatcccagtaaaacaagaagcccagatttcctgggaggtcataagtgacaacaaaagaaaaagtcactgaaacgctgtggatgtcaggttcaaggacctgcagctctgctcttgtaaagaatccaagggattctgtatacaggatgggcctgtttagggctttgactatgagctttattatgaaaggacctttggagcaacaggagatgagacagtaatgaattctgtaaaatgaaagggacctcagaagtccgtctggcacatccttctaccatcaagcaggcttatgatccacaagccagagagtagagaccctactttattttatgcttttggatgttaaaaacaaaagtagattaaaaaaaaaaaccctcagtaatctactcacagacttgagagtagacgttctactaaatgaaataaaattgaattacgaagtacattagaatgccagagatttgattattatgagggtcaaagaatgcttctgacagatgacacagtggtctttaatctaccatgtgtcctcatacacagaatccttatcattgatagcacatagctgtactctagctgacaaatcgcctgccagacctcatcacacacacacacacacagtatcccatatcagatatgtacacatgcacactggaatattaaaatgtagacagaaggatggaaatgacaatgaggatctgaagtttacatgctgtcttcagaatgttttatccatctgattttcaatcatttataacacatccaataatctgttttcccctcatctgtaaaagtggggtactagtactgaggagggttcttgcgagattaaagttaattaaaagatgagaaagccatttgaggatagcaaaatgtagagtgaggcaaatttctttgctgtaattttttattgtcatgtacttagtgaagcctcagacgtagcaaacctaaaaatggaagctgccagaccttctctgcactctgttcagacaggatggttcagtcctcatatttcccaacatcctctcaggcctcaaggaccttccttgggatcaaagtcatttttctgtgctcaggaaaaggagctgcccaatctatatctttgccaacaacccttttcccttactttgtgatatttgtgaccatgagtccccggctcacggttttctcctctcttgacacttgcagtcatgtttactcttagacaatatctttttacatgaaaaaatgtactaaatgtgactcatttagcacttcctttattatctcataccgtgtctttcttttcaatgagatttttaaggagctttaaaaaatcatattttagttaattttattgaatcacaagcctctaaactaatgtcttaaaaattctcaataaatgtgtactgaatgaagtcctcacattttcaaatatcttttccctttctctttccaagttaaataaaaaaatttatcttctgtttctactccagccagatatatctatgagtaaaaaataacagtaattttgcctgacaagtataagagctatgctagtgatgtattccatcaagaaaaaggaaagacaattttaaagaaaattagacataaaaatgaaccagttcactctctgcaaagtaatctgatggtgtttaacgagaatttttaccatttcttatcatctgtatcagggaagaacatatacaaacaaaagataaaggataaaagaaaaataacttgttcaaaaacatccataatgaatacttacaacatgaaaggtaaaaggaataaattcccaagcaaacattagtatggtatcataacaaaaaactacatatctaattaaaatgcttactttcagtgtatgaaagaagaaaaatgactattttctagtaatagtttaaaaatttagaacacactattttgtagtaaaagagataataaagatgccatccatcaggtttttcgacatctcttatgtaaaagccaatgcaatacatcccatttatactacagtacaagagaagaaaaccctataattaaaaagccaacattcttccctttttaagatgatagcaaaagctccataactcgttatgttttcctttttgccttttgtgaacaagtcagagcaaaatgtaaggctccaatacaacagatcttgagttctggtctaattattttcactcctttcattatttgcttgctttatttctcacataacttatggcttcattttatctctctcatataatgttaaaataacttaaaattattttggaaataagtagggcacactaaacacatgaatgactcattaaaaactgcaaatatgctgattacatggcaatagagaaatacgttaacagaataaggttaagtgaataatatatgtgaaataaatattagaagagaatctgagcggacatattggtagctaacctttattgagattttactctgcattagacactgttaaatgtatgtcacactttattatatcaattaatcttcatagccatcctctaaggcaggtattggcaccccacctccaagtccctcatctttagatgaggagacacataaagaaattcactgatctatccaaattcatgcagctaggaagctacctgtgtacaattttaatatgtagagtttattttcttaacttcaaagagcttaaatttataacaataatctttatttataaggagaattgacattgaatttaatctcttctaaatttcatggaaaaatacaagctatccctttgatcttcagcatattttgctaacattaacatttttaatttattaatatttcaatagtattgttttctagtatttcaaccacaacatggcagaggaatgaggtggatgaaattagtttgggtggtggcacatttaggttataattacagttactttaattataattataattataaacataattataattaaggcacctttttaattaaaatactcatgaaaacagaaggagatgtaatgttaaatcaccacaggaagctagaactcttgatcacccatctaccatagctaacgataattaatgcagcctagctgggacatgaggtcagaatttcagagccaagaaactggaagttagctgctcaaacaccccagggagactttgccacaaaagagaatgcaactgctctattgtgatccgatttgcaaagcacctgggtttatgacatgcctctattacctcctttcctcttacgtcagtatctcttttctctccaattcccataactcaacaagatcaaggatactgcatcttgaaatgtgaagtcagtggtaaggatgtgtgaagacacaggtgttttttacagtgtttcagtctgctgttttgtttttgttttttcaaataattctttgaaaagggggaaaaatcctattgcctatttcaaattacccaggaataaatatgcttctataaagccagacaatcagccagaggaagtagatgacctttccttgactcgtaagaaccttactaggctctgtgagaggttctgtgatgaatgactgtgagacaccacaaagttagctaagagaggaatatgtaccagtataattatattcctacatacatgcttatgcacatctgtaaaatatgcatcaataaatataaaagtaaatgggtatgggtatgggtaggtaaggaaaagcatcaacatgcaaggagttacttctgattagtggaatatgggagtctttgttttcttctctagttgattttccattttcatgttttctaaaataggtagtcattttaaaataaaactgttttagaaaaagcttcagaagaaatggggatacttgaatacttgtatgttactatttctatgagaggagagcactccaagcttgtggaaagctgacaaagttctgcaggacaaatcatttaaaatcatttaaaagctggtagcttttcccattctggttaataaaaagtaaccatgtgtaccatatccagaaaaaccaattctcaagcactaggatgtctgacactagaagatgtttaatgcaatttaatatccttttgataatttgaaaggcaattcacaatctcatggttcctcattgtcatcataaaaaacaaattctcactgactatgagtctaagataagcctggttatttgagttttcatttttgtgttcttcctgacagggacttagctttatatgtttaacaatttatatgagcacatgtggatgcagatggtaagattgtgacatcaatccttagctctcttataccaaagttacatagctgaatgaatttgcaacttcttcctcattcccccatattcccaatgagaaatggagagttcatgacagtaactctctggctgcattgaaatctgagtgcattttaaaatacttgaaatgaatgtagaatgggaagaacagtaaagatatcagacttaaaatattcagtagaattcaacactttctaggcctcattgagtcgaaagacattaaccaaccatcttcattatttatacccctattctatccccactcctttcactaatagtttttattcacaaatctttaaaatccttttagacagcaatctgtggttttcaattttccttttgaaaggagttgaagtcatttctattttaacatgtaaacattttttcttagctagggatagaaaagattgaatacggtaccagcagctgggccttaccttcttagaatcctaaaccccgatctggaagggacattagaaatgatttatccttatttgtcccgccctcatctcctctgacacccacaatcaattaatgcatttggcttgattaattctaagtcttcaacaacctgacactcaaagatatacttttcctacccgggggaaatggtgaggaaaagcaaatccactctagctcacagttcccgctattcccaagaaaacactgtttgggagccagaggtgataaccagtaaagtgactgctctgcgaagccttttctccagtctgcttcccatcatgctccagtttatgtaggcaatcttgtatactgacctgcatttatatgctggagttttattcatacttaatcctctgaaggtgtatttttgaacatctatccagaagtgagatctactaaattctttccttctcctctcttgcagacagcaacctgttttggtgttgataaactgtgttatatatttgtgtaattatgccatctctgtaagctctacaagactttattatacatgcctactagtcctggaacagattagaagaattaactatttttgcaaatagcttccatctctatgatctccatccatcttcaagacaaccacgaagggtagtcactgtgatttttatttaatagaggaagaaagtgaatttcagggtttgtgcctaaggacaccatctaaatagtggcaaagcagagtagagaacctgagggaaggcaactccggcccccaagcactgtttccctgggaacagctggaactatgagctcgagtggatttgcttctcctcactgtttccctcaggtaggaaaagtatataattgactgacaggttgttgaagactgggaattagtcaagccaaatgcattaattgattgagggtggggggaggcagggatgggatggataagggtaaatcatttctaatatctcttctggttcagaaatccaagaaatgtctgtaacatgaatgagcattcactttccctaccaacaccacagagcctaagcgagctttgcacacactcggtatccctaactaatgttttggctcagccatgagaatgcagcaaatcgtatttaataaaaagagccacggttaacactgagtgcttcaaaacttctaatattatgctgaacattttctttctctctttcttttctttctttctttctttctttctttctttcttttctctctttctctctccctctcctctcctctcctctcctctcctctcctctcctctcctctctttctttctttctttctttctctttcttagggtctggctcagtcacccaggctagagtgcagtggcgtgatctcaactcactgcaactttcgcctccagggctcaagcgatcctcccacctcagctccccaaatagttttgtttgtttgtttgtttgtttgctttgtttttgttttgtattttttggcagagatggggtttctctatgttgctcaggctggtctcgaactcctgagctcaagagattcactggcctccgcctcccaaagtgctgggattgcaggcatgagccaccactcccagccctaggctgaacatttcatccataatcccatttaatcctgccagaaatgctaaggatgagtactataatttctctcattttaaaaagttgaggctcaagctcccaagctcagtgagtagcagagacaggattcaaacccagactgtttgattctagcaccaatggcttaaccaataccttctcattctaataaaaacatatttctctaaaccttcataaagtaagcactcagtctctacagagactgaatctttgaagagaggtggaactcttaatggtcactaatatttttatgactttttttcaagtgttaagtttgcatcaaattaatctacctgactccttttctcatttggtctggaatggagagggcagttgtagctctgagcccatgcttggggttccaagcatcatgatcactttctattgccatttattcatgaaatatcttctacacttaaccctggagttgtcactgtactttgatccaagagcctctaatcccttcaggcagaaaactactctgtgagttgctaccatgttcattatccttcaattgttttacaaataaaaatgtttttgagtgaaatgggaatgtgttatgcaagccgaaaggaaatctagaaatattacttagtatctttagtcttccttttcaaatatggtatctatctgaaagtgaaaagccgccatctgctacaaggctctacaaacgagtctattgcactagacactggagactcaaggctagtgaggaatgaagtacaatgatcaagtcattgagttaattatcattaagctttgactctcatcttaagattcaaatgtatactttgttgtagtaatttaatcatttctattatttttttaacactgtccaaatccttttagtaaaaactcaaaatgggactgagttctctaaaaaaagattgagagctataaaaggagggagaataaatagtgtgttcccaaccatataaatggaaggaaaggagaattgacactgttgacttgtcatcttgggatatggaaaatcatctttctagccatagttgggccctctgtaatataatcttgcttactagttagccaaccctaatactagaggtgggattatcacagagaagttctagccctattgtgtcaatcacagctctttgctagttaaggaacaactcagagatataaaaaattgggaatgtgggaggggtacagtaaaaccacagacagtttatttgaaaggtagcattgttttatgggagctggctgaaactcaaactcatactggagatgaagcagctccagagatttcagctgtgggattttgatgtcatttttcctgagttctggcattcatggactcacctgctctctaaatgtgtactatcatttctccttactccttactgacatattaatagtttccctggattcaaatccaaaccttaggaaaaagagtggctacttagttcaacttaacttttttttttttttttccaacaggttgctgtgcagtttgcagacacttatctgggtaaccatctcctaatccttgcgtgtatctgggaaaagatcatattggcctcatagacttgttcctgctgcaaaactgcaggtagcaacagtccctttgaaatggaaaataaattagttgagaactccaaaacatcccggtgtaattggtgtaatttttgtatgcatataactatattgataagatatagggaatgctgtgtgctttttaggaagagtaggcatgaaattgagtccataaatacagctttttagaaactgctactttcatgattttatataaaatgatttaatttatcattaagagaggcatgcaacagcacataaaagcaactggaatcggactgagttcaaatacctgttctttcaattattaactgtgtgatcttgaataactcactttacctctctgattctcattcagtttcctcatcagtgaaatggagataataaatagtaccaacctcacgtgaattgttgtgaggattacatatttgttaaataaataaatatatgctagtactcagaaagtgcctggcacattaagagtgctatctcaagtgttaacattaaggatgatgatgactcaaagctcctatctcacaaaggtgtcaagaggaagaacaaagaaaaataaacagaaacgctgcttccatggcaagcttggtacagaatagttttgttagccctcttaagactccctctctcattctttctccgaggttttgcttgcccctaccaaaatgatgttactgagaggcatgcgaattgctttcagtaatcatcatcctccttcccctccctagtttggaggaattctttctaatctgctttcgggaagccttttactgcaaatctggaatccactcaagatctgggcttttggaaagaaagacttgaaagatctgtcaatgacaaccattgtttttcctatcaatttcctcactgaggcaactgaactcccagcacactacctgcttgtatttggtgaagcagtggacgataacaagggggaacaacagactaattcctcaggatattatgaagtcacacatgccttataccagttaaaccttatgacaaatcaccaggaaccaggtactaacatggttagtctttttctgaaggttaagtgaccaaccagtaagtatttgaactagcattacttcaggcataagtcggcctgactctaaacttcaagagctataatctatttcagaaagctcaccatgaactgccgagcatggtggctcacgcctgtaatcccaccactttgggaggccaaggcaggcggatcacaaggtcaggagatcaagaccatcctggctaacacggtgaagccccatctctactaaaaatacaaaaacaaaattagctgggcgtggtggtgggggcctgtagtcccagctacttgggaggctgaggcaggagaatggtgtgaacctgtgaggcagagcttgcagtgagaagagatcgtgccactgcactccagcctgggcaacagagcgagactccgtctcaaaaaaaaaaaaaaaaggaaacctcaccatgatcttttttttcttggggtggagggaggcatcgcccaagtacaataagcaattatatatatgaaacctaactggtgagagacagcacatcactgatagattcccaatggtgcctaaacacatacttgttattttgttgttgcagctggttatttcatccacctttctgactataaactgagttctcaatccaaaatgtgtgttgaatttattctgacattaagggtatactattgattgaataagcacgtccagaggagtgcagcatcctccagctaaggtggtcatcccggatatgcattgagagatatatgacccagagaagaggggatgtgattacaaaactgtgacatctacgtttaccatatcaccacctccagagctgaattcacctctattatttccatatttctgaaattctgctgcagactacattttaaaaatcacatgcctattttcttttcttttccttttttttcttttttcttttttttagacggagtttcactcttgttgcccaggctggagtgcagtagtgccatgtcggctcactgcaaccttcgcctcccaggttcaagcgattctcctgcctcagcctcccgagtagctgggattacaggcacccaccaccacgcctggctaatttttgtatttttggtagagatggggtttcaccatgttggccaggctggtctcgacctcctgacctcaggtgatccacccacctcggcctccaaaagtgctgggattacaggcgtgagccacctcgcctggcccatgtgcctatttttaaaaagcacctttgaattagataaattcgtttttgtttgaaagaagtagtacagaatccaaacaatgtcttatgcaatgattatcaccttcaatgcaaagaaggaatatttaccagctgcctctttaaaaaataagatataattcacatatcctaaatgttactatgtaaaagcatgcaattcagtgctttttagtatattcaaagatttgtgtgaccaccatcacaatctaactggaaaacattttcatcaccccaaaagaaaccccatagcagtaacttcccactgtcctaattccccagcccctgaaaaccatgaatctactttctgtctgtattctttgtggaagtgtctactcagaatatttcatataagtggaatcatacaatatgtgacttctcgtgcctgacttctttcacttagcataatatgttcaaggtttcttcatgctgtagtatgtatcaatacttcatttttatggctgagtaatatcccattatcagtgtatttgttcttgggttgttcccacatttttcctagtacgaataatgcttctatgaccattcgtaaacagtttgtgtgtgtgtgtgtgtgtggacttatgttttcagctctttggtgtacatagctaggagtaaaattattggatcacatgttaactccatgcttaactttttgagtgactatcaaagtggttttcacagtagctgcacacttttacactcccacttaatggtctctttctgcactatgagataaaaagagttaatgaaaaataacagaacaaaattgcagaatttaaaagctaagtgtcacgcacttatcctccatttaaagcatctttccctaggcctcctactatgatttggtggctacaaaatcagagttccaagaaagacaaataatttactttcatcgtttataaaatccatttcttttattctttaaatccattctattggctctcacagaacacgagtaatacagaaaaataatacctcgtttgtgattgaactgtagcaaaatttcacagtaaaatttcaaaaagcaaaaatttcaaaacaaaaattgtcattatcacttacttaatgactatgttactgaatactcttttggagaatctaattcatgtacacagacacacacatacatatatatataattctcctgtgaagagctatgctatataaagagatttgtaattattgtaatagaaggtaagatatcttaaaaaaaaaaatagtcccataaacgaggcttgctactgacctcagtcagtaaccaggaggctttcatgtggcatctactaggtgcttgacactaaataatgcaaaaatgcaaaacgtaaacatttgctttggctatatccagtctaaggctgggcacacgacagtgaccggcaggagtcagagtcacagtccatatgcctcagagtcaagttgccaaaagagggagcatggaccctggcagagaaaactggttgtcctccgcagcaccagcctttacggcagaaaaaaaaatgctggtatttttttaagtggttgtttttatttatgttcactctccaaataattctcaagcctcttcttctttttttatccatctatatctcctttactaccgtaacagtgttgaagcttttacgggccagggctccactgaaaacttaacaaaaagaaaacttctcctttgaaaagtgtctgtgtactcaacttttacacagagttgtgggagcttatgtgaatcccctgaagccaacctatgaacctcttcgaggacacctgcctgcattatggtgagtcatttcacccctggagcccttgcaatgtgaataaggatgtcctcctacagttgttctgatgaaaaatgtgatcttttctttgttgaattgtcactgggcgcaccacatccctggaaaatcatccctctagattaatctacttccttggatctaagaactgtacttatgaaagcacccttcaattagcattttgccaactggcactactaacaaagacaggtcctaacactcacactagtcagtccagtcagcggacagaaaccacatcacttacttaaacagagagaatttaaattgaagaattgttaactattatactattgttaactagataattgaagatgtaaaaagagaacttgaagatattacagaggaagcaactacagaaagcagctaccccagggctgaggggaaaatggaaacaggttggcaatatgaaaactcagaaatatagaggagagacccaatgaggtaaaactctgaagatgggatgcagcatggctcctctggcatctctggtggaacaccaggcaatttgttcctggagtgttggaaaaactgcaaactggatgcagctgcagctacaggaaagaactcctgctgcccaagtgaagatgcgttgctgggatgaagctcagggtaacaggaaggagacagggagcaaataaggaaccagccctgacctcctcctccaaccctgcagtcttcctgaagcaccctctgcttgcagagcttaacagggagcctgcaggcaaagcaggaaggctgcagaggcctctccagcttcccaaagcagagtgcagaagggtaggtttggagctaataataactggcacgcaaattatctcaatgaaaagtctctagattttgttaaattctgaaatcagcaattgaaaaagttttcatctgcataatagatgccttggaacggctaataaccccgccacctgcactgagcactccctatgctctagagtgtaacgatttagttaatataatctgtaatttcacttaatcttcataacacaaattccctgctctctgaatatacacacatacatgtatttatacatatatcttcatatacttacatatatttctatatacatacatacacatatatatatacacacatatatagacacatggcgagagggagagagagaacgagaacacttgcattatttgcgttaactctagagatctagaataaatattatatatttattcctaaacagaacaaaataaattaaaaaagaaaaaaaaaagaaccaccgagataacaagactgggaatgtttgaataattgcccagaaactaaacgcatatctgacctccaaccctgtgctcttaactactctatattactatccacagccagctcgggacaccagatctccttctaaaaaggccactttcctagtagggcactcagcgatattcaatgacactgatacaaaggccccttgtgccctaacgctgcagggttactagagttcactgggctaggaaagcaccaggacactgtctgggtgatgtctgctgtgttcctattaaaacccattcactgtctggtctcaattacttttaattacaatgagctacggcttcaattgcatacagcacagatattcttgtataattctttcctaatgatactactttaaacatagaaaaagatttggagagatgagatcagccaaggtggaaagaccatgaataaaagcataaagagatgcaactaattttctaaggagcatttccgctgacttttacaatactttaaaaacacatttttaaaatatagcaaaattctatgagatgaatctccataggcattcatttaatgcatttcttcaataaaaatatttatccagcacctataatttgccaaatagaggtgactcagatatggccactgccctcaaggattctgccctctaattgaggggattctaccatctaattgagtttaccctcaattagacttagagacatgaattcaataacaactactacatactgaatactaatgctggcagccactgttcaaaatgtctgatatgtattaaatcgctaaatgctcacaacaatctataaggcagataagtcttagtatccctattttacagataaagaaagcgaggctcagagaatttaagctattttatccaagtcatatagctagtaaatgctggaggcagaatttgattccaagtactctgacccccaatcctctgtatttacctaggccatgttgcctcccataaaaacaataaagaaatgctaaatgtcatgtggcactatggacaccagtactatatggttgggaaagcaaagaaggttactttcagaaaataacatttcacctgggcttggactttttttttttaacatagaatttattttttagagcagttttaggtggaatggaaggtacagagatttcccatatattccgtgctcccacacttttacagcttcctctattatcaatatctcacaccagaatggtacattcattacaactgatgaacccacattgacacatcgtcatcacccagagtacaaagtttacattgaggttcattctcggccttgtccattctatgcatttggacaaatttataatggcatgtatccaccattataacatacgaagtagtttcagtgctctaagaatcatctgtgctccacctattcatctcctgcactcccccaacaccgggcaaccactcatctttttactgtctccatagtttggtcttttccaggatgtcatacatatttggaatcacgcattatgcagccttttcagattggcttttttcatttagtaatatgtgtttaagtttactccatgtctcttcatgacttgatagctcatttctgattagggctgagtaatactccattttctggatggtgccacagtttctttgtccattcacctaccagaaagcatttttgttgcttctaagttttagcaattataaacaaagctgctataaacagtggtgtacaagttttcgtgtggacataagttttcaactcctgtggataaattgcaaggagtgcaattgctggatcatttggtaagagtatgattcgtttgtgagaaaccaccaaactgttttccaaagtggttgtactattttccattcctaatagcaatgaagaagagttcttgttgctccacatccttgtcaacttttggtgttttcagtgttctcaattttggccattctcatacatgtgtagtggtatcttattgttgttttaatttgcatttccctaatgaaatacgatgtgcagcattttttttcatatccttactcgtcatctgtataacttctttggtggcatatctgttaagttcttattgttgagttttaagagttctttgtaaatgttttttaaataaagtatattctctgactgttttcatcaataacagtaactcacctttattgataagtgtttattgtttgttagacagtagatattcaaggcacatctatccaaaagtgggatgatctacatctctataaatcagcctcaatgatttgacatttcaataagatacatttgcatggaaaaaaacttcaacatattctttgggagttttgtaaactgagcagtttggttttataactaattagaatatactgaatttgaattttatatgttaaaatcgagaacttgaggtaatgagagcacaagccagaaatggtggctccataattaatcccaatttaaaaagtcatttgcttattagaaaacagcatgatgcagtgaagagagtttggaattagtctggttttgctttccaacttttgtatgatgaaacggattgaaagcaaagcctaatgaaaacaaaggtcttctatgatgcagtttaagtgccttctgaatctcactttcctcttctgtgaagttgacatcaacactttcattggaataaatgttctaggcacagaagatggcagagggtatttgataaacattatcctatagaagcaggattgttgatactgttacagaaaaaatcatgaagactgtcaggaattcccaaattcacaaacacagaaatgtatctttgggctcctgaatttctccattcatatgcttctaaagttacacatttcctatgcacagattcacagagaaattgtctaaatttgtacctttcaataaatttttaaaaatatatatatgggtagcaacttttgcagtagctggggaacttactgaaacctattcttcaatcattctttcttgtttccatacaaattacatggtgggtgtgttcccatcaagaaaagctacagctgaattcaattttctgctctttaatctctctacactttccattttcaggcaacgattttcttagggagcttcacattcattttattattgtcaccagccatatcagctgactttcttctgatgtcctttttgagaaaagaaacaaaactttattatttcaaaagggtgacaccaaaaaaaaatcaagaatatagggaatagctactaattaagtgactttctgtacagtgcttgaaattcaaatactaactttgacaaaattgccaattatctcagatcatgggcttctgagagccagctgcccacaggttagtgatactgtgaatactaaagtctgttgctaggttttcggcaccgtatttgctagaacattagtactatgagactgtatctaaatacttatgctatagtgaaataaacttagtactatagccttcttggtgattcatagagcatattagcatgttaaagtctccaaagtcctacactcaaggaatctacttaatattgcataagccagcatagcccaaacatgtttgactttggaagcttttttaatattttggttaacacctattaatattttacagcactggtatttctcatagtaatctcttctaaactgtatgcacaatacaccagcgagcacaaaacagtaacacacaatatttgaacaaactacaacacacaatgtttaaacaaattttaattaattcatccaacaaacatttcctagtaattactcatatatgaaagcaagttgtttattcacatggttcattagcataattcactatcctgttgtgagtcaacatttaatgagcccagggatgggcttttgggagaacaacatgtagctctttgtgggtaaattaaggtacatattttattttagctcccattgaggtgaacatcatggtgaagtggacgctcctaggtgttccctggagtttacttttctgaggttctgatggtggctgttattctactatatccccgaagccacattttacaatgttgtaggaggagtctgggacattggaatgactaaaacattttcatcatgagaatagttagtgtgttgattcaatatatttaactcctttgcgaaaaatcttatattgcagtgctcacatctgatatgcacactttacctgttatgctatttcaagatgaaagcagcttgattatttgcatgtgttacttctaatgactctacctcggagggatctgctctattttttcacaaccaatcacttttatcttccttcatactttcagactgtttctattgacctaaagtttcacatgtttctgttttatttttcccctctaatgtgttactagcttttctcctgtggtgtctctgaggtccagtatatggtttagccatttttctagttttgaaaataattatttaagtaatcaaatcctcaacattgaataccatttaataactattttcggtccaattagatgacatatttaaggttacctgttgtatacattctaaactcagtcttaaaaatgcttaagaaatacatactataaactcttgctattcttataaaactgctactacttacctatcaccagttattttcaaattcataaatgtaaaggcataatttttctgtgttttttttttagatgtttacatagaacaagtgcaggatgaaacttaggaaaacgtacatattttataaagacagttaataattggtgatgtttatttaagatttgttatatagcaagcactgtattaagcatttcacatactagatctcatttaaccctcataagaatctcttacatccgtttcacagttaagagaactgaaatgcagaggtgagtccctggatcaaggccattactctatgaaacacagaagcagttctcaacactggatctctctgactccagagttttccctattaaccactatgctttgctgcctccagaaaatctactctaaatatactacatatggcaatggaaaagaagagatttagataagcatatggtaattagaaaagaagggggcatttaggaagaaagttaggcaaatgcttagaaagagaattagggtgagaatttaaaaaatcaggaaaatctttttcactgattttgcaattccaaaccatcatttaatgtctgggaaattcatggtcctcatctgttaagtggaattgttgtttcctaatcacttatgatgaatataaagtgttaggtgagtaaagagaaattagaaaattttaaggaacactaaatattagtttcaaagtgtccttccaatgtgatgtacaacattaaatactgtgtaaaatactttgggacagtgggtctattttcagtaattcaccaataaaaatattttactatagtaattttaaatgttctaagaccacggtgttaaataacttatactcagtaaaaggaggttccatgctggagtagtagaagtgtttgggacaaaaatataaaataaaataaaaaagattactcattcaatttagcctagttctagctcagatttcagacaattcaaaataagattagaaatgagaagctaatttatcactcaagggacagaagcctgtttgtggacactcaattataggatcgggactttgcatgtgaacgccttctacatagcttcttgcccagatctcaggctgaagtattctctggtgatgaaaacaattccaaaaacaatgaatgcctttgttctggacacacctcttccattcagttgtgttctctatcactccctcagtatcagatcttcttttcatttttctcccatctatgcccagggactcttcatattttgaactacctaaagctttgtacttgatcatttttcaggaccatcagtgaacttgacttaccaacacccctctcctcttccaagaaaactacaacccatatttcctaatttagcacttaacaatattaaggccacttactgtttcactgtggttgtatttgtgtaaagtactctctgcaactagcttgagatcctctgaggtcagctgtcacattttatcttactgtatttttcacaaattacacaaaaggtactcaaggagttaactgcttaaaaatggtgttgagatcggctgggcacggtggctcaggcctgtaatcccagcactttgggaggccaatgcaggtagatcacgaggtcaggagatcgagaccatcctggctaacgtggtgaaaccacgtctctactaaaaatacaaaaaaattagccgggcacagtggtgggtgcctgtagtcccagctacttgggaggctgagtcaggaaaatgacatgaacccgggaggtggagcttgcagtgagctgagattgcgccactgcactccagcctgggcaacagagcaagactctgtctcaaaaaaaaaaaaaaactggtgttgagatcataaagaaagactctgaaagacatggtacctttcactaaatataggatttttaccattctttggaagagttccatggatgtgccaatacagaccctttctggaattaggccattattgttaagtgactacaaactacacatatttaaaatggccacattctacattgtttgtcataatggagggttggtattagtgcttcccctgatctcagtactgattcctgaagaagacaggaaagaagtgaacagtcaccacttgctctaggaaccatcactgctaacaattttttgctacatcttgccagtgtaaggcaaagagccagaacacagaaaggctgctagaggctgggatgtcagctaattaaccctcagaagaaatttgtgccccaattccgaaaaatgggtgataaaaatttgaggccacagatacttcagaagcaaaccaggaaggcccagagtgagtcaatcaatctgactagaaccctagaaaattgacagctctgtggaagtcagtacacacgccacagaaacatcaccaaaaggagaactccaagctaacacagaagccaggatttactggccaataattaaggtatcttggatggaccccagctcttgcctttggctagcttacaaccttcctcatgagcagctcccacctaaaagattaacaaaataaaatgtatgataaaaaacaagagagatttagctttcaaattgtaacataattatgctcatgcaatccaaataattctcagcagtctgaaattcctcagagacacaaatgaatatattacaaacactctggtcataaagcccatgtttcccagcaataaaattgctgcaataaacatttgggttcttttccatttttaggaccattttgaacaacctgcttctaatgtatttcattagcttcctcaaagtcttccaatgaatgacaaaacctccagtgctttgagtggctgacattaagccataatgttgttttgcagtgtgtagtcttctcactgccaagcaagcgttttctgttatgttcccctgcattaaatctctcccagaaatactgtctgcaacctataggcaactagtaaaatgagattatctcccttgaccccaagtcactccagcattagccagaagggactgtgaacactaacaatactttgaatttaaagacaatttttgtcctcaggttaaaaaaatcttgtactttactctttgaacaaccactcacaaactcttccctgagtcgcgtgtggtctggtaacaacatatttattgataagcttttccactgagtaatcagacagtgcattattttataaagagcttggtatgtgaaaggccttcagcagttctgtaaccgacacaataagaaagtattgcacttccatcagagacattttacatacaagagctgaaagttgttccactgctatgatatttcaaaaagcaatttttaacaagttctgctctttttcatccttaaaacccagttattaaaacaataataacacacaatctcttaaatgaattttaacctcatgttgtcaactgatctcaataaaatcttataggaaactcaaaaggcaccttttgttaccagagtgtcagtcctcaccaggacccttctttctattctgcattttctgtctttcatgattatagctaatatatttcttaagagttactgtgttaagtatattacatttatcataacatttagtcacacaaccataaaaaaaagatatcattgctattcccattttatacatgaatcaacagaagttcagagaagtcaaccaacttggtcataagctagtcagtaccataactgcagttcagtttcagatctaatccaaaaagctgtatctctaaacactctgctgaactatctctttaatctttccctacctatactagaagaatccaatctcatcaaactttacaactcaatggataatggtaaagtaagaagacatctgaaaatttttcctgaaatacgtctcaggttaccacgtcacaggctaaccccaaataaaattatctaataggaatctgccatgaatttcttcacagggaattttctataattcattcaaatagaggaaagttgacttgattgctttttatatatgatgtgaacatgtctatcactatactaaaccattgttgcatagacccacaagactttccatttagagaactgttctcaactactcctcaaatctgcctcctgtgggtgagagacttgagaacttagacccttgaatgctgctttctttctttgcattctgtagcaattaattctctccttattcagaaaaagctactaatagttcatgtattgttgcttatggctatcacttagtctatttataaatgcagcagatttttgagacagtaaatatacaaagacacaaagaaaaagagtgaaaaaaagcatgatcagaagaaaaaagaataaggaagtaactgcatgaatagcatcaactgaaaatacaagaacaactcaaagataattggcccttcctctggctatctcagtcatgaggtattagcatgaaccagaaaaccacagagaagaattcacaaaggaaaccattgctgtgagctacatgaactagcgggaaagtgctagaaaaattctctctttgtctttggactcacagcaaagataacatgcagaatattgtgtttgtatgtttgggaagaaagaaaatcactataaaactgataagagacttcctccaaagagacagtggcagtttcccatttggcatgtttgaagcaatagcaccatttcttaattgtccaatttgttgtgaatagcctagttttccttcaatttaatttcaggatttgtttgatttttaatcacacctgcactttcggaaactctcagagcaaagatttttctgtcctcaaggcatggtttcccacctgtcagaacagggccttgactgccctcagaggctctgaggtgaaaatgaaatggcctcgaatgtttggaactttacttttcctactctttaagaggagatttttgtttggttgggttttgttttgttttgctttgcttttaaagttttttgttattggtgtttatactacttaattatcattttaattcacacagtgctgttcaaaggtgaagacttttgttttattttgtttactactccgaagaagtggtgcttctcctttctttttttttcttttcttttttgtttttttagagacagagtcacgctctgtcgcacaaactggagtgcagtggtgtgatctcagctcactgtaacctccacctcctgggttcaagcaattatcctgcctcactcagcctccaaagtagctgggattacaggtttgtgccactacagctggctaatttttgtatttttggtagataccgggtttcaccatgttggccagtctcgaactcctgagctcaggtgatttgctcaccttggcctcccaaagtgctgggattacaggtgtaagccactgtacctggcctggtgtttcattttgttttgtttttacaaatgtcctttaagtccaaagtccaagagctggatttcttgatgtgagaagaaatctgtgaaagtcagctgcttggcagatcacaaggtcaggagatcccagaccaccctgcctaacatggtgaaaccccgtctctagaaaaaatacaaaaaaaaattagccaggcgtggtggcgggcacctgtagtcccagctactggggaggctgaggcaggagaatggtgtgaacctgggaggcagagcttgcagtgagccatgatcgcaccactgcactccagcctgggtgacagagtaagactccaactcacaaaaaaaaaaaaaaaaaaaaagaaagtcaactgcttgaatacagtatttgaaagggtttattattattatcaaaggaaaggtaacaaaatgaagatggaggttttctcttctggctcattgcctctgtctctgaggagaactaggaactgtggtaagcagatttgaaaggaagaataaaatctaaagcaacatcctatgaggtaaaatcattgtggactgtcaatcttatagctcatatatttcaaattagacttctggttgtgttttatttcaattttttccattcgattttcaaatgatttttattgtctgtttgtattgtttctcatattattattccaatcccattttactaaacatgtttttaagttaaaacccttgatgactaagacacaaccacttagaagataagactgtcatgggtcatactttttttcttatctttacaaggctaaaatgtggccattagtagtttgtgaacccaaggaattcttcagaccaattacttccacaattctaagaaatggggcacattttcagaagattcttaacctactcctagccttacaggtgagcagttattctaagtgaaagcttttcttcttcacaaggaactcacagctttaaaggaaagagggcaggaggatgagggctgcatatgagcactgtaaaaggaggccctagaggggagtgggatgactcacgctaatctactatgattctgactggaatggggttatacgaagggtttgaacatgacaccaaggctttagcatggccctctcaacctgctgttaaggtgaaatgtatggaatgctgttggatattcactcaggtttggattactctgacatatccttccatttcctacctaacacaactttctcaactgtattcacctaaaactatacagaatattaactagagctgatgtgaatgtccacagtaggggaaaaggtgggttatttttgttgttttttgtttttttttttttttttttttgagaccgagtcttgctctgttgcccaggctggagtgcagtggtgagatctcggctcactgcaagctctgcctcctgggttcacgccactctcctgcctcagcctcccaagtatctgggactataggtgcccaccaccatacccggctaatttttttttttttttttgtatttttagtagagatgtggtttcaccgtagccaggatggtctccatctgctgacctcgtgatccgcccgcctcagcctcccaaagtgctgggattaccggcatgagccgccacacctggccaggaaaaggttttaaatggacaagaactatactatttctcagtctcagaagacaaatctctgtttaagccacggtatgtataaagactgcagatgtgtttgtgtatgtatatgtatgggaagagaaaagaggggagagagaagagagattactgaattttctggcgtaaaaaaaatagaacatgaaaaaataaaatgtaattttatttttatttatttatgaatggttaataatagtctacaatagttacaaatgcaagctaatcaaatccacactttgacttctccatctgaaaggtagaggtacagtaatgcattccttgatgtatttcttaactaacttcctgacccataatgagactaagtaaattctacaaaaccacaaatactaagtattcaaaagttactgtgagtttatttttataaactacagcttccaaaattatttgaggctctaatctatcccatttcctggaaaacactagaatcaatcgttcatgagactctgattacaagcttattaaaacattgatgatctaccagatataaactctagggcatgcaaaatttcagaagcacagcttctgaaaccagtgtctggtcttgatgagcgttcagagcagtgtgaagccctcaaagcttttgttttattgaagagatcctgggttccagattcataaaatcttagaagcacaagtaccttagcctattcacaattgaagagaaagagacagagagacacagaaagacagagatagacacagatagacagagatgtcactaaatatttcttctgtctctaggtttccctaaatcactctatctcgaggaccctgaaaactacattgcctttttacaaaagcctgattcgtcctccggtaataccatttaaacacaacaaataaaaattggccagagtatcaacatacaatatctctactgacttaacatggctctcctcaaattggggtgactcatcattaagactgaaaatggttagttttatgcaaatacttgtgaaatttacttccaaaacagaagaacatgattagagctcattttgcagcttgccttttatggacaatcatactgtgctttattttattaaacacttaaataatttatttaccatcaaataacatcctcattaaaggctacaataagggagatagatgtcactctgaagacatatgggataaaaaaatgccaagggcagttttgaagagaattggataagtgaaacaagttcctgagagcatttactccagctcagaaaatacagaagtttgttgacacccaaacatatgtgacacattgaagatggatctttaaagatcctacttggctgaacactgtagaattatatgaagaatccttttcaacaaccatacaatgattttctcaagaagagtagacaatgagcattttgtattacgccgaggcaactgcattgaagacactagctctacattgtacaatcactcacaaagcaattggaatttgacaataaaacaaaccaaggccttttccccactaccaaacaaatttccaagccgtattgttgaaaagaatgcagttggataaagaagtccaaagcctagaagtgacttgaggtttaaagcacttcacagatgctgtcaaaataaggattttcaaagcttgttttcacagtggagagaattcgggcactggagaagcatctgtgtaatctcgtctaagcacaatacctacagggctcattgctttccagagacatggaatcatttaatagtttcacaattcaaacagaagtcctaatccattgtatattatagtaaaacccagccaagactacaaaaaatgtgaatatacagatgcaaaattaatccacttctcaaagcttggaagtgagcagatgatgcattttatgacacaggtggattattttgggaggttgggggcggatacctaacctcatttaaagacaagtttttaataactaagagaagttactacataacagcttaaaatattgagatatcctaaaattatcctatattgcttatatttcaaataataaatttatcaaactataaataatatggcatgttggaaagaccattaattaggaatcaagtaggtctagattcaacattttcaatattttgacttcgccatttatagctgtggactttaggcacatctgaattatctcttgggttatatggttctctttttttaaagcaattggaagaacacatacatcatatagccattagttgtattaagtgacctaccagcatggtttgggaatacagcactctgttagtcacattatttaactccacctagaaaatattaccagacacatgggttcagtggctcacgcctgtaatcccagcactttgggaggccaaggcaggtggatcaccaggtcaggagatcgagaccatcctggctaacacggtgaaacctcgtctctagtaaaaatacaaacaattagccgggaatggtggtgggcacctgtagtcccagctactcgggaggctgaggcaggagaatggtgtgaacctgggaggcggagcttgcagtgagctgagatcacggcactgcactcagcctgggcaacagagcgtgacttcgtctcaaaacaaacaaacaaacaaaaacaaaatactaccagacatggaaagaacactagactgagggtttcaattttagattttatttttattcttttgtggcttcatctcttttactttaagtccgtcttggggttgtctttggtgagacaaaataattgtcccctataaaacagaaggaactcactacatttcacctgccaccatttggcttgtcccctcaaacatggagccttatcagaggggtcaaacaatccttcttttttttttcctggaaaacatggtattgcacagtggctctggccagtccagtcttattaagtagctttatccttgatccatatgtctagtgttcctggagaaacatgttttcatttaataaataaaagacaatgtaatataatggaaagttcctgatacatctacgttgattggttctattacttcccagcagtaatattagacagttttaacctaacggaatagtcactaacttctctctaaataataccatatcttgagtcattgtaaagactgaataagaatgtatgtaatataccaagtcaatttcctaccacctggtcaatgctcaatatacagcaatagtgaagataaagaaggtgacaagtagcacaagattaactggaaagtttctagaaccttatatagggaaggtcatgagaagtcaagcgtttgaagaacaaaggtaacatttaccatgaagatgtggcaaagatggaattaatagccgaggagggaaaataaatatcggcttaggcctcctaactgtctgcagaaatcttcccatagctcctgcctgtttcccttttggttgctagagtttcccaattgctgtgggttgggtaatttgcctaaccagctgaatttattttatttatttatttatttattttgagacggagtctcgctctgtcacccaggctgcagcacagtggcgtgatctcggctcacggcaagctccgcctcccgggttcacgccattctcctgcctcagcctcccgagtagctgggactacaggcacccaccaccacgcctggctagttttttgtatttttactagagacggggtttcaccgtgttagccaggatggtctcggcctcccaaagtgctgggattacaggggtgagccaccgtgcccggcctgaatttattttttttaaaggcttgattttgttgttgttgttcccaccctttcccctgaatactctgcacagttacactggaagtagttaaattcaccattttatccatagatctcagaattgtgagacaaaattaagataaacattagggaggcaagcacctcccctaggaaacgcaatgaccacaggcagcttttactcaatgcactgcatctgaaggcaggccctgggggggacggtgggatttccctgattgggtggggcatggcaggcactctctgtctgatgtctgtgactggttttcctattctagagtatttccagttcacaggggaaataacgcaaatggatacggcaggccaacgatgtaacaaagtaggcatattgttcagttgtttcacccaccttttctcagagccagctctgatcgctactgctggatgatcagtggctttttgtctttaatctctgggcacagatcactggaagagatatggacaattgaaccaaagtgggacagttagcatgtgtctcctactcatctgtaatttagatgcagagtttgagttacataaatggtagggccttagaataaaatttcatgaacaacttctattgtagcccctgaatttgtcatggttcctccatttcccagaaacttcctgttcagcttttcctagaattttaaggatctgtgtaatttccaatcagtgcctcctctacttaagctaatatgagcaagttattatttgttattaagattatttgtttctattattaattctattactaatattaatagatacattaatctaattcaaattaccattaccatctgacttagaatcttgtgatatacaaaagacattcatggaaaataggctggatcgatcaactgctaacctctaaaacatcaatagtcataatcacccaaagccaaattcctttatttttcatttaagtatatgacaaaccttttattttttttagaattttactttttaattttgttttgctggcgtctttgttaaggcaaactaaaagttaaatccaatgttttcataaaattaacaaatattaatagtaaagctcatattacttgacatgaactaaaaactgtttatggggtaaacaaaaagtggcatagatattctagttattatgtgattcccatccaacacatatgagtagtgtacatagcctatctttctgaccttcagaaaagactagtttaagttatcctagacacatgaaaatctatcttgtctttaaaaatctgcagaaattaaaacatattttccatgtgctttaatatcatctaatagatactatttctggcgagtcagaaaatatctttccttctcactgctgtatcctcatcacttagcacagagccaaaccttgaacaggggactcaaactagttcttatataaataaattaaggaaggaataaacaaatgaaaaaaaggtaaaataacctaacaaaaagacaaaaggatttaagtctgatgctgtcaggcaaaggcaaacaggttattccaggtgtaaaatgaatacaatgatatttgtcacatctatattttcccaaaccccatctttaaccacataaagcactgaacacaagaaaaatggcacaaaactagattcaagttactgtaagttcttacagtctcaaaatgaacccacccatgtctaacaatacttattccatccagcattacaatttttaaaagggctctcagatggctgcggctcttttcagacttaattgtgaagagggcactaggaagaatgatccatcgacccaccaaatcccttaagcctgtgtttatttcactttgcaactcacccaacaatgacatagaggcattatagaatgaaagaaggtggagagcctgatggcttccacgcagaggggttcaggtctctctctgggatgaaccagccttcttaatctcttcccactcattcacgattccttgtacagggggcaggaacactgcgagcactttccccagcagtggcctgtcctagtttatgcatccctaaagagaaccctggagaagcataggactcattggacaccacaagagaggaagtaaaggagaaaggaaaatggaatgggacatggcagcctccagttaccatgtaagttgtggagaaatcaaatgtttcccttatgtgactaatcattttgagcattgtccctgtagaaagagagcacagaggagtttggacttgtaattcaggttgggtcacggcttcacgaacattaccttcctcatgagtaaaataatgatagtactaatgatgacaattatgactgataacaataaaaaccatttctatcttccaatatttttggagatattaaatgacagaaggtaattactatgtaaaatttaaagctacagatagatgtcccctattatttttcaactgtgcagaaccttccaacactaagcctagatgcttagctggggttgggagattctgggcatgatagagatggtaaaattagaaacaacagcctcattgactatacgcataatttgaaccaaagcccttattttgataagcagatttctgaaagggttagccagtaagattctgagctgggatgtagaacccaagttattcccagtggaagtgatatagaaagagacgctgtcagaagcaacactggatctagaattgattgtccaatacagccaggtatctattctaaagtacacacacacacacacacacacacgtacacacacaattggtgagtgaaatgaaagaaaagatagccagtgacctagaagagagtaaacacatgggaaagaaaagctctatctccatgaggtgtctagaggaaaaagtaaaagcgagggagacccaagccctctgttatggttcatcatgggaaaataccaacaaaagtagttcatgcagcatcctttaccacattttgtcacaaatctcatcacgcagctgctgctgacatgactcttctactaatcccttcctgcctatgcaacagagctggtgagtagccccatttgagccttccctgataaatcccataatcctcaccacctgcttatgggttccccagcatcggtgatgactgactccttaggattcaaagcaaatgctgctgtcctctctcccttttctatgagtcagccttctgatgataacaatccattgtttcatcatttaatgtggtcatataaacaggaggaggatggctgagattaagatgggacattaatttccatttcctggaggataaatcttctgatgtttccaaacttgtgcctctggcctcctgacagtcccataaacttgggaagatgaatggagtgtctgttttaaagtcatctttaacattttatgcatgggcatgaacttcaaattccagagaccgagttcatttgctgctacattaaggatccaggtggaggagaataagtcaccgagattcaatcatcttctgaaatattgcttacctgagagtcccttcaagatagagtaactgctggagacccccatgtgcctctaacagctggactttggtccttcaaagcctaaatgatccatttggctacattttattttcttcaactcttttcactcttccagatggtaaaatgcaaaaatcttaatattctgcaatggccaagtagctgccacacagtttcatgacccatcactcactctctgattatcctgtctttatgtatgaatgagctcctacataatgccatcagagtacacgacactgcacatcagtatctagcagagtacctacaggaccaaaacaggccagtaaatctaagagatttccgagaagagctgcaaaggtgatttaagaatattgaaagttgatttaggaaggaagataaaaagatctcttgcttaagccaactatgaaaatgtggtaaagcaggtacatccatacatctgaagttcagaaatgcttctaagcagaaggattggaagccatactaaaggcaactgcaaaattggagcttaggaaagagagagactctcaaactgcatgatacatcctctgtgtgattctaagatgccaagaacgcttcaggagctgatgttgcccaagactgacacgagctctttctgcagtgaaaaccaggatgagagacaagaattcttcaggagatcattgtttatggttgtggaagctgagtagtattgagggataatatcatccatattgcatggtgagaggcaatgcaagcatagggcttggcacacacttaagtgctgaatgcatgacagctagtgctgctctactctcaatggtatcgttctccctgccttgcacatgacaaggctgcagtccaatatgcctgccagtcagatgctgggctccttcattcttcttactgagctcccattcaggaatcaaacacatactacagattagcaaagaacaggcttaagaactaagcaacctgctgtgagagagctatcacaactttatttttacacccttttctcaataaccataagatgccaagtatatctttttgtggcttttcactggaaaaccaagtgcaggacttgagaaacagaaggctttatattttacttctaagtacctatgccagacaaatcctgaaaagcactttcagctttttggaaaatattcccaggttcacgggctaaaagaagaccatgaaaaaaaaaaaaaaaaaaaaaaaccttactgcttcatgattccaacttttctcaagttcaataaggaaagaaaccatagcaataataatgccaggtaatgatttaagttttatgagctagggagctttctttggtacttttcagtcatttctcatttaatccttacaaaagcctcatgcagcttatgctttagtggaattcttcaagattccattgctagtaagcactcaaactacaatttgaactcaagccgcctgactgcagagccatgattttttttaaccaagatgcagtactggttcccaaaatgtatgactgatttccacatatatgcccagcacatacacacttcgattgaccgacagtgctgcatccctggtctgaaacatctccggtctgaaacatgcttcaatgtctgaaatagcatcctgaatgacatctcttcattataccctctccccttcactctattctcaactagagcaattcacttacaaagcgagtctttcggccaggcgtggtggctcacgcctgtaatcccaacactttgggaggccgaggagggcagatcacaaggtcaagagatagaaaccatcctggccaacacagtgaaaccctgtctctactaaaaatacaaaaattagttgggtatggtggtgtgtgcccgtagtcccagctacttgggaggctgagacaggagaatcgcttgaacccgggacaaggaggttgcagggggctgagatcacatcactgcagcctggcatccagcctggcgacagagtgagactcagtctcaaaaaaaaaaaaaaactgagtctttcatgtcactccctgtttgaaatctccctcagaataaaagccacattccctatggtggatggagaagccttacacaatctgcctatcactacctcttccaccatgatctctctggcctcatccctttctgttctctacctccttcactctgctccagctcttgtaactttatcttcttgctctttcttgaacacagtggggtcattccagcctcaggaactttttactcaccattcctatgcctggaccgctatcccccagaagcacacatagctcactcccatgccacctcgagattttcgaattcttatcactctatttaaaacttcgaaaaccccacttctcccagactttctaacattctcccttactttattttctccataacagtgatgatcatataatgccctttatatatttcactaatgtatatattttctcttttttaatcaagaatataagatctatgaaggcaaacatttttttttaattccctcctacacccccagcactcaaacagtgtcatatggtaattgtttattatatgaatgtataatatatcatctttaatattctaagaaacatccttcaatcaaatagagaatcttaaatcactgggaaatcctttctgttaagtattcttccaaactgacattaagaaactccaatttattattgcagttggaaaacatttctaaatattactgaaatcatatttctgtttcacaatatttttccttaagcactttgttctcactacaaataggctatgaaggtgaggtatataattgcaaaaaagggggaatgacagatataaactatagaataaaaattattcacctatgactttcaaaaaatggtttttaatcaaggctacagatcatacaacagatttagagcccaagacattttgattggcaataattaggtacaagaaatagaagtggcttttgtttagaatttttttaaaaaaggctccatatatcagtagttggtaatatcagagaggacactatgcattgagtagggaatgataaagatatagtttgccagaccaaaagcaaaagtagcatttgacttggtgggaggacccctaagaacgggagaagcaacatggttagatgttaagtatggtccctgacacagccagccccttcactctttgcagtgaaaaccttcatttgggaaagtaatagaagcgtcatagacaggtttgatgatctgtcggcaagagaaactcattgcctgatcttctggaacatgggagaaggcagtctttcagagtgtctctcaccaacgcgggacagctctatgctgctaacaagatgtaaaaatcccccctggcctagtgtaggacacagatgttacctaagagcactggctggtcattaagtcaagaggtgaagtgactgtggaggagaaagagttagagtaaatggcccaagctaggaattaagtggcagtcacagccagtcttgggaaaaaatatagcacccacaagcattaggatggggacttagtctatcagagggctgatgccaatgcataacacagacaaggaaacagaaggcaatctgtctcatctacagttgcatcagacacagagtcaatatgaaaggccaagggacaacattctttagtgggagcctgcaaacaaccgaagggtacacattgacctgacgccacttccccacctcatcatgctgcatgtagccatgaaactcatagtctccctgaacccaagcaaagaagaaagagcagaggaaaaaagccactgaaagtttaagtgtctgttctaaagagttggatttatccagaaagcaatgaattttaactggaagtcagtaagatacattcaagtggcatataagtattccttccttaagcagaaatgggtgctggcgagcaagcagtattcagttatgcagaaataaagttatatttctacccacctcagtcacagtgtacaaattttaaatccactctatatgtaagggccagtgatttatcagtgctgaattttacagtaaaataaaaatttaaaaagttaccaatggctaagtatagggcagaaatcatgaggaatattaaaaaaaaggttacctcccatccaaggagaaacacggtaaaaggtgattcagctaaaatattataaagccaaatatgaaaaatatatgccctgcttacaataaacctataatatagccccaacatagttatttccaattggtaagtggaattcaatttgcattaaaaaaaaacaagaataaagatacactttacaacttatccaggatttttcctcttgtatatatgaaaccctcactgtttattccccatttccatccagctggaaacaaccatatccattataagattacacagcactaagtgggcacggttactcatgatttgctaatggatgaattgcattttatccagtgtttgcagtcaccttaaatgcagataatatatggcaagttattgttgcaagaggcaagaaacagtcacagttatgtttcactggcatttaacaaatgaggaataagacgttgaagcctttgtgctttgctttaacaagttttaaaaggtaaaagggactggctatgaggtagacagatcactaggtttgaaatcatgttttaccacatactattgatatgactttcaacttctttcaccttgaaaaggttaagtagttacctatagggaacacagagatcatgtacatgaagacttagctttagcaaaacaacttactatatcatatgcccttagtaaagctttgctacacctatcaatatttttattatttatttatttattttgagacggagtctccttctgtcgccaggctggagtgcagtgatgcaatcttggctcactgcaagctccacctcctgggttcaagcgattctcctgcctcagcctcctgagtagctgggaccatagacacccgccaccatgcctggctaatttttgtagttttagtagagacagggtttcaccattttggccaggctggtctcgaactcctgacctcaggtgatcggcccacctcggcctcccaaaatgctgggattacaggtgtgagccaccgcacccggccctatcaatattcttaaaggccaaattcctaacaaaacggatcatcaactcactcttaacccaagattctctccataagctccttttttctagttttcatgtagattgcccatctcatttcccccattcacttctccatgctatcccaacactagttttctccaatcttcaatcttcaattgttttgaacaacaattaatgtgctttaaggagaataacctctctcaatattgagatcttttcgcaaagtcacagaaacacacgcattcacttttaccatgtccaattgtgatgaatgcaaggttctgggaaatgactggccagtgttaggacatagttttcaataaaggaactgaataaaaacctctgtgctcagggaatgaaatccaggagcacagcccaatttgtgatttatttttaacaagtgaatgagaaatggagaaattaaaaaacacatttttggaatcagaaatctttcatctgatttctttgttgcatgcttttaagcaaattatttatttattctgggactcaatttccctacttgtaaaataaaggcaacaaaactggctggatcatttccatttctttccaggttctttcctactttccatgtccacactgtgtgtcataggatggcagttttggtgctataacaactgggcctgcaaggtgcctgtttgagttcataggagcaactggctagggttccaaagctggaatgagagaaagaccaaagtctttatactctatcccaccatcccactccacccctagccccagcctctctgccaggccacacattagcagaggccatattcttcttacctgtgcctgcagctctcctcatctgtgccctccctgctattatggctccctctcgattctggtcaccaaactctcagcctctttaggaccagaggtgatagctgcacatcagctagtgcctgggtgctttcttattgcttataggtttcctttagttctgacttttaaatagtcccttcattaagttatctttaatttctaatttccatttgagtgtgccatctcttttctgccagaatcctgactcactcaaaaatctacatccttgagctattataaaaacatgagacaatgtaatacaggaaaaaaatgcccattttatgtctgttacacagtagggtgatcgatgaatatctggtaaatcttacttataaaacagttattttttgcaaagcactattgtgataagcattctccttgtgcaggtcatgtcttagtcacatgtagacaatcattaggtaagctgcaaagtggccaatttttgtaatatctagtttttgttgttgttgtctatgtcaggcataatatccaggttgccaaatattagtaggttattatgatgtttctcagtatgtctttctttaccaacttatcgatattgaactcttttatctttcctcccaagtgaatccaacttagctcctgagtctcacacctgtttcccaaacatctagcacatcacttagtagacaataagaggtccagaaacaactattgtttctgggagctgcttgccatactgaagaagtagtcagttgtcctgatgcagactggtgagctgtctctattgcctaaatcaataattgtatgttttgttttgttttggttttttccaccattcagcatttaggctatctccataaaagatctggtgagtgcatatgtatcacgtgtcaggaatgcatatcaaattgagaatttactgttttctgtctgggctcagccaacacctcgttgttaaagatgacactattttataagggaagaggaaatttaattaatgcctttgtggcataacttctaacaattttggaatgacttctttctggaattgaaattagttccttgaagatattgctctaaagctccatattgacaataattagatttatttttggtaatctttacacatgcatgacttctcccatgtggctctcatgtattactctgggaaaacacatattaatattcccattttaagaataagaaaaccataacttagaggtgttaaattccaggcacaaggtcactaagtaaatggcagacataggaccagaactcagatctttggaccccaaatttcatttttcactcaataactcttcatgaacaaccaacaatgcgtacagtactgaattagtcccagcacaagcttctgcactattatggtgtccattaattaaggaagtttcagttgctctgtaaacaatctatagtgaagacatatatagtgttaaaggtattgacaaaattctacagcgctccagaggatgtaaagaaggaaaaattctgagagtagtaaagttgggttcagtcttgattggcagataaaagtttttcagggcagcttgatacaggatattttctttctctattaactacatagtatatgatatatctctctttatgttaactcaaatttaattctcagggactcttgattgagaagatttttgagtgtgagaccactagaaaatacaagaagtccacatgtccatctcttaatatgtgaccctttccatgagcatttccaaatactgacctaatcaacagttaaacaagattccctaaaggagtggtctatgtgctatgcatagacctttagcctttagccacatgtaactatgtaaatttaaattaagtcaaattaaaattaaattaaatttaaaattcagattctcagtcacactaatcacacttaatagtctattaatagtctcatgtggctagtggctacaatattgaacaaagcaggtattccatcactgaagaaatgtatattaaacaatgctggtatgcatttgaaatttgtttccttaaaactactgaaccaaggaaccataggttaaactaatacaaccataaagaatacaataaaatattataactaaaagtgatctagattcattctttcatttgttttgtatggtttagtgcatacgtattaagtgcctactatgtgccaggcattgtacttgaagtaagagattaattagcaaaatatacatgatttctgacctcactgatcttaaaacctggagggaatacagataatataacatgcagtttcaacagaatgtgattatttgctattacctctaattttgtcggaatcacagtaaatggaaactctcttgcatttgcacatgcagaaaggggcagacatgtctgttcctgagaagctgcaatctttctgggtcacataaaccatcatgctaactacaggaaagtttccttccagaaatttccataggtttttaagatgtgaatttagcagccagcatttaaatgtttttacctcacatatattcaaatatgagtttttcaaacatgagagcacattttgtaaatcgtaataagaaataagtaaataggccgggtgcggtggctcacgcctgtaatcccagcactttgggaggtcgaggtgggtggatcacgaggtcaggagatccagaccatcctggctaacacagtgaaaccccgtctctactaaaaatacaaaaaacttagctgggcgtggtggcgggcgcctgtagtcccagctacttggaaggctgaggcaggagaatggtgtgaacccgggaggcagagcttgcagtgagccaagatctcaccactgcactccagcctgggcaacagagcaagactccgcctcaaaaaaaaaaaaagtaagtaaatagtctcttaggcagactttatgatacagtcaaagctatcttgtatctagggacatcagagaaaagagcaggtattgaaaatctcaaagaaagagcttgaaaattgagctgaacaattctcagatgaggcagcaccagttctaagcaaggactttggtggttagtgggctggatcttgattactctctcctgacattattttaagatctaactcctacagacagttcaggagaaagaacaagggaatacccacataaaagcaaaagtttatctgtcaagattcttaatgttactttacacttctccctctttgagaaaataataattctttctgatgagaaataatggaaatgtatttttaaaaatatttttctagagacagggtcttgctctgcaatgcaggctgcagagcagtgatgcaatcttatagctcactataacttggaactcctggactcaagagatcctccctcctcagcctcctgagtagctaggagtataggcatgcaccaccacacttagctattttttttcttttttggagaccaagtttcactctcattgcccaggctggagtgcaatggcgcgatctcggctcactgcaacctccatctctcgggctcaagcaattctctgcctcagcctcccaagtagcctgccaccacacctggctaatagtttatatttttattagagacggggtttcaccatgttgaccaggctgctcttgaactcctgaccttcaggtgatccacccgccttggcctcccaaagtggtgggattacaggcgtgagccaccgtgcccggtctattttttcatgttttgtagaaacatggtctcactatgtgacaatcaatgaaccaacactgacatgtctgtatcaaccaaagttcacagtttacattaaggttcactgtgtttaaactctatgggttttgacaaatgtatgatgtcatgtaactaccattataggctcatacagaatattttccctaaagtaaaattcccctgtgcttcacctagacagccctccctcctggtctcaaactcctgtcctcaagtgatcctgccatctcggtcactcaaactgctgggattataggactgaaccaatgcaccggggttgaatatgcttgaataaaaaatagtaacctgaaatttaagtatgtcaagcataacatttccagaaacaaatcttccatgggctaattatgtgtgtgtgtgtgtgtgtgtgtgtgtgtgtttctgtttggggagagttgactcaatagtctttataataaaaataactgaaatgtctttaagtatgacattttccagtcagctataagttctatcatgctttatcaactctcagttggcccagtttgtatatacatgtaacctacatggcccatttagtctttcagtttgcaatctctgatctataatgactttgcctattacctttgtttatttctatagaacatttagtgtgtgttttcagtatggcctggatcaaacataagggagctttctggaccttatgaaacgatttctatcttggtcatcattttcccctaatgactagcataatgcaacacatgatatgtatttgttacatcaataagtgaagaatgaacaaatgcatgtttaataatagtcattgcattttaaggacttgtcattatcgagccttcattatttaatcttattattgatttagacactgtggagctggttctgatatgagaggatttaatgtatgggaaggaaaacgtatggcccttctcatgcaagccaagctgcatggctcactgtcctgaagctggatttgagacgacctctggatatagggaagtcatgcaaaatgtcaaggtgttgggatccggatcaggatataaagaacaaacaagtgttcccaagtgaagactggtttccagcagtggcaagatattggattgtcagtggctggcatttttaatggtatcaatttttggagttacatataaaaagggaatctaactatgatttgttaaaggtgctttattttgcttcctatgctcagtgggcatttagttagcgttctacctaagcactataaagaagaaaggaggaaaaagccttacaaaaccagaagactctgagcatctacatcttacatgcaaagcgataaactgtggttcttcggcttaactcagccttttctattctgctaactaaataggctaaaaatgcacacacaattagaggggcaagtattttaaagagtatatagtataacatattataaaatataatgtaaaaatctttacattttgtgaacagaaaaatgtcctacaatccctgtccacaatattttattagcattatgcttaccctactgaggagtcacaaaaattgctgtaatattgcctccaaatgcttgctatcaatcttccgtcttcagtgaaatagcaccaaaataatgcagataacattttttgcctatctaattcgttctacccccatacctttctccttccaacactcctgcccgggcagttgcccatagtcacaataaactcaggagaatatgaccacaaagcatggtgtaatttttataaatttttgaattattactctttgacatagtttcagaatttggactttggcatttttatttaaacttatcacaagcagagagagagttggatctgctctgcaattaatcatctctgcgttacatttcccacaaaacaacgttaagaaacaaaggaacagaagccacgctaacccagcccttgatgtgcaaataattggcctggcctggcttttgtcattgtggatggcagtagtcccgactaaggtttattaatatatgctctctagacaaacagaacactggaagtcctgcccatccccaagccctgtgaaattcacaaagcatgcctcagcttttcttgctcattgcttttcaatgcagcttcctcagcataaggtctctttgtccaaaaatactgattttgatcttcctacttttaaatactgtagagtgcctaaggcttgaaaactacacatttctgtgctcttggttcaatatgctcagtgggagaaatttatcatcggagttgttgctgttggagaaatacagagatctcctttcccctcagtccccaaagcatctgttgcctggacttttgtttgtattaatgaaatatgccatctgcattgtgcaggcatttacatttcagtaggaagcagagaagggaatcccaatgaggaatccagtagccattataaaacccctttgttctccttcatgtaaaactcaaagaccaaatcctcctaagcacccgtggccactgccgtgggcttcattttagagccaggaaatgtcaaattataacagaccatcatttcactgtgagttgcctcaaaggccactcttctatttggacaaaagattgcactcatggtttttcttctgccttaatggatggcagattcgtcagaacctttttggacacaaatgatagaaacccaactgtattaagcttcaacaacaaagagaatgtactgccggtgcaactgacaaattcaaggaattgtactggatattcaaggaaatgtactgccagtgcaactgagaaattcaaggaatgaatccccaggtctgactgcctcaaggtgctaagtgatactgttaggaattagtctctccctacctctcagctcagcattccttgctttgggttatattcaagcaaattctcaccaagtttaatcctcttccgctgaattttacctcctctgctttgcagccctagtttgaaagaagttcctattatccactagttccaaaagaagtctggaaattgaatatgtttggcttgaaaggtctggctttcgtcaccttccttctcctgaaacagtgtttctagccaagggaaatacttcagcctcatggcagaccagtcacctctcacctcaggatctggagtgtgggaactgctctactgtacacacgtggactgagactggagaacagtaaaggaacataagtgtgatgttcccagaaaagaaaaaaaaagcatgtttaacaggccagagccagagatgtccattccagggagggatggctgaaagaccttccaggatttggcaatttggaaaagtacttagcctcacatgatcctggtatgaaagagctcccttttttgctctgccatcctttaccaaattccctaaggagtgcaggaaagttatgtctagatccacacgtactgcttatctttttcagagacacgtgaggttctaagttataggaaagaacaggtcagcagtttgttgccagaggtaagaaacaaagagctggcaagtgtgaaacaaccttagttgtgtgggaaataggatctggaagaactgaactagaggagccaagaatgacctgaatgcctgtggtatattcagaagaatcaacaggagaaagaaacactggccagaaagtctaattttatttctcaataatcaacatatatttgaaaagtgcacgaaaattgtaatactgataatactgataccgatcataatactcaaacagttaacatgtattcagcaagtagtgagttaataactgtgtttagcacttaacatatctagcctaaatgaagaaatgagttctgggggcgaacacagatgtggctccaatgaactgtctggagggtcaggagagcctcaggacagaacatggtgtctcagttaagatatgaaaggcaagtagaagtcagagtgaaaggaaggctgatctaaaggcaaacagagtgtattagggttctctacagggacagaactaataggatagatgtatatatgaaggaagtttattaaggagtattgactcacacgatcataaggtgaagtcccacaacaggccatctgcaaggtgaggagcaaggaagctagtcccagtcccaaaacgtcagaagtcgagaagccgacagtgcagccttcagtctgtggctgaaggcccgagtgcccctggcaaatcactggtatgagtccaacagtccaaaagctgaagaactttgagtctgatgttcgagggcaggatgcacccagcatgggagaaagatggaggccggaagactcagccagtctactccttccatattcctctgcctgcttttatcctagccatgctggcagctgattagatgatgcccacccagattgagggtgggtctgcctctcccagtacactgactcaaatgttaatctcctttggcaacaccctcccagacacacccaggaacaatacttttcatctttcattcccatcaagttgacactcaatattaaccatcacacagcacatataaaaagttcttgtggtaggtctgagaatgtagtgatcaggaaggaaagggtaattcttgatggctgaagcaccacatgagaagggtgcaaagaagggagagaagcataaaaaatagtccaggaagttaggaaggcagaaaacacattcataagctagactggatttggacttccgtggacctcccagagctgatcaaaggaagagatggttatgtctctgctggtgggtgaagaaaatgagaagtttggatgaggatctccttgtcaaatattctcaaaattctgaatactaggtacattcagatgatacaaatgagactcactcttaagagtgtattatattgaacagacttgaccatcattccaaatttggcaaaagcaagatgcttttccccaatagtaatcatgcgataagttaatcaatttatctacaggttgagtatctcattctggtatttcccaaatgtagaacagtgctagcatatcacaagctcagtaaatgtttgttaaatagatgttatgaacagatgagtattaaatgccttttattttgggtcaaaccagacctgacaactacctatttattctgcatttatttatctcctgaagaagtgcttttcttttacaaactatatatctaaatattgaatggcattataacaaaaaactattatatctattaaatatctttggggatggcttttgtagaatcaccaaggaaaaatcacactcagctctcagtatcaggaataaagattctcctttttaaccatattttcaatcaaattaaaattatcaatcctagaaatatatgtgtactatatagactgaatgtttatgccctcccctcccaaattcatatgtttaaaccttatacctggcatgatggtgtttagagcagggccttgaggagctcatcaggtcttgggggcagaaccttcgtaaatgggattaataccctgacaaaagaagccccagagatctctctcatcccttctgccatgtgaggatacaaagagaaaatggccatttacgtacaaggaagcaggccctcaccagatacctaatctactagtgaagtgatttggggctcaaggtcccagcctccaggacttcgagaaataattttttgttgtttaaaagccacccagttatggcattctgttatagtagcccaaacagactaagacaggaaactgttacccagaactaggagtgctgctatcccaaacacctaacaatgtccaggtgactttgaaactgggcaatgggtagaggctagaagtgtttggaagtgcctgctagaaaaagcctacattgctgtaaagaacctttaaaagtgattctgggtagaaatctcagaaaaaaagaagagatgcagagaaagcctcaatcttagaaaatacctatgtaatcctgaaattaggaatatgaatggcaaaggtcattctgatgaggtctcagacagaaataaggaacatattactagacagtggaggaaggtaatctttgttataaagtggcagataacttggatgaatggattttgtgtttcagtgctttgtggaaggtagaatttgtgagcaaggcaatcggatactaggctgaggaaatctttaaacaaagcactgaaggagtggcttggctcctcctgactgcttatagttaagtgtgaaagaaatgaggtaacatcagcaaaatagtggaataagagctcacctaattgtatctcccacagcaacaataatttttcagccacccacagacaaaatagcctttgtgggaaccttggattaatttaggaggttgtgaaattccaggggagcccgatattcagtagggccattttgagagggccaactcatgcccagatggcagacttggtgatcatggttctgactgcagacctggaaatggctttatcctcttgtggactcagctatggccccattttctcttggtcttattataaaaatcatcagcaaagaggcccagaaaaattcatgcacactagtacattggcagacaggccagccaaagttgagtctggatgtagaccctgaaacagctctgaaacccagttttagacactcttagctgtggacagagaggaggccttctcatccacgaacgcagagggagaaatgcctgcctgagtccccagggtaggcttgccaaactcagccctacagcagatcttgaaatggcactaaaactcagctacaacccctctgagctgttggttgtgagcaatcctacatgcccaggcatctggagggaaacacacttatctatgatcctagagacaggactgcagaccttagtctcagctgtatatcctgaagcatccttgcatgtactgggctgtccttgcattcctataaagaagtacctgagactggataatttataaagaaaagatgtttaattggctcactgtgctgcaggctttacagaaagcatggtgctggcatctgcttggcttctggtgaagcctcaaggagctttcaatcatggtagaaggcaaaggaggaacaggcatatcacatggcaaaagcagaagcaaacaagagagtagtggtgaggtgccacacacttttaaatgaccagatctcaaaagaactcacccactaccatgaagacagcaccaagccatcaggaatctacccttatgactcaaatacctcccaccaggccccacctcaaacattggggattacaattcaacatgagattcaggcaggaagaaaaatccacactatatcattccaccccagtccctctcaaatctcatgtccttctcatattgcaaaatatgatcatgccttcacaacagtccccccgtcttaactcattctagcatcaactcaaaagtccaaaacccaaagtcttatctgagacaaaggaaatcccttctacttatgagcctgtaacataaaaaaaacaaatttgttacttccaagattcaatgagtgtataggcattggataaacattctcattccaaaagggagaagtcagccaaaagaaaggggctacaggctttatgcaagtttgaaaccagcaaggcagtcattaaatcttaaagctccaaaataatcttctttcactccttgtcccacatccatgggggtgatggtgcaacaggtgagcttccaaaaccctgggcagctctacccttgtggctttgcagggttcagcctgaggctgctctcacagtgtgttgagtgcctgagacttttccaggggcatggtgcaagctgccagtggatcaaccattctggggtctgatgggtggtagcccccttctcacagatccactaggcagtgccacagtgaggactccgtggggggcctctaaccacagatttcccctctgtgctgccctagtagaggttctctgtgagggttacacccctgcagcaggcttctacctgggcacctaggctttctcacacatcctccaaaatctagacggaggccaagcctcctttactcatacactctgtgaatctgcaggcttaacactacatggaagccaccaaggcgtatgacttgcaccctttgaagcagtagcctgagctatatctggggccctctgagccaaggatggagccagaggggctgggatgtggggagcagcatcccaatggtgtggagtacagtgaggccctgggccctgcccctgaaaccattctttccacttagacctctgggcctatgatgagaagggctgccacaaacctctctgaaataccttttccccattctctgggatattaacacttggctcccttttagttatgcaaatttctctagcaagcggttgctacgtagcctgcttgaattcctctcctgagaaagcttatcctttctgtgtcacgtggctaggctgcagattttctaaacttttacattctgtttcctgcttaaatataacatccaactttaagtcatttctttgctcctgcatctgataggtaggctattagaagcagccaggacatatcttgaatactttgctgcttagaaatttcttctgccagataccctaggtcatcaccctcaattccaaacttccacagatctttaggacatagatcacaatacagccaacttcttcagcaaggtataacaagggttcagtttctttgcttcagttcccaaaagctcctaatttccatctgaaacctcggcagcctgaacttcactgtccatatcactaacagcattttggtcacaaccatttaaatagtctgtaggaagttccaaactgtccctcatctttcttttttattctaagccctccagattttttcaacctctgctagttacccagtttcaaagttgcttctagattttcaggtatctttatagcaatacccaactcattagtaccgattttctatattaggccattcttatattgctataaagaaatacctaagacaaggtaatttataaataaaaaaggtttaattggctcacagttcttcatgcttaatagaaagtatggtgcaggcatttgcccagcttccggtgaagcctcagggagctttcaatcatggtggaaggcaaagggggaataggcatgtcacatggcaaacacaagagcaagctagagagttggggaggaggggctacagacttttaaatgactagatctcatgagaactcactcattatcacaaagatagcatcaagccatgagggatccaccctcataaccaaaacctcccaccaactccccccacccccaccaccaccactgcattggggattacaattcaacgtgagatttcagtggtgacaaatatccaaactatatcattgtgacttggttttagtccctttaagccatggctggggtcaggactgcctgcccaggtacatattcagtgacctaggaggagccctcccagggacctggaggaagtcactcccagttgtgcaactggtaacaggcctgctgtctgcataccttcaagtggttcttcatcccagtgccagccctactggccaaggtactaatggtatcttgtccaccaagaggtcagacaaaagccatgcctaccagagacactggtaacaggcctgccaactgtgggtcccctcgtggactcatgtgatccagctcaatcgccacaagactgcaatcctataggcaatcccatcagctcagagtctcaacatgaggaggcttttcctgccaaaactagtctgtaaagactagaagcggtatttgctcctgcaaatgcatagccatcaatgcaaggctacagcgataacaacaaatcaggcaaacatgacaccaccaaaggaaactatgaacattctataattgactccaaagaaatggagatctacaaatttccttaaaaaagaataaaaaataatcatcttaagaagctcaatgaaatgtaagaaaacatagacaatttgatgaaatcagaacaatgcatgaacaaaataaaaagtttaataaagaaatataaaccataataaagaatcaaacagaaatcctagagctgaaggataaaatgacaatattaaaaaattcaacagacaactttaacagcagactccactatgcagaagaaataattagtgaattcaaagacaggccatttgaaattagccaagtccaggaccaaaaagataaaaagatttttaaaagttgaagaaagcattagggacctatgggacaaaaatcaattgtacaaatatataaactgtgtgatttctggaaggagaaaggagagagagtaagagacagagaattatttaaagaaacacttgctgaaaactatccagacctttggagaaatatgagtattcagattcatgaaatttaaaggatcccaactaagatcaacctaaagaagaaactccaggacacattataaatgaattattaaaagtcaaagacaaagaaaatcctgaaagcagcaagagaaaagagacttgtcacatataagaaaatctgcataaggttaacagcagacatctcaacagaagcctttcaggccaaaatggagtaaggtaatatattcaaaatgtcaaaagaaaaactgccaactaacaatattatactcagcaactgtaatgctaaagggattctttcaatttgaaagaaaagagttatttctgtttcatgtaacaacatgaaaacatattaaagtataaagctcactggtaagcttaagtatgtagtcaaattcggaatatcctaatattataatggtggcttgcaaatcacttttaaccctagtataaaagttaaaaagcataaaaaaaaactatagctataataatttgttaatgaacacacaatataaaaagatgaaaatgtgctatcaattttataaaaaaatgggaaatggggcagtacaaacatagagttcttgtatgcaaaataaggtaatttgttatcagctaaactaaaatattataattttaggatgttttacgtatgttccatggtaaggtaaccagaaaggaagaaatctctagtagatacacaaaccataaaaagaaagaaaacaaagcataccaatacaaaaattcaacaaatcacaaaggaaaacagcaagagtggaagaaagaaacaaaggaactacaaaattgtagacaattaaaaaaatgtcaatagtaaatccttatctatcaacaataactttaaatgtaaatgaatgtaactctctaaagatacagagtgtctgaatgggttaaaaaaaatcaacaatatgctacctaaaatagactcacttaagccttaaggacaaacatagactgaaagtaaaaaaatagaaaaaggtattctatgaaaaatggcaaccaaaagagagcatgggtggctatacttatatcagacaacatagattttcagtcaaaatctgttagaagagacaaaaaaggtagctacatgatgataacaattgtaaatatatatgcactcaacactgacgcacctaaacatataaggcaaaaatttcagaaatgaagggagaaatagacagcaatcaaataataataggggacttcaataacccatttttcaacaatggatagatcatccagagagaaaattaataaagaagcagtaggcttgaacaacactataaaacaaatgaacttaccagacttacagcaaacattccatccaacagcaacaactacacgttcttctcaaatgcacatgaactttctccatgatagattatactttgggccacaaaacaattcttaacaaatttgagaagactgaaatcaacccacatatattttctgaccacaatggtataaaactataaatcgatatgagaaataattatgaaaaactcaccaatatgtggaaattaaacaacatactgttgaacaatcaatggttcaaagaaaaaaatcaaaatagaaatgaaaagcatttgagacaaatgaaaataaaatacaacataccaaaatttctgagatgcagcaaaaccagtgctgagagaactatatagtgataaatgccaacatcaaaatgaagaaaaaggccaggcgcggtgccttgcatctgtaatcccagcactttgggaggctgaggcagatggatcacgaggtcaagaggtcaagaccatcatcctggccaacatggtgaaatcctgtctctactaaaaatacaaaaattagcccggcaaggtggtgcgtgcctgtagtcccagctacttgggaggctgaggcaggagaatcgcttgaacccgggaggcggaggttgcagtgagcggagatcacaccactgcactccagcctgggtaacagggcaagactccatctcaaaaaaaaaaaaaaaaaaaggaaaagaaagaactgaaacaacctattgttacacctcaaggaactaggaaaataataaactaggcccaaagtcagcagaaagaaagacataataaagaccagacctgaagtaaatgaaatagagactaaaaagaaaagatcaacaaaactaagagttggtttttttgaaaagatataaatagacaaagctttaactaggttaaccagaaaataaagagagcccaaataaataaaattaaaattataaaagcgacccaaaactggtaatacaaaaatacaaaggatcataagagactacttgagtacagttattcaccaacaaattggataacttagaggaaataaataaattcctagaaacattccacctactaagatgaataatgaataactaggtaatttgaatagacaaataacaagtgagaagattgaatcagtaatcaaaaacctcccaacaaaaaaattccagggtcaattataccaaacgtttaaataattaatgcccatccttctcaaagtctttcaaaaaattaaagaggagaggacatctccaaactaattttatgaggccagcataaccttcaaactaaagccaggtaaggataataccagaaaataaattacagtccagaaaccttgatgaacaaagatagatgcaaaaatcctcaacaaaatactagtgaaacaaactcagaagcacattaaaaggatcatacaccatgtcaaatcagaagaatgattcaacatatgcaaatcaataaatgtgatgcactactttaaaagaacaaaggacaaaaatcatagatagtctcaacatatgcagaaaaagcatctgacaaaattcaacaatcactataaaaactctcaacaaattagatgtagaaggaatttacttcaacatgttaaaggccatacatgacaggcttatgggtagtataatactcaatggtgaaaaaatttaaagcttttcctcaagatcaggaataagacaagcatacacactctcatcacttctactcaacatagtaatggaagtcctagccagaaacattgtgtgataataagaaagaaaatgcatccaaattggaaatgaaaaagttaaattgtatgtttgcaggtgtcataatattatatacagaaaaacttaaacattctaccaaaaacctgtcagaactaataaataaattcagtaaagttacaggaaataatatcgacatacacatgtcagttgcatttctatcacctaacaaacaactatatccaaattgagatacagaaattgagatcccatttacaacagcatcaaaaataagatacttaagataaatttggccaaacaggtgaaagatacctacactaaaaactataaaacactgatgaaggatatcaaagaagacataaactaataaaaacatatcccgtgtttatggattggaagaattaatattgtttaaacgtccatattgccaaaagtgatctacaaagtcagtgcaatctctgtcaacattccaatgacatttttcatgaaaacagaaaaaaaaaaaatcctaaagttcatatggaactacaaaagacctgaaatagccaaagcaattttgaagaaaaagaacaaagctagaggcatcacactgcctgattttaaagtatattacaaagtcatgtgatcaaaactgtacggtattggcataaaaacagagatactaaccaatggaacaaaatagagatctcagaaataagcacacacatatgtcgtcaactaatctttgatgagagtgccaagaatatacggtgaggggaaaaaatcacttcaataaatgatgcttggaaaacaatatccatacgcagaaaaattaaattcttttacttaaaccatatataaaaattaactcaaaatggattaaaaacttcaatgtaagatctgaaaccgtaaaactcatagaagaaaacatagtttaaaagctccctgacattggctttggcaatgattttttggatatgacaacaaaagaacaggcaataaaagcaaacacaaacaaatgggagtacataaaaccaaaaagcttctgcacaacaaagaaaataacctacctagtgaaaaggcagtccatggaatgagagagaatgtttgcaagctagctttataatgaagggttaatatccaaaatgtttaagaaattcatacaactcaatagcaaaaaagacaaatccctgattaaaaagtgcacaaagggcctaagtagacatttttattcaaaggaaacatataaatggctatttgtatgttttctttgaaaaatatgaataggtgctcaacatcactaataatcagaaaaatgaaaaatgaaaccacaatgagataccacttcatacatagtaggatggccattatcaaaaagacaaaaggtaattattggtgaaggtgggaaaaaatgaaacgcttgtccactgttgattggaatgtaaattggtatagccattatgtaagacagtaggaaggctcttaaaaaattaaaagtagaacaacattatatgatccagcaatctcgccctgggactatctccaaaggaaatgaaataagcatcttcaagagataccagaatctccatattcattgcagcattattcacaatagctaagacatggaattaatcaaagtgtccattgctggataaatggataaagaaaattatatatacacacacatacatatataatgtattatacataatgtacacacacacatacatacgtacatacacaagcaatggaacattatacagctttaaaaaggaaatcctgccatatataaaaacatggatgaacttggaggacattatgctaagtgaagtaagccagacacataagggcaaataccgtataatttcacttatatgtagaatcacactcatagaaacaggaagttaccagggactaggggatgcaagaaagtgggaaatgttgatgtaagggtacaaaatatcaattttaagatgaacaaattccagggatcaagtctatggcaagggtggtaatggatttattaattaatttgttataatcattacacaaagtatacacatatcaaataatcacgttgtacacattgagtatatatgatttttatttgccaattaactatttaaaatataaaagaaataatcttgctatcaacagatttattaaatgtcttggtttaattttattccaagagcttggtattaatgaataatcatagaaactatatacaaaccaatacactaaagagtaacacaattattgttgatatccaaatttgtcagaattaaaatccaattttcagtttaaaaaagaaaatgagagaaatgagttaaagagggaattattaagcagaagggaaggagaacttgaagatttgaaaaattcttagcctatccctattgcaaaaagtgaaaaagcatggccaattgcctatttgaaaagaagattaatatgggtgtgaactatgaacttaatccaccacccaagcaggaaaactgccagttagaactgaaaagaaaagaaacaaaaagtaatgaaggaaagctatcaggctttgttgtttttgcagcatgggaccagagaggtatatatctgagaacagacattattcttcaatacaagaacaatgaccccggaaggccattcagagaccatcaggactgctttctcaggttcaaaacaggggatcattgctttgctctcaacaggccagaaagcctcttctcaaagctgtgagatcagggccccccagaactgtgaggtcatgagtacccaggaaagcgctgggggtgagaaccctgcagagtagagtttcaagttcaggacttcttccctagtgggcctagaaggtgaaatattagctccagtgggcttggaggcacagcatggagccagaggattattcttgacccttaattccttcccttctcaagatctcatgaagtttgccttgtagtttcaacttacttggcctctgttactccctttcttctttcttatttctcccttttgaaatgaaaatgtctagcctatgcctgtcacacaattgtattttggaagcacataatatgttttgtttcaaaggttcacagctttagaggattttgcctcacagtgactcatacctcgagtctcacacatacctaatttagaagagacttagaagagacttgggacttagactttacagttgatgctaggatgaattaagatatttgtggctaatggaatggaatgaatgtatttttcatgtaagaaagacatgaatttcgaggggctatggacagaatgctatagactgaatgtttatgtctccccaaaattcatatgttgaaaccttatccccagtgcaatgatatttaaaggtggggcctacaggaggtgtataggtcatgagggcaggactctcatgaatgggattaatgtccttatgaaagagactctataaataagatcccttctacctcacattctaccatgtgaggacacagccatctctgaaccaggatgtgggctctcgtcagacaccaaatccgttgctgccttgatcttggacttcccagccttcaaaactgtgagaaataaatttctgttgtttataagccacccaggttatgttattgttggagcagacaaaactgactaagacaatgtgtttattttttctttagctactagacagtttgcagtaaatccaggaaacaatccatcagttgaatgggatcatatcatatgcatatgcccatgacacatttatccttgggctttatttttttcctccactgatttatctaacatccaatgtcctttgatttaaaaattaactctatctcactccataaatctgtgagggactttgcaaaaaattacataaaaggataaacagaccgatgggtgactatacagatgaattgatatctaggtaaataatatctattcaggtctttgcacccttatccatttctacttcctttcagactttgaggatacctgcaatagtaactacatttttttcttgtcagaataaccatatactgagtatgtcacattttggttgtctcctctatttctgggtaccataaaataacatataactatgtctgagcaatggatacagacaagacatgacatgtaaaacttccaggtcagaatacttataatgtgaggtcctccacagctctcttttccaatctcaagaaccagcaatgccacagttggtggactctttaacacttgggtccctgagtgataactatgcagatgagaactcccacatgactcacacaggtcatattgttctttgctgcagcatcaactaatctatcctgaaagctatataccataatgaaatgagtacagagccagtgaaatggaagtggtggacaagcctccaaagtagctgaaactggtaatataggaagtgaaaggaaaaggcaaaatatcaaaatttcactgcagattttgaagtacactttcaaaactgcaaaagaattggtaagggtttagagatgaatcatgaaagtgactaggatagacatagaaacagcaaagaaatattaaatgtgctcttattgtttacctacagaatggtggccctttgtacatttcatgcactcagctgaggtattgcaactagttttaaagaaaggctatggtttgtatataagggttgcatttcaagagtctctagcagtaatccaatttaatctttcaagggaataatacaaacatgggatttgtaatcagaaatatcttactgtggctgaggctttgaaaatgttactttgctttgcttggccttgatttttgttttattaggaaaatggagagtattgtacctatatgcagtgttgatgagataatcatattaaataatccaagaaaatctttggccagggaaaaagttcatttattattagaagccttcaaatattttattttacaataggaagtctaatccacagagagattaacctagttgtccatgtcatggagctaagaaaaatgtcttctaataacctatagaatttgggtatttttcatattttctgaggactaaacaagtagataggtcacaagttaagtcaaaattaatttcagatagataaaagagtgagagtattcatcatccaaaaaatggagtggtagaaaatgaaggaggcctgagagtctctatctatggaactatccgtttacagccaagactgatcacagctaaccacaaatctgccctcacttagaaaagctttccatggtttcttccagctaattcctatatgttttaatatcttttcagagcacaaagcacatgccatctaggatgactaccaggctttccatcatggcctgccttataatatatctcctgtgttattatcattcttactgtttattagactttaaattggttttacctttgcaagtgaatatatttaatgtcagaaataattagaagtcgagatttttgagggtaagtattgaatgaatgttaactacttggcatcttcatacatcatatataaatgtatcatacattatacatcaatacagcataaagcatctcttacagtgctatgcacatagcaggcaggtaatttgtatttgctgaatgaataaataaatacatgaataaagaaagtaataaaaaaattcactgcctgtaggcaagtacctggaagacatgattgtacagtattatattattctattctctgatgggaagagtctgatttagactagaaaattcaaaacaagtaagaggacatcgagactaagcaaatcacagcagtgatacttattagtttatagacagagaccaaagacttataacatggatcacttgaaataaggaccaggaaattcacagaagtaggcaatctcataatgcacaggataacctaatagatctttccacctgttattcctctaagggaggactctttccatgaaaccaaagatgactaacttgaaaggcaaagcacgactgcttaaaccggccatgcatcactggcaccaaactgctacaactgaaaatgcggaaagcaggctatccacattcaagcaaacccatttaattcccatactacatcccttcttgtaacatgctcctcataggggagaccacagtgaggaaatccctaggttctatgtttcaggtctcaagtgaaaaaaaagcaagaaaaaatgatctatgctaaggagaagagggagatgggaataggatggctttgcttagggtctatatgccaaaatgcagaggataaagagaaaagcgaccagcacttcgaaaaggaggttcatgttagaaggtaacatggcacagtgaaaatcacaggtgtctttggagccgaagtctttaaatttataacatgcaacttagtgtctataatctcaagcagtttatttcatttttctgagcttcagtttcccttataaactgcggacagtaccacctgtttctcagggttgccacaggatgccatgtgattattcatgagattgtctggaatatagtagctcagtaaaatataatccctctctgtcaatcctgagagccatttttgacaaaacaaaaagtttcagaatgttgagaagatccataaaatgcatggacctaggcaaagcaggagctcagagctagaactggttacatgagcagaagaagcatccccactgctctcaatcaaagacttgggttctcaaggacaaaattcatacaatgacatctttgggaccatcccttctaagcttttaagttgtttaaaggaaagtacaacaaagaaggctagatgatgcctgttattacattattgttaagactggagggaaaggcattaaatgtaaaatggctaactgtgatttaacaacattatcaaacatgattctacagtaaaaaaaaaaaatcacagggtattaagtaacatcatatcaattccccagggaatatcatttagagacaagataaaactggcataacagtacatacagttggagaattgttatgataagggacaaaaacacattattttcttgtgtatgcatctctttgcataacaaatataaaatgtctgaaagaaatacacagtggttccttttgacacaaggactgtctgtggtttgggcatggggagaggggctatcaaaggaaaccaatatttttatctccattttcaccttttaatacaaaaatgtatttattatataataatacaaatgagggaaaaggaaaaaaggaggcaagcacatctacctccaaaaattagtttggtggacagggagtgtcccaagggaaaaagcaccagccacctgatgctgctgtgaatgtagatgtgaccctctgtacttagtgccagtcttgagaagtgctccggagactggttttggctttgtctattccagagggcacaaagaggtcacctcataagggaaaatacccgttcaaatgacattcttatttctgtctctctgttctcacaactaagcacaatacaagcaagggcctgccattcctgaccttggtcaaccctgatatttcgtccatgtactatttcttccatgtacttttccttcaagtaaaaccattagaagtctgattttcatttccttccttcttttcccattcaaaaagagaagtgctgagtagtaagtagcaagagttccactccaatgtcagggttctgtggctcttgcctctctgatcacttaaccaggaaaggtaaggaagaagctactcaacctaattatagataaaaatagcatggcatttgagtgtctgtgcttttatctgaagaaggaaataaggtaagaccctaatcttaaatgatgcatatacaaatagcggtagcatttagttatttttatggataaaatagctttttaagttaattttctttaactttgatgctgatggcacaatagcatgatggcacctctgtgtcattataaaatgtctatcatctccttacggactaaaagcaggaaagaaaaaaaaaagtagtcctgtttcaggctccaaagtgaggcaccgatttagcacttgtcttctcttctgaatttgcagctggagataagctaagaattgggcatgaagaggaaaaggaaggaaaactcaagttgaaataacgataagcaaatgctcagagttgttgatgtcatcctagacattgttagagaggcaaagacagtatcagtcattttgacaagccccttctgttcactgttactgctttcccagggaggctttctttcacatttaagatgagaaatcatattcctctccacccacaatttcccctttctttttttcactttgttaaaacatctaaaaatcatgaggcaaagacaaactggcaaaaaaaaaaaaaaaaaaggaagaaaatgaacaaacacaacaaaactgaatgaagcccaaagtgtctgaagagccaaagcagctcccaacttacaagggggtatatggtaaacattctcaatgatgttgcatctccccagtaaataataaaataattggtacttgtattcacagttttgcccacatctgatgttgaaagcttagactagatgaactaatatgcatatgtaataaagcaatatagaagataaccatactgttcaataaacagtaaaagaaactaaaatggactggaattatttgaatgttaattcttgaaagtaagttcaattacagaaccttgcagtggatagatggaaagtcacaaggcagaaccctttgaaagcagggaatatgtcaaaattagcccagtacttagcacaagagagaaacacaataaatagaatgtatcataagttaatgctgcaaatataaacaagaaactgagatgtgtccagagttgaagatgatatattggataacttttagaacgcttaatttaactcaaaatgtaaggattttcttttacctacaggatacagcttagtgtttaaatttgcaggccctggagacagaaaataagggtctaaatctatgctttgtcatttactagctaggggacttgaacatattacctactggaagcttcagttacttcatttgaaaatggagacaaggttgcaaggtgtggtggctcacgcctgtaatcccagcactttgggaggccaagaagggcagatcaggaggtcaggagattgagaccatcctggttaacacggtgaaaccccgtctctactaaaaatacaaaaaaaaaaaaaaaatgagctgggcgtggtggcgggtacctgtagtcccagctactcgggaggctgaggcaggagaatggcatgaacctgggaggcggagcttgcagtgagccgaggtcctgccactgcactccagcctgggcgacagagcgagacttcgtctcaaaaaaaaaaaaaaagaaaagaaaatggagacaatgcaaactgtgaaggttagagtgagaattaaataatatatgaaaactttttgtaccacgcttcagtgctagtgtgtttacaggtatgtgttgttattgttcttgctgagcccaggagccctaggaagagatatgtgttcagctggcctccaagttcatgactcgttccaaaattaggtcctaattttgatctctgcctgcaattgagacaagaccatctgaaatgtatttaagtcttgttccctttgcaaccctggttccaatgttagaattaggtatgtaattagaaacctgtcagataggtaacataaaatggaatcaggaccagtcaggttttaatttttcctttttttctcccaaaccggtgactatgaaaactagctccaaaatgctcttaactgagcacagaaaactgaaaaggaaggtaaacgaaccattaatggcatcaattcttccctgcaaacattttgctgggaactggtggtcgacgtgatctgagcactagtggggcagcacaaaaaaagataaaagaaaaacaggtaatctgagtctatgagtcagtgatccatcaacttgaggactcatgtaagaacaaaatcaaaagtgaaaaacaaacaaaacgaaaaacagaaaaccagccaaacctgataaaaaagcaaccgtgtatgaaacgtgtaattttctctttacaaaactcacagagcagacagcatctctccaatttgatcaaggaagtgtcagccttttggtcagcaaaatgcaattgtggaaagctgaattctacctcactgcccactctgctcagctttcttttctttctttcttttctttttcttttttttttttttttttgagatggagtcttgctctgttgccaggctggagtgcagtggcgcgatctcggctcactgcaacctctgcctcccaggttcaagagattcccctgcctccgcctcccaagcagctgggactacaggcatgcaccaacacgcccagctaatttttatatttttactaaagatggggtttcaccatgttggccaggatggtctcgatctcctgatctcataatctgcacgccttggcctcaaaaagtgctgggattacaggcatgagccaccatgcctggccccgctcagctttcttaaagcaaaatgcccattttctttatttcagaaaggcctagaagtttcacaaatttgctcagctagaaattttcaaggattataatgatatttgactacttcaacatgaaaactgctttggatttacctttggaagttgggaacagcttaaagcattctgcctggatgtgcttgatctgaccaggaaggctatcttagaaatgtcaggagcatggatattcactcggtcactactcactcatcttattagtggtggctatacaatttttgcatacagaagacattgcttaacgcatttgcatatgggaaaaatctctgaaagtgtggcttttgggactgcatcagaaggctgggaagcaaataatgaaggtgaaataagggggaaaacaggcttctagccaacttgaaaatcagtatttcttgctcataacaggaaaactaattcagtaccaccaacacctggtggtttgtgtcttaattgaatcattcagttctttttttccccctctgctactaataactgaagtttaataggattttaacatttccagcaaagtggcacatatccctagctctctcagaagaggtaattgaccacgattgtattaaaccatcattatgggaaatgcttcaggtcccagaagaaatgctaccaatgcttgtaaattggaatgtccttccttccttttgtccctaaggtgattttccagtaagctaacgtgttgggcaaatgtctgtaacacgtgattaaacatgattcaatctaattaaatacttatttaaggtcaatttatctctgcttgactttattacctcctgtttgaccttggcccttttctttccttcctgaataagtctttgctttggaagcgtcccttgagtgacaataatccttttcattttaggctcactttaagcctaacctcttccaagaaaaccaacgatcacttcatcctatctaaaacaaacaaacaaacaaacaacaaagcactctccaatgtctgctcctagtttttaaaattacaagtaaacacttagatcaccagcctagaaaaatatgacttaccaagagttccaagccatatagtcagcatctttgaaaattgccctgcaccacccagaaaactgtgattcataaataagaaaaacgtcttcgatagacaggtatctaccttattaaaattcttacgtttagattgtagtcaaattttaatgagaaataaaaataatctggcttcctgttgacctttaaaagagaagaaccttgtgagattctgtattccattagcttaatctataccatttccagcctttgggatgaagtcagaaatcctcgttaggaacctttctctgcatatttgtggagagtctgtctccatgtcatcagctcattatgaaacactaaggagaggggacacaacagttctgctcattgcagaggcacttcttttgatggatgtggattttatctcctttaatcgcgggcatttccctgcatcccagttgagagggaggatctgtgacctcaacataattgtattaatgaatcagttgcaagcagaagggacacagtctgtccatgacagaaaaacgagcctaaaagatatgttaggaactaatgagtaaattgggagaatacttgtaagcactctgcttgccataaatagcaacagcaagggaacagcatacaacttagcgccacaggcaagtagcctttccatcccagcccactcacttgagcccagcagtggttaacatgatttacagatctttgatggctttggaagtaaatgagatgccaaccccaatcttgtttgtggcaggctgattattcaaagatatgtaattgcataaaacaaaaaaaaatgctcatgttacattggcttttcaaggaggtttgctgataaagagctagatcttgccattaggtaagagagattctagatgaaaactaactgattcaggattctatgctgtcatttggggcatttcttattcttatgtgcctggaaccaatgaatgcacttctgcttgaatatagctcccttactttcagcaccatagttgaaattccaattttccaggatatatctgtttgggcctccataggtctggactcctccactactttgatttccttagaatacatgttgtgtattggtgattctatgtcattggcatgtctttctgttcattttcttaagtattcttgcatcctttttgtgcatcttccccacaggcataactttgtctatgatttggttaattcttaggacagcagggaaatgggatcatgttcctgaagatagcagaggaacttaaacaaacaattggctctagtcaagtcctctgtgaacatctcacgccttttctgattttgcatcacctcacttgtgcttccatcctgcatagacagctttccccttctgccctcatgctcaaaggctgcctttccatctggcattgttcaaaggcacacagccttaccagatttcttccacctggtaggtagggcccacctccacctctgaatgtgaggcaaactgagagaatggagtgaatgtggcaataaaggctggtttttgagtcaggcatacctggctttaaaacttatctctttcctttactagctgtgtgaactttggccagtaatgtatcatcttggaacctcagattcttcattgtaaattggtcacacttatagtgatttcagctatttcacagatagaatacaagtatttctgcaaaatagctatgaaagggactggaactcaggaggatctcaacacattattttattttccttccagtatttccacttactacttgtacactcttcaatataagtataaggtcttacaatcttcataggcaggaaacaaattccatagcacttccatttctacttaggaaatttaagtaatccttttctccagataaacataagcccttcttccagaaaaaaataaactaagcctaaatcatgttcttcatgagaaagaatttacacaaaagaaacaagagattaaagtgtactttgggtgaacacaacatcgggttgcatgatgtcccatcttgctctcacagttagggaagttgcaaatctcaagagtgacctttcacagtcgctgggcaaggaggaaaggcagaaggggcaatagagtctagattttgaaatcatcagtcctgtaagtgtttgatcccatcactgtcatttaccagctggttggctttggataagtgtctgaactcgttttctcatttctaaaatggaagtaacaacagtactttgtgatgattaaatataatgaaacaaacccatggaatgtgcttagcaaaaacactcaaacacacacctgaaccacagcatagggaactgctgaagaactgctaccattagttccttaaggaacattttcctagctgggacttcattaatcctaatacccctttatcgtggagatggagcacttcttctattttctccttgcttcataatgctgatgcgtgatgttgattaacatcaattctttggcatttctccccactgccctttagctatgatctcaatctccaataaggtgtcctgggtcttactcccaggtcgtgccactattcctggtgatgagactctgataaaaatacattaaattctgcaaacttcttaataagaggtctgcctaaaaacatataatgcacatctgaagtccttttaaaccaataaattatttgcaaaaaaggatgctctttctcaacaccagtccctgagcacaaactcgtacaaatatcaaggcaataacaaaagtttccgttcagattcaagacaccaagtacaagtcttgctggagcaggcttcttcagctggttgctattgacagcagactgggtgaaattgttctgaagtaccacatgcatgataatagctgtctagatacagcaaatagatataagcaaatgaatggtcttggaactgtctgctgtcattcatttaaaagagaatctcttggaggctgactacctttgttcaaaaataaatttaactagaatttagttgccgtgggacgaaagaacatagaataaatccatcaggctcaagcgagagctgccagttccttcaacgttaagagaaatacaatgattgggctcaattgctcactggcataaaaagaagggagaaaaaagaatgttcaaataactctgttgttatcaaaggctgcacatgagcctgaacaataacataattgcctttgttcattagggagaaaccaggtggagacggtttaatgtcttaattaggaaaatatttcacacgagcataatttaagttttaaattttacccactcttcccaatttgtcatttaacttgaaaatgggagtgtgttcttgtcatcttacattccaaaggcttcttcgaaacaaacctcttcaaaggaagatctttaagacccttttcaactgctcttctaattctcctttctcagtgcccctaataacttctttgatggcttggatgaaatctctttttacttattgattttagttaccccatcactcactctattgctattgctggattctgtgtgagagaccattgatcatttccttaacttcacaaaagctttgctttgctcaagtgggagtttctgtgcttgttgatgtatgtttatccattaggaatgaaatcatgttgctctgccttacagaggatccacctcatctaacttgagcagacttgataatgtcttcaatatgtccaagttttctatatattctagggaaaaagaacaaactatcaaggaagaaaaaatgtttcacatgcaataaaggaccatccaactggagggaatcgctgtcttccaatcctaattttaagacttcattgtgagttaagagaacccaaactttctcagtcaaaccaccaataatgagacaatctgaataacctagtcactctagtgtccttatgtagaagcagaggaaaatttaaaaaaaataggtttctcatcttatggctacttttatttacagaaggaacaagtggactctgctatacagttacaaactgcagagcaacaaataatcaacatttctcaaaatcaagcttcatacttataatagttttaaagtagaaaacatattgctaaagcagtaacagatgttaaataattttgagaggtaaaccaggtattaaatgattaatcaaaaactttccaaaatctatccagaagagcaaaggctgggagcaacttatttagagttgtaaaaggagttcaacatcgtaacaacggcctcacatggctgacaagagcttctgtgcagcagacaggcaatggatgggagcacaaaaatgtaaagtctttcgacttagaatctaacatcttttgttcccactttggcccttatcctacctgaaggtgaacagatttccctatggactctggaccccagagctccttcctcgcagaaagttttctttttttttttttaatcctagattactcttttaattggaattaaaaaatacataaatgaaatttactatcttaaccatttttcaatgtacaatccagttgcggtaagtaccttcaaaatgttgtgtaaccatcaccaccatctatttccagaatgtttccatcatccccaaacagaaacactggagccattaagcaataactccacgttcctccctcccaatcccccagtaacttctagtctactttcttctgtctttacaattaaatttgcctattctgtataactcatagaagtgataaaggctagaatttgaactcacttttcaaagcctccttgttgcaaacaccacgtgtaggtgtccaggtcctatatacactctcctgctctttatagtacctgtccttagttctgagcattcttgcatttgggcttcttttgtatttcttttaatgtttgtcccctggtgttgacacagacattattattggcatgtcctcttcccaggtctctgacttagatctttcacatcacatttctgccttatcctctgacccaactcctgctcctccaagtcttacctcttttttctaaaactaatctatcaactatagagcctccctcaaaaactgctgttcccacagtctagctgcagaccatctcttggatgttgcagcattttggatgaaagcctctctcttttggcccgatgcagtggctcacgcctttaatcccagcactttgggaggccaaggtgggtggattacctgaggtgaggaatttgagaccagcctggccaacatggcgaacccccccatctctaccaaaaatacaaaaattagccgggtgtggtggcaggtgcctttagtcccagctactcaagaggcacaagaatctcttgaacccgggaggtagaggttaccatgagcctagatcacatcatggcactccagcctgggccacaaagcaagactgtctcaaaaacaaaagtctctttcttttatacttgagaataatgctaggcagagtctgctacacagaggatgctatcatgaaaatcctctgtgacaaaaatcctctgtgactgagttatcgtcaatccactttacagactgagcagccgaggcacaatgataggtgggaaaaatcttatcttcctttctttccacttctttcttgtccactgcccttagcctccgtccaacaatgaaccactgctgttggctgaaaaatagaaaatttgttttccatcaatgtttctttctttgagaagaaagtagcaaagtaaaacctagaaagttaaacttctcagactcaactaagtaagaacttatagataattctcttttgcctagcatttaaaggcatcgaatacaggtcaatttctctctctctcaccctctctccctttcccctcttctttctcttttctctcatctttcccacccatcatccttacctcctcaagacagtcaggttttataaactccaggcaatcccattatttattcctatacccaagctttagctatgaatagacaatttcacatttttcctatccaaacccacctattcttaaaaattcagtgagagcccctcttgtttagcactatcccacccattctgctcttaattccggtgccatatgttaatttacacaacatagcacttaattttcaaattagtagttccttagttctagactcaagctccttgaaaactggagttatgatgttatttgtaccatgtacccatcatggtggcaagcaatctttagcacgctaacagtagacaacaaatacttgtttcttgattcgataattcagtcacagctgggctgaagtttatctccgtactgtcaatgaaataaagggctggctaagcaaattaatactgtaaacatagagaatttggcctactttatgtgaaaatcaacacactattttaagcagcacttccgtgcctagttccattcaaacaatcgatgtgctgattgtgattattgtctgtttgttaaagcattaaccagattcactaagattaccacgttcaacagccccgttgttactctatgtgtataaccatatttctgctattacccttctcatatatttcaaaaataaaaaaaaataaaaaacgagaccttgtacaactaactcaacatacacacaagcttttcccttcctttgaaacaacaatcacacttttggaagagtcagagcaattttgtttcgtcccccttatcagtgtggggacaaagggaactttccttacacccgctgaaggttcagcctctggaataaactagacaggagaaaagacgtacaaatttattacattcatattcacagagtctgacaaaataagagattcaaagaaaggccagattggttgaattttaaatagaattttgaactacaggaataaataggagcttgaaggctcctgcagagaaactatgagaaggtgaggggaggaactgcactgtgaacgaaggttgtctttttgggtggatacagctttttaggcagcagtcctcagaagaacaggatccatggacctttggtctcctttccagtgagctaatcttttgattgatattatagggagggggctcaagacaactgcattccttctgcagaaaaaacttcccttacttagataagggaacttcagagaaagtccctcctgtgtttcaggagggaagggtagaatgccggagaaggtcagaaagaccttgattttgaggctatttctgaagcctttcaatatcctttatttcagagtactcagtgtgctgaagcagtacatttgggggtatcattttctgagttccaacatcaggtacagaagatgtttttacaggagttagaaacccaggctgctggaaggcctttgtgggaagaacccacaattcagcctcattgcatttcttactttcttcccttgtgtctgtttcaccagccttggtgcatgtatgtaactgctggcacttggagacaactgttgcagttttctaacattcagaactttagaaatgtgccaaccaaaaacaaatctagctgtatctgtgaaatgaatggaagtccaacagatccccagctttcaactttagattttcttctgtcttttctgtctgtctaacaaacataaatagcttactcaagcagtcctttacactgtgtcaaaagactgctgaacgaagaaaacatatgcagaactacagcttccaacaaactttgccacaaattgctgacatttctgtgtgagtcagaattctctccctatgcactgctactgttgctattattactactagtagtagtagcagtgctagtagtagtggtgacaataaaggagtcagagggtcttcctggccctgggaaaagtaactggcatactttcactctaataggttggggaccagggggagttagaaactgatgtcaggaaggaaaaaaggaattatgtggccacaattaattccatcaagaagtaactatcattttactgcaaatatttcacaactttttaaactttacgcttttaactcctactgaccagcctcccttctttctacctctaactaaagtgaataatttaagatttacattccatcggccaggcgcggtggctcaagcctgtaatcccagaactttgggaggccaaggcggatggatcacgaggtcaggagatcgagaccatcctggctaacatggtgagaccctgtctctactaaaaatacaaaaaaattatctggacgtggtggcacgtgcctatagtcccagctacttgggaggctgaggcaggagaatggcttgaacctgggaggcggaggttgcagtgagccgagatcgcgccactgcactccagcctgggcatcagaccgagactccatctcaaaaaaaaagacttatattccatcattccacagtagcttagtgtaactggaccacaatgtaagggttggggtgggatgagaaatcggacaagtcagcagaggaaaagtcattatcgttccagatacactatagggaacccggaaggattttaatgggagtacaacaatcaaatgcatctttcaaaaacttaactctcgttgctcagatgatgtcctgggcccttagttgagtggccatggctttgcctgtgataagaaacacacaaggaagagatttggaaaggagaaaaaggtgctgtgggaatgacactcatgcttttctgcaggtaaatatgtacaaatacatctttcccataaactccatgtgggtgaggatctgtcctgtctgaacacagggcctaacacataataggagcttcctaaatgtttttcaaatttgaaatttaattcaaataatcaaaaggggactgtgggaaagaacaaatacatgggtaattattcgttatggtaaataatttattatggtaagatcattagtttcttttaatgattttatgtcctttctaaaacaattggaaaattatttgcattattcacatatgtgcctctctcccctattgaaatatgaagtccagaaggctgaagactatatttactttcccagatggcactgagcacagtgctttgcacatagtacatgcaaaattaaatgcactgaagtataaaaatggctgatatcctcttctcattaagcattaaagaggcaaaagtatcatacacatagatcagaattcccctcaacaaagaaaaaatatacccagacaattatgtcaccaaacgtaactttaattgtatcaaataaacacaagttgctggaaaaatcatgaaagggcattgatcaaactatcctccttaaccagcacctgccaatccagaagggtgctccttatagaagctctgatatagaatatacattggaagtttcctaatggctccagctatcagtgtatctgattaacaccgtattgtccagaaagcaattacgtccaagcattattctctacaattttgtagaagaaagagaatattataatgaaacgacatatattaaatacccagtaaagtgcctggccagtaggagacccacaataccagacagccattgttgggtttatgtttcttttttaaagtattattaaaatcacatgtcctttcataaaataatcccaggtgatttctagaatcaaaagccagaagacagattagagaagctactaaaagcaaagagggaagaaaatacagatattacatatggttgttatagcaactgaaagcagcccctgatctctctctcattctttcccacctcttgctatgatcctgttttcaaataaataacctctggtttttcttttaaattgtccatcaagatgaaaggaaaaggtggcccttgtttagtagtaaagagtgcagttgtagaaaaaaaaaattggggaagaaaaaaaggatgaaaagaaaagataacttaaaatcaaggaggcaacattgagaaatccatttacgcaaaacttaggaggacgtttttcaccaaagacttttcacaggagtgactctggaacccatatgcaggggagaggacaaaagtcctggctttcttcatacaagtgaccttctgaaatcctaaaaaccaaaaagaatgagagaacggagctcaaacaataagtctttactttcctgagccaagttatgggttccacatagcctacaacaaaaacacaatgcatcatgttcagattgcatagccatcaaagcttgaaaacagtgggtttgctgcagtagtaaagggtcttggagacctcagagtttcagtgcagaaaaaaaacaaggcttagagagggaaaatgacttgtccaaagtcacaactggtaagtgagaggccgaattaacaataatatccaacacttgcaaagtgcttaggtacagcagatgctgttttaactgcctcacatatatcatttgatcttcataaccacattgattattaagtccaggttaaatatgagaatggaggcacagggaggtgaaacatcatggccaagatcacccagctagtaagcaggagtaccaggtttcaagcacacgctatgtgatctccggtttcacattcgtagctaattcggtctacactgacagcctccctgcactccaccagaactcccctccgtcccctgcttccttttgcaaatttgagaggaccagtcagctccacctaactctatctgggaacaaattcccctcaaatcactctatcttctacagatgtaaggccacagtctagcccctactctagataaaatcttgtccagtgttccattttggaaaggaaatgtttcaccaacagaagaatctggggctctgtggtcgtaaggctccccatgggccctttaactcttggttcccataagggtatcccttaatgtagctaccagcctgctgacacagccatcattcctccagcctggaagccaggcactagagaatgctgagaagtaggaatggcagaggatgaagccaaccttgggtgttatgtaggcactggatgacacaggtgccagagcattccgaggccaactgtactgatcctactgggtcccagtcttttttgacctagaggaacactttaatctaatctcatcctgtcctggatgtcagcatatagtataccattctttctgaccagactctgcatcctccatccccgacaactcaaatttcaactccctgaatttatttttactgccctgccagactagcctacatcccctccatatgtactagaatgtatcaaaagttctgcaatagtgtcagttacaagaatattcatagcaaaaatatctgtcccaaaactgaaaactactcaagtatgcaccattgggagcatgaggccaggtgtggtggctccgcctgtaatctcaacactttgcgaggttgaggcgggcagatcacctgaggtcgagagttcgagaccagtctgaccaacatggagaaacgccatctctactaaaaacacaaaattagctgggcctggtggcacatgcctgtaatcccagctacttgggaggctgaggcaggagaatcgcttgaacccaggaggcagaggttgcagcgagccaagatcatgccattgcactccagcctgggcaacaagagcgaaactccgtctcaaaaaaaaaaaaaaaaaattcaatactgttaattttatacgcttttttaactactcaattccaagttccatgaaggcagaagccatgtgtattctgttcattacaggatctctgacacctattacgttcctgaaatataataagccttctatatgtgttaaatgagttattgagtggaaaaatttccattattatcacaataatcacagccaaaataatttctcttatattttcatttctgcaaatggtatggtgactagcacataataggtggtcaattaatttttttttaaataaaagaatgaatcctctatctcctaaatgatctctccaccccttaaatcctttctgaatttcatgactaaccattcttattttcatgtgactttccttagttcattctttacttaaaatatttactggctccccacctgtacataagagaaagacaatacttggtgactaggatctgaactatctttgcagattcgttgtttattattctttacgaggatctatctgtccaaagagaatgtgttttcttactgcatccttttcatacacagtttttcccctcctatttttccttgcttgctccaaccctcagtaatcctaccttccagtaaactgtgcccagggttgatggtctacaccactcatcaatcttttacccattcttcgtctaagataggcagacagagacatcagttcacatttacattttatttctcatgtagattattcacactttgaggacaaaatatcttctttcaggcttagaaattatttttaagagtaaagattttcaaggcaatttaattgttcataagtgcacttcatgtgtagagtacatcttaaaattttaggagatttctcactgaagccaaataacatattttgaggaaaaaaatgtatgtgccaggcccctgggtaagtgaagcctcagtgcctctacgcggtccatactttccgctgtccctcactgcagactgacccccacgagcaggctggaacaaatgttcgttgcttcaagatatttcatcccagggacaaacatattcctttcctagacttttcactcttttcctcttctctagccacgtaagatggagttttgtgtgagaaattcctctggtgccaaccaaatgagggtaaacaaaatccatctcccctggcaaagtttctccaatctaatttgtgtaattacctatctccctaatgatgtgcttgtttacagattaaagctatgaatctaagcatgaaaataagattaaatctgatgaattaaattcccatttgcttaaatcttctggatattctttctttaaaaagaaattgcaggtagaaaagaggataagtcactagtcttggaaagccagaaacacactttttaaaaactggaaccaagctagtaataggcagagttgtgcacttagttttagccatgttgatataagattggcttatttggaaactctgaagaaaaaaaaagtcaagacaaaatgcaatttctattactatttatctatctaaaagctttctaaatgaaataaagacactgccacctagaccctgtgatctggtcctgcaatcaattggtgactgcagtgagctcctagcaaattctaggggatgccagagagattgggaagagagagagggagagaaagagaaaaggaaagacagaggggaaaaaacagacagcagattctcaaaggtatagtcaggccctgacacatatacacaatcagtagagattggtgaagcccaaatacatgacgcagtttcatcaccaaatggctgctatgatgctctccatatgccaaaccatatcatctagtcttttggcaagctcttcactgaactatttatagtgattgcagtcctttccgaaaaacctggaatgaccaacacatgatattaataacccagacatggctaataactggatcatattcagcagctccatgcacctggccaaacactaagtgcttcacgtatgtcctcaccacactcctatggggttgctagcatcagtcccgttttgcctttggtgaaattgagatgtagagtgtttaagtaatttctttgaagtcacctggctagcaaaaagtggagaaaactcaaacccaggttcatgggcctccagtgattatctaaagcatgatattccactccttcatcagggcaaagctaacactgcaacagcattcaaattaaatccagtaataaaataatctccatcttgacctcacagccagtcatgtttttctgttatctaccattcaaaaagaaaatacatgtatatttatgtttatgtgaacacacattaaatatctcaagtttcagccaccaaactttccttgcagaatctatgaagttgagtttaccacaacatcacaataattcttacatactgattccagcaatacagggcttcaaagacttctagaagtatgctatgttaaaagttgttaaaattcaaacttctaatttcatgacatgtgcagttttattgtcagcaataattccacaatatcatttttgtggtttgcttctttgtggctgacttgtaaatgttgagttttcaaacaaatgaacaaacatttgttcttattggcccatgttgtcacagactgagctaaaattccacgtttactgtgaatgcctataatgttttttaagtgaaatgcattctacaacctgcctttagtagaaaattcttacattatgaaggccagctgtcttaccaaccattgtgataaaatagctaatattatgtatatatattcttgtatatacctatacatagtcccataagaaattgctttcaagacatctatagctctattgtctcaagacatcattcgatatcccaacatataacacacatggtaattctggctgagcattggacaaaatgctttacatgcatgatctcttgtaatactcaagttaaccctgttagtggtcacaatattagtttcattttatgaatgatgaaatgatcttggaaaaattaaatgaccagtccaatatttcccgactggtaaacggcagaaccaggaattcaaacccagtcttcaactaccacattacactgacagtgttttgaaccctttatgaaaagcaagggcatccacactctgaagtccttcacagcatatttagttcagtctctacagtcctcagatttctcatctgtaaaatgaggacactggagaagatgacctcagagatctttcttcttcgtaagcgacccatgttaactacactcagttaccaaaatcagactggtggaaaagcaaggaatgaaaggtgtctggcaaaaacccatgtgcactcaagtagagttcataagattctggactaagcaaccccctgggctaagttttatcttggctacttttgtagagaggaactcaatggaggggaggggcacacacacattatttaatactgaaacaaattaaaattattattgtctcctccatctaataacataaacttcagcatttccttccagagcctattgttaacattgttcatattctccaagctgaggaagtatgcagtgagcccagtggggattattggactatttttcaaaaaggtagtagttatgtaacacagacttgctctggggcagtgctcagatcactggctcaaaattgttcctggctcattatcatgtaataaaaagaagttattattactgttcctagtctgtgtgtatgcagaagtcccacgcagagtgcagtggtaacgggcatggggcagaggaatcccttgggtttccagttaaggccctaattgggtctattttaaaggctgcctgtaacaaggaggagtttgtgcctttgatcatgactccctagatgcctggcttcctgttgcactcaggagcttcccccagcacagtcccagcagtatgtcctgcacacagggaactatgctgaggcagcagagtgattttctgtctgtggcaccatcccttcacttcactgaatattgcacaatcaaaaacaccagcattcaccttcttgtaaaatagtctaattccttctcctagacttgcagtgctatgggaaagcagttcttggcaatttaaaacacacctgaatctccttcattctaaggagtgggaagataaagtggaggaggaaaagagattggggcaccttgaattatcctccccaagcaatttaatcactttaatctcccatggctttcctattcaattctagggaaatggaccctggcttggccctcttatttgctacttcccaggggccattctccatttacttgtggtttccaagtgcagcctttggcagaggtttgcgaggaggaaatgatattaaaatgtgtgcccaggagatgcagattctagcagagttcctactagtgactgatttttacaaacgccagcttgtggtggggagcttggattttgtggcacagagaacccgcgctgcaagaagcagctaaaaccacaagtgttcttcttccctaagtgttcaactacactccaaaatgttttaaatcctcttcgttaaatgacacttctcaagtactagtgtgagaaaggcactgtgttaggcatagtgatgaagaaagtaaatgtcctctattccttaaagctacttagtattcactttgagtatttattaaacatcacactcagaagatttatccacagtctaaatttatatattttatttgtgcactggtctatattaaaatgtcttagtatggctcaaatgcatactttctattcctagaaatccctctcaatcattagtacttcagtctaatgtccagtttcacctgcggttcttctcccagctcttcttcaatgccatcatcactagatcataggtagggtgacactgacagggttatggaacagataaggccttggttattgtccagtctggcattctcattttgaaatgaaggaaataagccagagaactaaaattactatcattaaatacacaggaaatttgtgatggaactggggccaagaccaacgtgtcctgactcctagcacaggcctccctgtatgtagtttctaaaattgctaaggtcacatatgttatacctccagaagcaaaggatgaagtagtatataacagacaaaggatatcacatcactcttgatcatacacattttgtgacagactgtgtgcactggccctgccctctatagtgttatcttgagaaagtaggtgtaaaaatcacaagtaccatcggtatccatggtcaggcactcacacaatgccctgaaaatgagttcaatggatgaattactcctacaagtagctttgcaactggtctcccttttttctatgtttcacccatacaatttatttttgctatatatgcttttcttccaaactaaaatgctgattatgtcactcctttatacattcacaataaagtccaatctcttattttgttttgttgtttttgtttttgagtcagggtctggctctatcgcacaggctggactgcagtggcacgatgttggcttgctgcaacttacacctccagggctcaagccatcctcccacctcagcctcccaagtagctgggactacagacgcacacctccacacccagctaattcttcttttcttttctttttctttttgagatggaatctccctctgtcacccaggctggagtgtagtggctagatctctgctcactgcaacctctgcctcctgggttcaagcgattctcctgcctcagcctcctgagtagctgggattacaggcacgcgccaccacaccaggctattttttctgtatttttagtagagatggggtttcagcatgttgatcaggctagtcttgacctcctgacctcgtgatctgcccgccttggcctcccaaagtgctgggattatgggtgtgagccaccacgcccggcctaattttcctattttttttgtagagatgaggtttcaccatattacccaggctgctggtctcaagcaatccactcacctcagcctcctaatgtgctgggattacaggtatgagccactgcgcccagccccaaactctttcaatctagtttgcaaggcccttttttgtaagatgccagtttttctctccagcctcatctcccatcccatcttccgctctgtattctcccttcctttcatgggctgttcccttttgtgctctgaggggccacacatgcttatccttccccttagagcttgcttgtctcatgttttcatctggaaaatcctatttatcttttatatttgccagaaacatcatatgtgatatcttcttcaaaacctttgctgataccctcaccttactccactcccatttggctagattctcctcctttgcacataccaaattatatttcaactatttaattctccccttagactttgaactacttgagaggaggactatttctgtgttcttagccctaccagaaagttaagcacatgatagggttaataatactaaaacaaagatgaagaattagtaaacaaaactcaaaactgttgggcacatgcatccatatttttaactattaccctttccttcctcctgtaactctttgctgaccacagatgatgtgcctgatatcaaaatggtcagccacagagctaggcacacaactctcacatctcatcatatacaaggcatatccctgtggaacaccacctgggtttaaagaaagagcatgactctgcagctagctggcctctgccaaacaaacaagagcccatggccttgccatattgggcactccgtagtgagcagctgaaccccagctgaagagccaggttcagcactgtctcatagggaacagctccacctgctgaactccttgacattcctctcccccttcggcacagctttgctagaacctatcaatataagagtggtcacaattttgagaaatgacagcatcacgatagagacagagagacattttgcattccgtcacttgcctgcattttttacaggattataagggtatatgtgtgacaaatatccacatcacgctgttaaaaaggggaaaaaaaagaatagttacgtcaatataccaaggctttctacagtgtctcttttaaagaattaagccatcaggatgcatggtgctatttaatctatctccctcttcaacaaggtggcaataatctctatcttccagtggatgcagggggaggtgtaaaagcatttatatttctctgcttatgtccatcagcaaacaacgtgataaacaccaatgtgggtggtagtgggagatgagatggggcaagcaatgaataaagcagagtgtttggtaggaaagtcttgggcaaacatatttggcatttcctgatggtacaagtttgttaaactaccaggaattctagaaaaagcgaatgtgactgaattaaatgaccaaaagaagaaaatgaggagcctggagaaaggccagaagaccagcaacttctgggaaggaaacatttcgtcagtcatcccagactggcagattacaaaaatggttttgtctaaaagatgcaaaaaccatttattatcctggttttctttcttgatggtggtccaaatactgcattttaagaaagtctgtcctactctaaatcactgtgcaggaaaatttacccacgtgcaccaagtgttttaagaaagaaataaaatagaattataaactcatgattttgaaaacaattgagcataaataaaatttaagcaggtctaaaaataataaagtccattaaaaatacaaacaagttggctacagggaagttttaataataaatcaaggtcagacaattcaaattttgttccaattgaattcaggcaacttaaatgttagggtgaaatacagcaagttagcaagtgcacacacacaatctaactaaaacagtttctgatttgggagaaaagaggacaacttttaaatagagagaagcattttccaggtgagagaagaaattattataaaaagaaaggagcccaaattatttgcaaaatgactatcattttagctctatttttaagtcagtgccttatttcactattactgaactttacacaatttcatcattttgtcatgtacacataaattttttgtttaatcataccactggggcaagcatcctggttttcacagggaagtagctccacagttttattgcatccttatataacagaatttgcctcaaaatttgaagacaaagcagagacactgaatgagattatccagtttcaggtataagtatagcttatgatatagatgtagaagcagaagcagatacatgtgtgtctgtataaatgtccatcacatacacccacacacacaaatacaactcaccaatgtccatgataaggagaatcctaagcgtttgtctctttagatacagatttctgtaaatgcattttttacggtatttaaaccatgacaaccagcactccacctattgcctaaaaatgttcatctgatttcaaaaaatgtttcctctaaatgttttcaattaactcctaacgaatgagttagctttgggggttttgaaaagtctacttcccgaaaagaatcctggatcataacgtctcaaagactacagaacgtgagtggatgccccatgctcttagcttatggaggatcgaggctatgactggttttcatcatgaataaatccccagcacctggtgtatgtcaggtatacaccaggtatccaattaacaatcactaaatacaggaaaaacttgaggctacttgaagatgatatgtcatagcgtcctaaacgcagtagaatatagtggttaagagctgagcttttcagaccccaactgcatggggtctaaactgtctggtgtttttagaccccaacttcacaactcccaattctaccatctgctttctatgtgaccttgggtgagttacttaacctctcaccctaggttaagtagcttaactagactttaatttagagaataatgattgtgactacttcctattgtactgggaatagtacaattccttgtactcatgtctagcgaataataacagtacctacttcctattgttgcagatatgtgtttcccctcaaatagtgcctggcacatagtaaaaacccagtaagtattagttattattatattaactatcacccaacccctaagtccttacctacatttaattgaaattctatcataccccaacttaattgataaccccagcaactctcaatttaccccttcaggtaaatgtgcctgaaagaaaacgtaagtttaacctacaattctttttcttattggcacagtgctcttaggtcagtccattatcacaaatgcaattttatccttctcataatgcaatatgtcctcgtcatttttcaaacgttcttgccctgctgagactttgcaacatgggcgctggttctcagttcagctccttaaatgaagagcaggaagctattttctccctcaggcctttggcagtgctagccctgactagacagccatcagcccatcctatccactggagcagcatgctttatcaaagtgcacccctaccctccctgccacaagggagctgttgcctccaatgcatctgatttgatctgaatctacgcttctttctctctctctctgtctctctgtctctctttctctctcccctctctcttcctgtgtctcatttttggccacttttgtagaacaatttggatgagacaactcagacagattatacttcaagaatcaggatagtgaaaactatccaggcagactttctttatggtatatcaatgctgaccatttatcttctataccaagagaggtaaataaaaagattctatattgctttagtgtcctgaaaaatatgcttattgcaaaccacctatgtgccaaatactggcatataaaaataaatgaaatgaagccttgcccttgagaaactcactattaattggagcacacactagatgatgcttagtgcttggagggagacatacagagagtgacccggcacataagatcagatattttcttcatgatattcaggcttcccttcttcttgaaagtgttggagaaatcgtcagacaggaggtgatatccaaatgaggacttaaataatggaaaggatttaagtggacacagacatggcagattgagtttttaaacagaggcagtaaagttttaggcagcttgagcaaaggggcagggacggaaaataaatgatccactttgtgactggaagtctacaatggttaggagtgtgtatgcctttgagccaggaaaaccaagggtccaaaaaacactctcaagttggcatgcagatgacaaccacaggacctttactgtgcctcactgcttacattctctccaatctcctaaatcaggccttggcaaacgttcctgtaaagggtcacagagtaaatattttaggtttgtgagctatacggtctctgtcacaactattcaactttgttgttgtagcaggaaagcagccatagacaatatgtcaatgaatgagtgtggccatgttccagtaagattttatatcaaataattttcacatgtcatgaaataccattctttagattttccagtcacttaaaaaggtagtaaccatctttggcttgtgggccataaaaaacaggtggtaggacagatatagcccatgggctaaaatttggccacccctgtgtaaattacctcaaatcctacctgcaacaaaagataaattatgtctttccctctaatggggaatgcaaaggtttctttaaagatattttcaatacctggatttaagttgagtaagaggtactagggtacttataaagttggtgagcttttaaggcaaatataattttcccttctccctgccctaagattttaatctaaccaaatgaacatcaaggagactttcatagagggcattaaaccaaggcttaggtgattggaagggagctaattcctactctctggggatagtcatttatttgtctcagggcatatttgggatctgctgaaaagctctttcttacctaatttttgtcttaaaataatgaaattcctaaactgattctctactacctagcaaaaaatgctaggcaaaaatttctaaagtcacaacaccctaaaaccagatcgggaccttgtaacatcatctcaaacagcagtctgctgagacttacgtgcaaggaaagaagggaactgaaagaccacgaaggtatctcttcaactactcactggctggtaagccagccctgagagcacagctccctctgtctctgactatacatacatttccgccccagtttcatcctttctgttctttttttcttttatttagaaggtagacaagaagaacggaaagggccaaccaattaaaagctaactttgctttctgggacatttccatgtatttagcgtacatacactgtctccagttggcaaggcataactaagtttggataacactggagtggaatattctattgcattttcttactgctgtaaaaaaaaatcgcgctttaatcatacgtggtaaccatccgattcatcccaatatacttgtatctaatactgatttgagaagcatgtccaagaaaataccaaaaacaaccactgttaaggctctaaaagcagaaacatacagaataaccaataaaaaaatcccatcaccattgtgctaatcagatttaactgtgaagagagaagatagtgatgctttaaaatggttttgtgtacgtgcacgtgcatgcgcattcttgattgtgtgtgttggttgggtgaagatttaggggagcaatttatctctgagaaaatcagattcctttgtccagtttgaggacaagaacacaacattctaagatgtggaatctaatctgatattttaaaacactgttagccttggttccaaatatcttagacattgagacaatgaagaaagtgttcaaccagtcacagcttggtgattgtgctaacaacctaagatcaacccaagacccaagatatgaagaattaaaaacaggcactaatgaccttttctcctaccccgccctattctgtctgcaaaatttttaatcttgtataaagacccagcttaaatgtcacttccctttaaaaccttacctcccactcaggcaaaattaggtgtcccccagtcatctttgctcccatagcactttgcacaaaactctattatggctattatgcacttatcacagtaaattgcaatttattgtttatgggtctatttccaccagaatatgcacccttaagggtaaagatcagatcttattcatctttgtattcccagcgctcagcacagtgctgacacaacagccacttcaaacatgttttagtatttttattattaaagaaacgcatgcccatgctaaaaattcagaacagcataactggtataaaaggaaaggttaaaagttgtctttccaccattcagaacatcagtccgacttccaaaacaaaatcactcttaagagattcttaataatgcataaatactacatgaaccccttccactccacacccatctgatgaacatatggcttcaaagccatcacacatgcaagagtggctacctgtgctaaccatctgacatggttgggtgcaaaatcactcaaagcaaaaggcaagtgaagcactgtgcttttggaagggcaccgtcttcttaggaccagttcttctatgcccttgatttgattataagttcttctcactcactgatatggtttggctgtgtctccatccaaatctcatcttcaattgtagttcacataatccccacgtgccatgggagggaactggtgggagaaaactgaaccatgggagcagttacctccatgctgttcttgtgatagtgagttctcacgagaactgatggttttacaaggggcttttccccgtcttcactctacacttctctcccctgctgccatgtgaagaaggaggtgtttgcattcccttcagccatgattgtaagtttcgtgaggcctccccagccatgctgaactgtgagtcaattaaacctctttcctttataaattgcccagtcccgggtatatctttattagcagcatgagaatgaaccaacacagtaaattagtactgagtagtggggcactgctgtaaagatacccaaaaatgtggaaacaactttggaactgggtagcaggcagaggctggaacagtttggagggctcagaagaagacaggaggatgttagaaagtctggaacttctagagaattggaaggctcagaagaagacaggaaaatctggggaagtttggagcttcctagagaattggagggctcagagacaggatggtgtgggaaaatttggaacttcctataaactagttgaatggctttaaccaaaatgctgatagtgacatggacaatgaagcccagtctgaggtgatctcagatagagatgacaaacttgttgcaaactggagtaaaggtcactctttgtattagtctgttttcatgctgctgataaagacatacctgagactgggaagaaaaagaggtttaattggacttacagttccacatggctggggagatctcagaatgatggtgggaggtaaaaggcatttttggtggcagcgagagaaaatgaggaagaagcaaaagtggatacccctgataaacccatcagatcccatgagacttattaactatgacgagaatagcacaggaaagaccaacccccatgattccattacctcaccctaggtccctcccacaacaagtgggaattctgggagatacaattctagtggagatttgggtggagacacagccaaaccatatcattcttgctatgcaaagagactggtggcattttgcccctgccctagacatctgtgaaactttgaacttgagttaaatgatttagggtatctggtggaagaaatttctaagtggcaaagcattcaagagggagcagagaaattctggggggagaaattcaagcttgctggagaaagtggcataagtaacaaggagccaaatgttaatcacaaagacaatgggaaaaatgtctccagggcatgtcagagaccttcacagcaggcccttccatcacagacccagaggcctaggagggaaaaatgctttagtggaccaggcccagaacccactgctctgtgcagcctcaggatatggtgccctgcatcccagctgcttcagctccagctgtggctaaaagaggccaatgtacagctcaggccattgcttcagagagtgcaaaccctaagccttggcagctttcacatggtgttagccctgtgggtgtgcagaagacaagaactgaggtttgtgaacctctgcctagatttcagaggatgtacagaaatgcctggatgtccaggcagaagtttgctgcaggggtggagccctcatggagaacctctgctaggacagaggagaagggaaatgtgggtttggggtccccatgcaaagtccccatggggcactgtctagtggagctatgagaagagaaccactatcctccataccccagaatggtagatccaccgacaacttgttccatgcatttggaaaagctacagacactcaatgccagcccatgtaagcagcctggatggggaccccacacatgggacctagcgggaggtaactgaatcatgggagtggctacctccatgctgttctcataatagtgagtgagctctcatgggatctgatggttttataaggggctttccccccacttcactctgcacctctctcttctgctgtcacatgaagaaggatctgtttgcttccccttctgccatgattgtaagtttctggaggcctcactggcgacaccgaactgtgagtcaattaaacctctttcctttaaaaatcacccagtcatgggtatgtctttattagcagcatgagaatggactaatacactcactgacacttttgccttttattttcatctcttcctctctttttatgattctcctgctttgtttatatgcctccatcacagctctgtctttgtctcccaatatgactttctttgcctgtggtctctccgtgtctctttgtctctcatctttcctttttcttcctcttctcaatctgcctctgctctctggctttccttctgtctctctctgcctttgtcatgaacttatgttctttctcttcccttctccctccttccctctccctccttcattttctccctctcccttttcttctctctcttattcattttctgtcttccatatatctgttatttatgtctctctgtctccttctctctgttttttttttccatctctccttgttctggagctctctttccaatcagtgctcacaatcagtaaacatccttactgtggccttacgatactaatatttcgtttttaagagtggagacttaaatgttgtacattggtgcttatgttgctgtgaatgtatacagacatataagagcgcacatatttattatgtatatatttatatgtacttatatgatatgcagatggagaccaaaataaagacagagattgagatttaaactgaaacatatattgtttaactgggtgaatggaggtcactggaatttctgggatatatagtcaggttggtgaaactaccatggatcattctctctggaatcaacaaaggcgatgataaacaaaaggcctggtagcacatgctgctgcatactcaggaaacagacagagtgatcttgctcttttgcaaaaagcctggacagcagactgtctcccaacaatagtgattaaaagggaaacaggcaacttgaatgtgagctcttgtacagttgttgcctggaattcagttttaatgaggccaagttcacaaactcgtttgctctctctttcatttattttcattttaaaataacttttaaaaataactcaagcaatacacatttattaagaaatgacaaaaagaatgaacacaagaaaccttgcatagaatcctaacattcatcattatcactggcaaacattttgagtcatatcctttcctgctttttttcccacaaaagtttaattttacagtatataataattgaaaaaaactgtttcaaacccttactatttccagtatatttcttttcttttctttttttttttttttttttttgagatggagtcttgctctgtcacctaggctggagtgcagtggcaccatcttggctcactgcaacctccacctcccaggttcaagcaattctcctgcctcagcctcccaagtagctgggactacagacacccacttggctaatttttgtattttaatagagatggggtttctccatgttggccaggctggcttcaaactcctgacctcaagtgatctgcccgcctcagcctcccaaagtgttgggattacaggcgtgagccaccacgcctggcctccaggtatatttctagggacttgggatatatgagagaacaacatagacaaaaactctgacttaatgggtttatgtttgtactattttgtaatcttttattctggtattttgtggacagtttcccacttaaaaatatatgtttttataatcaaccttttaatgacttcattattctacaacacacaggtacaaagttataggttgttcacaacacatgaaaaaaaaacactttcccaaggaaatagcaaataaaattggaaatatttagtaagcaaatattaagtggaaacagctagagttgctgacagggatgctaagaagattaggacagtgccccaatcttcaatttaagaaaatagaactggaccgagagaacctaaatgcagaaacagaaacaacatcatgaatgtcatattacaaacatcttttaataggccatactggagcactattaatatcaatgaaactgtaataacagctaacccttattgatgatttagtatatgccagatgttccgttaagaagttatattatctctgttaatttctgttaagaagttatactatctctgttaatcatcaagccaccatataagaaatataccattagtaccctcattttacagatgagggaactaaagacagagataaagttaattgcacaagttcacatatctagtggatagtagagtcggcaattaacccaataaattatattttaaatcatgtgtactttctgccatttaagacatattgtggttatgtggacagccatggaagataattttttagtatacattgaatgacagaaatttcacctgggctacactgtactgtcctgtgtgatttatagagccttacattccaataggtcttcactgtagggggtcatggtttctattgagaagctgataaacactgtggactgcatctcttcatgggaaaaattaaagcatattaacacaaaattatgcagacaatggaagaagtccatggactcttaaactcatgtgcaaatcttaaggaaatgattttcaaacttgagtgttcccaagaatctcctagggagtttgtaaaatatagatgcctggtcccttctccccatcaggtcattcaaaagcaggacccatgaggacagtactttgagaaacactgccccaggcacctatgagtgagcccatgcctgcccagttaagaattcttctaccatttcagcaaaatgcaagtcagggcgagcagggctgcacatgataaatttctaaaccagggtgctgaatgtgcccaaaatagcctttttccctttaatgattataatcaagaatgtacagtgggaattgctgagataaggggaagatctttcgcttttaatctgccccaccgacccatccaccacccggccccaaaccaccaaaggccctgcagcagaaggattgatggcccatgattttgtgtctcaacagctcctgttactctggttagggaaagatgactagaggcgtcaatctattggttccagggcacaacatgattagttggttgtctgataacatgattcttattagcactttctttaaaaagtgtacacgttgtgcacactgtcactgtagggtcattagtcagcagggagaaaccaaacagcacatcccacacatcttcccaggataacaagatgacacacattaataacccccagaagccacttgtggggatggacacaggtgagggcttcaacccaaacagcatcatggagcgggttattgccaagtaaagtgtcagtgacctgacaatggggtgaagtgaaaggaagaccccccaagatatgtcattcatataaagagctcccctaccaccccatctgcactgaattgtggagttctttccaaagaaactcagaaataaacccattcaaaaataaacttatacaaaaataaacccatacaaagcatgatttatagcacaaagagctttggttccagaaagggcaaaaatcaaatcccagctctgccacctgctagctgggtaaccttgagcaagttgtttaagcttgacttctacagctttagaatgaggataacagtacgtagttcataaaggtgtcgtgataatcaagtgaaatcatgtggtgatgttccagatcatatttccagagaagctgttcactaaattggtggttatttatattatttttgttaaaggagacttctgatataatcaatatgtcttatgtagatagagttgtccctgatattcagcaaactttcctttgctctcttcttccactctcaccccaacagttagaagtagaaaaagctacatctggtaactcagttataatccttgagcaagtaaaacccattagcatcaacaggcagtccttcagtttgactactgctgctccaaaatgttgattgacactctaggtttcctatatgggaagacgtagtgagaccacctttaatattatttttaactagcttttatctgcataagaaaatcaaagagaggaagagatggctatacctcccttctaccccaagccgctattgcaataaacccagtcatgagtagtctcatctctgaagtctattagcagtggaatacatatggcagacaggttattactgggaacctcacttccagaaggtcccatcatcactctttaaggtaatttcagtggtttaaacaatgccaagagcatgacttttcatgaggctccttgttttgaagcccaagacaaacaacttgaaaagctgaacctggaactcaggagctctacagccaatattcactcttcttcccacaatggaaaaccttaaggatacaggtgcatgggcttcagacaaactacaaggctagggtgcagctgtgttctaactcttgcctgtgatgggcttcagacaaactacaaggctagggagcagctgtgttctaactcttgcctgtgatgggcttcagacaaaccacaaggctagggtgcagctgtgttctaactcttgcctgtggcaagccagcagtgggtcaaaccaagaatcactcctacagtgtgaccaaatgttatttgaccttcttcttccactaactgacctacttaataggaacatcttgttttttttatctgagagtgtagatgatatttgtctttcctatcttatagaatcgtggtgagaaaaaataccttaagtaatggaagtaatgtgtcgatctttgaaaactgaagcattttgcaaagagaaaaaagggctataactgatctaaagtggtataaaaacattcaggagtgctatagaaatagacacaatatctttcatatgtgtgtaaaatctcacataggatttccgacagagcatccacgtcctttttttactcctatctacattctaggataagctctgttctttcattctaaacgttgcactctaagattccacctttgcttcttgccaactgtttgcttactccatccgtacaatcggagcagagtttgagctccttgacaggaaccactgcacttttatggagcctggcctcacctcgcaatgaacacatctcttctctgccatcccctttggccactgcagagatgctgtttggccagtttcccctccaggagacacaagtgccttctctacaccttttagccacaaaataagggacagtaattaagacatacacaaaaacaggacaaatattttacatacatttagtggctgaatataagctggcaaggagaaaaattaatttatcctcaaggcagcctgaacagtgatctctctcaccaataacttaaacaaaagaaagtccttttgtgaaaactctgtgtggaaagtatcaaggtaaaaatgaaacaatgatgactccagctaagatttaatgtgcaaataaggtcagtcatgtctctcaatgaccataaaggtttttattttcctactgggcttggaatgtacccaaatttactacaagattgatgtgtatattttttgcttaactcatatttttcaatcattcctaaggttaaaactttcgttaaacatagtttttaaatcaagtaatttaaattcctggatataaagaggaatgtttacatctcttcccttgacctttggttatgacatccattcagctaaaaatatccttgtaataatctccaactgttacttacaatcttctctacatttcaaggtttctctgaagtacctactctacaatccagcttgaaggccatcccagccagaagatgcccaactctcccctgacttcctacagcatgttctgtcctcagagaacgtacatctcctgctgtctcttaagaagtttctttgggtacaagaccgagagctcattgagggcaggaattatttcttttcatcttgtgtagcacttcacaaatatccctatgccagtgaatgacaaatattaggagctcaataaatatttgttgaattaaaactaaacacaataatttgcgtaaggctcttggcataattttggcacatagcaattactcctaaatgggagcaattattattttcatatataaatgagattcatgtatctgcttttttgccctatcctatgaacttctaaggtctctctttaaaaaaatgtggatgtagttctgacagtcaacattcatgtcaatgttctctagaaaatctcattaaataactaagagatttttactttccaatttcacatgaggcatttttttgggggggaaggggggtccaaagttagcaagttccttaacatgaagatgtaatacaataaacccaataaactatgttttgctgcaaacccatgtgcacagattgaaatgaaggcctgctgggatctcacattacttgatttcccctaaacagatatgcatatgaactgaggaaaaaggaagaaccttgtgaaataaaaggtttgttcccttacaggtcaagggtataggtcattatgtcatttctacatccccaacactcctagtgcactttacttagtaaatgcagcaggtatccagtatctgtatgaacaaagtattaaattagttttgacctgtaatggattttagtccattagtgccattttacagaggatgaaattgaggctacaacatttcaacatgctatgactacgtatctaatttttgtatacagccagtattataacccacaattcttaattcccagtagagaaatctttcttcccatgagtaagtagcatttattgagcatttactaggaataaagcactttgtatccacgatgtcgcctcctgaggaaaaaacctccgaaagatatactatccccatattttagatggggagactcaggctcaaagaatttaagtgacttactcaaggcaacgtgctgatttagcaggacaactaagattcaaactcaaatctgtttgatttcaaacccattgccttccaaatcacaccacattagcattcatatagcattaagtactgagagaaggaattacgtggacttgctagagaaagctaaaatctttcatcattttactttttaaaaggtcagctcctccccaccgaaaaaaaaaaactgtatcaaaatgtatagccaagtcaagcattcacagccagtgtgtctataatatcagatttgccattaaattagaaaaggaatctattcctgaggaacaactgagctgaaagctgaatgatcgcaggttacctcttgctcactgaatcaccaggtgcagattccatgtctcactgaagatgaagaggtgggtggatgagagaacaaccaaagcactacttaaggtaaagggtgcaatgtgacaggcacatgttaatgtcctcgcttttctacaaggagatggagcttccagctaagagtacgtcctcctccaccatcatcagaaatcaactcaagataggattatctaaaatataaactccaaaaggtctgagtttttccgtcctactttaaagtccattgaacaagcccttctgtgcagtctgggaataggatcactttgggtgacagtctctgttctgccactgacctcctgtgtctatttggcaattcatttagcctcttggaacctcagtttcctcctgtatgtaatgacaataataacacctacacatgacatttctgtgaaaaattaagtgagatgatgaatgtaaagcatctaccccaaaagttggcccagattgggactcaatttattcactaatgttggatggtaaatgtcaaatcccagaacaactagaagcaaagaggtacacagaaatcaagcagtccatcatgtgctatgagaaatgtaacattaaagatgtcatcatggaaaaatagaagtcaagtaaaaccctctgttaacaaatcttgtaatacaattgccagtgagaaaggggcagagtggtgaattgaaatactaaacttaactccggcataaaaatatgaaaaagagatattaacacccgtcacctacttactacctacaaaggattttataaagattaatgctacagcactttaaaatcccttggaaataaggaataaacacatacaccattatgcatacatataaaggcaaatatatattttaacactctaaggattactatataaatttagatcagggcacagcatgcctgggatgagtagggtgggaacaatatgttcttgcttacgacaccaagctcatgacaaatgattcatacccagcacctttcatgccagaagatccccccaggtgttccaccaactctagcaacagtttccatcaatcgagactgcagtacagaggaatcacatcacacccacagacgaggcaaaacagacatgtctttatacaactgctcaagtccaacagctgagggggcaggaaagtgaagggaaggaggtgagtgaaccatccagaattcctcaccagattgacaagcagcctataattaccatgcatttgcaccttgaatgcaggtgttgtcataatcagagactcttcatagcaaaggctttttgctaaaggtgagaagggttcacaggatgtgcactgcctgtggtcctgaatgggtctgggggcagatttataggggaggacatctaaatgtgaaaagataagagtcccccatgcccctccaccactccaatctggccctcgggtttaaattagtggatttcccaccctggggtaaagtgaagtgctgttgagagttccaaacaagtgtatgaggctgtaaagtcacactgccctcttatgtatagcctggctcctaattctctgtagttaatctgaccggcatagcccccactttagagatgaaaaaatccacattcagcggacactcaacttgcctcggtcaaaccacaaataagcagaactagaattcaggtctccactctgctttgcattctacaaaacggccaaaaaaaaaaagtttatttatgctttctttccctttaaaaaatattttaaactttctctgagtctggtccagatacgtaggactggctttgttttggaggacatagataaagactatttctctttctccactatctgtatgtatatacttaaaaaagaaaaagaagaaacacctttgtgtgtgatgaccagagcagagactgggtcagcagaggtctttatggaataagagacttcagggggcagaaatctcacctcattagttaacatgatttgagtgatcaaaactttaacactcatcacctcatttcctacgttatctcagacctgcctgcatgttcaatgccctgaacctaataagccctactagaattataagcaccatttattattattttttaatgctggcagtgcttggcaccatttcctaaacggaggttaaaaatttgccaaagatgtattctacttttctctttctttccaagatctttcaagagatgagctaaaagaagaggtctaatgggtgagtgatattttacagcttgaattacattaaaagccagaaacattctgagtccaaagtcttttacttcttaatacaacaagagctaacatgtttgatgtgtttcaaatctccccttaaagccagaagctttgagttaatcacttaaagcagtgtgaaagttattcaatcagtttaagaagattcgagttcaaattagaggattaattttagtggctatgatatgaaagatataatggttaaggtaaggaatgagggcaagggtctccagaacttgaatggaaagaatttcagcttcatttatttgatcaaaccactcctgagaaccatataaaatcacagactctgtcatgaaggaggaattgtagggaaaaccctgctactactctcaggacagatacatcaatgctaaatattatctatcatgatgtgccttaatacaatttatatctgtgtacccaaggaattcatgatgacagattagtattttaaaatgttcacaactctcattaaaaagctgacaatgagcacaactcactaaagtggcacttctctgggaaggtttctgggaattacatcacaacagaaaacgttttgaaaggttccagactgcgtaaattgtgcatattacaaacactacaatctcaattacctggttgaagctgtaaaacttgaaatttttttcccccattttacccatccttggttgttatgttcttgtctatgtctggagaagtttccacactttaaaatcacttttagttattacaatcaaagctggttctctactatttcaactcactgaagtttctaggttcaatttaaacaggaatagctccctcagattgcagacatgcaagcttttctgaaaatctaaaacctttcctgataggaccaaagctcatggacttgcatcctaagtcccctggaatccagcctcctggaattgagcaatccctttcctgccttcataaagggaatgttaagtctttatttgtgctcttcattagaggaggtcaggcaatgggggagaacagggagttgttgtcactgggatatatctgatcttcctgggactgaccatgccagagaacaaccgctcattcacgggctggaaagccccagttctcaaaacaccctcgcttagcgctgttagaagatgctggagagttcctgccctgaaacttgcatccacttggtccctaaagcagaggatacactaaagaacaccttatatactctccactgcagttctcccttgtggagaagaaggggttaggagctccgcatgaaattaaaataaaataaaataaaacgcctacatatatgggtcttcttaatcttctttgagccagtacataggtctggcaagtaaagggaaagtcacttgaggggatgtcagcttgcctggaaatttaaccctttcatctctgtattaggagaactttaacccctctgtttacctggtcttcagttccacacaccaatgcgaccaaggcaacaggaaatagggatttgactcctcagtttgaagctgtggcatttggagaggactctgatggtgttggtgggagagatggggaggttggtctcctagtaggtgatgttaactcttgggggaagtgggcagagaccagtttgcagcatctcccatgtccagaaaccctatttccccccaattctccatcagatcacacagccgactttaaccctttccatctttccacccctttaccctcagtcccattctactcacgctgctgttgtggccagaccagtggaccatggcttggttgtgtgctgagtctcccgtcagcgcaaacgtggtgctggtcagtctcagctcctccatccggaagcgggtggctttgtccgggtcccgctcccgagtcccaggctcctgctgccctccatctcttagcactccccgggggctccgactcgcgccctctccccgttctgccttctcctgatccgctccgctccgtctcctccggccggagcgtgcagcaaccgccatggatgccccagtgccccgagcccgctccagggatagcgctcggtccccgggggccactgagaacaggggacgcactacgaggggcaggggcgtggcaggagccctgcctggccgcccctggtgggaaaagcccctaggggtcgaggccgagcgtggagcggagctggggtgcggcgaggggcagcaggagccgccgccgcagacgcccggggcgcagaggatcaagagccccgcgccggcgaggagcgcgctcagccgggcttgggagccgccgccggcgccaacttttcccatcgcgggagcgaagagcagcggagagaggggtcccagaacgaaggtggcggcacgagctctgcgctggcggctgtggggggccggcgctcaggaccccaactccatccaagttgcgccgcggtgggggcgggcggaggcggcgccgggcaggtggcggccgcttgcccgggctgggcttgtgc

SEQ ID NO: 1144 - DNA, 591046 bp, Homo sapiens; identical to SEQ ID NO: 1142

SEQ ID NO: 1145 - DNA, 586046 bp, Homo sapiens; identical to SEQ ID NO: 1143

SEQ ID NO: 1146 - DNA, 591046 bp, Homo sapiens; identical to SEQ ID NO: 1142

SEQ ID NO: 1147 - DNA, 591046 bp, Homo sapiens; identical to SEQ ID NO: 1142

SEQ ID NO: 1148 - DNA, 31430 bp, Homo sapiens
cgccccacccgcgagccgcagccgcggccccacagcttctggggctggggccccggcagccgggcaggccggcctgacctcgacctccgccgtgcgggcccgaccggtgagtccagcccggcagtcgcaggacccggccgccagcctctccctccacctctccctgcccccagcgccaggcgcgggctgcgctcggtggcggcggcggggccctcaggcggccatggcggcaggcgccggggccgggtccgcgccgcgctggctgagggcgctgagcgagccgctgagcgcggcgcagctgcggcgactggaggagcaccgctacagcgcggcgggcgtctcgctgctcgagccgccgctgcagctctactggacctggctgctccagtggatcccgctctggatggcccccaactccatcaccctgctggggctcgccgtcaacgtggtcaccacgctcgtgctcatctcctactgtcccacggccaccgaagaggtagggctggccgatcgcccgagccgggccccagatgcgctgcgggcgggtcgctggaggcgccgggggaagggcggacccacgcgcggctgagcctctcccgggccccggaggggcggactggccactgccccgggcggtgtccgccctgggccgcctggagactgtcacgccactatcccaatcccgtgaccatcccaagcctcccctgggcagcggaggggctgttaaggtcactgccccaggtcctatgtccgcgcagatcctccccacggccgcggacgggccggagggcgcctgcccagccgctatcccatgcggcgccaacctgtgagacggacccgcggtcgggtgctttgcacactggggactgaacacccccatctccgtcctgcctggcacagggacttgtgccaagcccgagacgccctttgaatactttcgtaaccgttcgtttctggaaggttgagctagtgatcttgaaatgaccggtagcactgatcaaagatgagttaagaggtaacttcctctttgcttcatcgactttttcaagaaaaacaaactggaatgttatcaaggcaataatttttttgtcatcacaacctagggattaaaaaaaccccaacattttattagcaataattacatttgacctttgtacaaaataaggagtaaatataggctttggatagctgttcatcagaagcaccctttgggctgagtgtggagggatagggggcagagtggagttcactcccatctatagtttatactacgtgggataaatattacattgcacattctgtgacattactttctattctctgctccaaatagtgaagtccctttataatcatttgagtgtaggccttgtggaggactcatggaggttgaggttggattaacagaaatacagtggaaatatttcatgccctccatgcatgcatccattttgttgttgtttttgagacaggggtttactctgtcacccaggctggagtgccgtgccgtggctcgatctcggctcactgcaacctccgccttcagggttcaagcgattcttctgcctcagccttccaagtagctgggattacaggcgcgtgccaccacggccgactcacttttgtgtttttagtagatacaaggtttcaccatgttggccaggctcatgcatcctttaaaaacaaaaatttgatcgagcctacattttaaaatatcttgtcaatggattggtatgcttattatgtatttcttttcttttttttttttttgagacagagtctcgctctgtcacccaggctggagggcaatgtggtgatctcggctcactgcaacctctgcctcctgggttcaagcgattcccttgcctcagcctcctgaatagctgggactacacgtgcctgccaccacgcccggctaatttttgtatttttagtagagacggggtttcaccatattggccaggctggtctcgaactcctgacctcaagtgatccgcctgcctcggcctcccaaagtgctggtatttacaggagtgagccactgcgccaggcttattatatatttcttaatagacattcccattgtcatttgccattgctattcatttacatattacatatgaaaaagtaagctgctttagtttttggctgttttgctgcctgtttctagaatttaccagagggagtgtgttagaatgaaaggatagctgggttggaagtggaggtcttggtttctaactggctcttccaccacagacctgctgggtctgtgttcccacagatacaatagaaaataatgcctgccaaaacaacttgacaaggatgcagtgaggaccaaatgatatatatgcagataaatgtaaaagattgcgatgtgcctaacaaattaaaaatatcactcaacacattaaaaatattactgttatcagacaacatcctgaaaacacataataaaatttagttttgattgggtccagatttagctaacagcatttgaatgtttctgatattggccagttaagttgtggactcttcaatgttattattaatttaagaagcatttgttgaacacttagaaagagcagggcttaccaaaaaagtcaagagcttctgcctagggaagtaaagggaggcctgatggaagaggtacgtttatgattaattagtttttaggatcagcctcatgtgaaaaaaaaaaaaaaaagggtggagggtggggattggaggcatttaaaaataaagtgcaaaatcaaatggcccaagaagggtaaatgagagttaaaaacaagagtttctgaaatgtatgtcactagaaccttcatatgcttctgagtgactgatgcagggaggggaaacgccattacaggatccacattgcttgtttggtgaaagcccagcaacagtgtgaagagtgtagcagtttctggctattttctcttaagttcatagaactagcaaatgactggatcaggtaggattcagatctaagttggtatgacttcaaaaataaaaagatcctatgttttacataatacaaatatgtaaagtgctttcacatccatggttgcatttgtgtcttgttatcagccaaagaggttagcaagttttccgcttcctacaatggccctcctaccacctcagtatttcttctatccatctatcctgaagtaacagtagtatatgttttcataagaggaaattgaagcccagagatgtcaagtgactttcaactggcttgggacttgttttctgattctcagacttaagaattcttagtgtttttttcagacttgacagattgcttccagaaagagtcagcaaaaacacataaggtttttcgatttagatgcttgggcttatctactcatataggctttaatactgagtgcatgaataataacatttgatacgtttttaagcatgatgctaatttctagaacatgactggggataaagggaaactaatagaaaaaagttgtgatttatatttagcttctgcaaactgcttttcaagccatcatttccaataaggaactttgtactccagccaaattgaacttcttactataacaaggatttctctccttcttatccctctcttttccccttcctcttcctttcttctgtaccagttatccaactatgtacccatctttcaatacccaattctaacactatatccttatgaaagttatcttccttttcctaagtcaaatcaaccactctgaattcccatgataatgacaataactaacttttactggatttttactgtgtatcagggatgattttaagtcacttttattctttcattgactcctctcaacaaccttatgaataaggtactattagtatcatcattttatagatgaggaaactgaaggaaaattaacctcttctagagtgacatacctttaagtgggggccaggattccaagccagaagctatgcttcctttgtagggctttgtagctctcctgtggatctttaccgttttattttggttgtctgtgtccttattgagcaggacaacttaccagattttaagttcagacagcaattgctcgttcatttgtataatctctatagcacagtgctttacatcaaacagatgcttataattttgcatcaaacagatgcaattatttagaaaacaaacatttgtttgttttctaaattattggctgcaggaatgaaataacacaatgtgatgtcaagagatgatgtttttcaacccttattcagttttagctgttcttgggttaaatacctagcaattgtttggccttggtagttttaagtagagtaagcaagtgttagggcaaatggagaaaacaagaactttgtctcctcactttgatgaagcagttctatctgaacatcaccctaagtaggtagtccctggcccccattccttggctacctaatcttaaaatagaatcacagattcttagagtttggaaggaccttagagattatttaatgtaactcctacatttatatatgtgataacccagtgatttgaatctagttcttctaactccagcctagtagcagtctctcctactaactccatgcacttgtgtttgactggtataaactgttactccattctctattacatatctgattaaatgtttctgccctgtcttcgtgatctgtgcatataaatccatgtcagtgtctttattaagaatatgtttatggcagggacaagtgcctagcttaaggtcaggtcaaagggcattaattaatgcatttcttgtgtttatgatgataaagagttgaactgaaaagtaagtatacctgagcatgccagaaacaccttaagaaatggtttattctctgtttaaataacttatttaaataactcatattttaaacacagaataaaccatttcttaaggttatctttgtactacatattgcctttgtattacatattatagagttattttggggggaataatagaaagaaaaggaaataacctttagattcctactcagacttttttttataggtttgatttctttgagatctagtatatttcctttttaagcactcttttactcccactttttttaaaccagctcagtaacttttcaagcatcatttattaaggcaggactcttgtaagggcgtgacctctctcattaaaacaaaatgtgaactccagatttccaggagatagaagcagggagggacttagggtgaggcaagccaggactcaaaatttaaggaggcctttgcaggactgtgagaatgaatgtctccttaacttctgcagccatggtgcctccctgcctcacccttagtccccggccatctagaaggagactcttcagataatgtggaggtagcttcccttgattcctatggcttcactatacttaattcctaacgaataaaactgtttctcctttcaaattctggttcaagtgtggataaaacgtggcatcgtggtatttagaagaagctttgaattttcctcctggtgcatttgattggggtagaaggctacaaccagaccacttgggttttgcgaagttgaagaacagaacagaagcaacccagtacagttgatgtggatgatagatttggcctcaggggaattctcttcacacccctctctctttttgttccccttagcacagtgacaggctggcattttcaacaagaaccctaataagtattaaagaagaaagaaaaccaaaatgattcacactgaatataaaaataaaggccagctttcaaagtacagatttatcaggtcatgagaaaaccccattggccctgaagtgctggtttaactgcatttatgtgcgatgtctgtctggtttcctttgccgcagcttataacctgcctaatttcctaaaaatggatgtgctcttctcaaatgctggttcctaaactgagccaagaccaaaggtctgggtcgaaagcagtgagcccctagggccttcctcattggcttggcagagagtggttttaccttttctgaccaccaaggctcctctggagcctccccaggcctcaggtgggaaccctccctccgtaaacaaagaagcaccctccccatcacaggctcccagtaaacaatgtcataagcacatcttaggcacttattgggttagagcagttgcaggaatggagcaatcagtcatttctacttcttatgtcttccagagtcaggttagcagtctattagaaactccataaattctcttttaaaaatcgtagaatctcttgtgatccctggaataatgaaatgaaaaaaaaaatcttaagagtcacctgtctgggtagaaagtctacctttaacagcatactcgcattacatgtttttcacatatgcacaatatgtcttctaatgtcctttcttcctatgtcttagaaatgcagtttctatttttatgaagaaagaagtcaatgtttggataattgaaatcttcttgttaccagctgacctaatggttattggttatctaattcccttctgcatagatgtcaattcatccaaggccatttcaagcaaagaggtttttttgttttgtttttgttttttttcagtataaaaatttacgtaatgaacattgtatagttctagtatttcctagtttgggaagattttttcttttatatattatctatacttgcttttatttactatttttctttatgtcaactttaaatcaactcttttaaaaacttagactcttactctgacttaatatttataaaatcatagatatgatatgctatttttcttttttttttttttgagatggagtttcgctcttgttgcccaggctggagtgcagtggtgcaaccttggctcactgctacctccgcctcctgggttcaagtgattctcctgcctcagcctcccaagcagctgggattacaggtgtgcaccaccatgcctggctaattttgtgtttttagtagagatggggtttcactatgttggtcaggctgggctcgaactcctgacctcgggtgatccacccacctcagcctcccaaagtgctgggattacaggcatgagccaccgcacctggccctgtttttcaaaatacattaaattttttcaaaatatattaaaataaacataaacattcaattgaaaagtttacctacagatcacctaaaattatctgatggagtatcagtaataacagtaacagtaacaaatactgagctccttccatatgcccagcacttttataaacattttacatgtgataagtcatttaattttcacaatgagagaggagcaatgattattaccattttcaaatggagagactaaggcactgtaaagtgattcatccaactcatttagccagtaagtagcagagcaaatgtgggtgcaagtagagtctagagtctatgcccctaaccactctgcaagaaaaacctggggcatgtattcttcccattgcttttttgttttgtttgtttgtttgtttgtttttgagatagggtctcacttggctcactgcaaccttggcctactgtcctcaagtgatcctcccccctcagcctcccaagcagctgggattacaggtgtgcaccaccatgcctggctaattttgtgtttttagtagagatggggtttcactatgttggtcaggctgggctcgaactcctgacctcgggtgatccacccacctcagcctcccaaagtgctgggattacaggcatgagccaccgcacctggccctgtttttcaaaatacattaaattttttcaaaatatattaaaataaacataaacattcaattgaaaagtttacctacagatcacctaaaattatctgatggagtatcagtaataacagtaacagtaacaaatactgagctccttccatatgcccagcacttttataaacattttacatgtgataagtcatttaattttcacaatgagagaggagcaatgattattaccattttcaaatggagagactaaggcactgtaaagtgattcatccaactcatttagccagtaagtagcagagcaaatgtgggtgcaagtagagtctagagtctatgcccctaaccactctgcaagaaaaacctggggcatgtattcttcccattgcttttttgttttgtttgtttgtttgtttgtttttgagatagggtctcacttggctcactgcaaccttggcctactgtcctcaagtgatcctcccccctcagcctcccaagtagctgggattacaggcatgcacccccacgcccggctaatttttgtatttttagtagagacggggtttcactatgttggccaggctggtcttgaactcctggcctcaagtgatctgcccgcctcagccttccaaagtggtgagctaccacacccagcctgattttcatcatctacgtatttagctcctacagaagatttttaaaaatagaatacgtggctgggtgcggtgactcatgcctgtaatcccaggactttgggaggcctaggtgggtggatctcaaggtcaggagtttgagaccagcctgaccaacatggtgaaaccccatctctactaaaaatacaaaaactagccaggtgtggtggtgcacatctgtaatcccagctactcaggaggctgaggcaggagaatcacttgaacctgggaggcggaggttgcagtgagcgaagattacaccactgcactccagcctgggcgacagagtgagactctgtctcaagaaaaaaaaaaaagaaagaaaaatagaatacgtgtctcatgcccatgagaggatcacattctaatatgaaagatagggccacatacaaatgacatcacatcgatctagagctgaaacatacctcagaaactatctagtctaccattttcatttagagaagacctaagaacatgttccagaaaaatcagtattttgaggctgtaagtgaaatttgtccagtgagttcagtggatctcagcatgcagctttcacctgatgccagtgccatgctcttgggcttcccaggctccagaaccatgagccaaataagtcttttctttataaattacccagtgtctagtattctgttatagcaacagaaaatggaattacacaactcttatttgaaaaaatgggaggctataattatgaaacaattaatgacttatgtggaattacttcccttggttaaattagatctttactttcattaactaaagatgataatttcaaagctttgctttttaaatttgttctgctacctgtgaaatcatttaaaatcaaggaaactagacaacagaaacagtgcattgttataaagtcatgaacatcattgtcatgtagttccttatatttgtatacctgaggtactaaccatctaatgagcatattttgtacaacagaaggcctatatatttgcaaagactgctttaaccctgaaaaatatttgtagaaggtgtatttttaagggagtaggtaggaatggaatgactggagataggtaggtttgtgtcctttgatttctccctagatgaagttgtaggtggagtaagaggtgtatcaggcagtccttgaaggagggggcatatgagtgctttgctgaattgggtgagaagagtgtttagaaaggaaaaagccatgagacagtattaagtcataaataaacaagaggactttgtgggtggaatggagctggagtatgaaggtgggtgattgagagttatgctgcaaagagactcttatcagtgagtaaagagcttgtggtaagattagtttaggagtggccagaagagctgttcctaaactcatgtgctccttggtgtgctcctaaactaagcccatgaaggctctcccctaaatctcctgtaatacaaatagaaaattatttttgcacaaacacctttattgtcacacttggtccattaattgagggatattggttaaacatatactgtgtgccagagtaatgttctagagtactgggaatgtaggggtgagtgagaaagacacaatccttgccctctctgtgctttaatcagttcagccttagaaaatgaaatatttaaggtgagaaggcaaggaaaagggaagacttaattttggagttttggattgggtatgtggggggcaggtggctttgattagggagaccaagatgaaggtactagtgctgtttctcagtgagttacagggttgtgggcaaggaagaagagaagtagatgcctcctctctcacctcaatctttctccttcagtcactgcgtagttccgtctcttaatatggaaacgttaagattcttatacttatgggcctttttccagagaatgcagagagcatacaggattttgtcagaggtgcagttcacctctggatgttttctggaagagtaaatcatgtgtgaaaattgaataaattaatggactatcagacttgctgtttgcttttttccagtataagctttgtgtctttgagactatggtaggagtgtatgacttcctggctaggatgtcagtttaatttgtttgtgcttctatacgatagttacagtgttgtcagaaagcattgaggaagttttaaaatcataatttagttttatctaatcctgtaatgaatagaatcctatgaataattcaaataactagaaaagctaaaatttcccaaatatgtattttatacagctctttttcagtgtataattgaaaaacaatttaaattttaatcagtgggtttttttttaatgacaaggggttatgattgatttttagtagttattttgttttctagaataaatttatatgaaatttaatatatcaagtaaaattcattgttagggaagctattacttaaattatgatatagccacataattgaataccatgcagtcattaaaaagaatgatgtggatctctgtgtttgacctggaaagagttctgtaacattgttaaatttggatacagtagatattatgaaaactatataattaaaaacgtatttattcatttatttaattatttagagacagggtctcactctgttgccccagctggagtgcagtggctcacttcaacctctgcctcctgggttcaagcaattctcgtgcctcagcctcctgagtagctgggattacaggagtatgccaccacagctggctaatttttggatttttaatagagacagatttttaccatgctggccaggcttgtctcaaactactgacctcaagtgatcagcccaccttggcttcccaaagtgctgggattacaggtgtgaaccaccacatccagccataaaaactttaaatgttagaatggaatattacctagagaagttctactacttggaatagatctcttctaacaaacattgcttatggctttataattcataatccaagggtggctttttcatccttacatttaacttttttgaaaataagttaacatgaaaactagaattgagttagggaggctctgtagctcccgtttccatgaagagtctcttctggctaggcacggtggcactcgcctataatcccagcattttgggaggctgaggcagaaggatagtttgaggccaggagtttgagaccagcctgggtagcatagccagatgctgtctctacaaaaaatttaaaaaattaaccaggcatggtggtgcacacctgtagtgtcctagctactgaggaggctgaggtgggaggattgcatgaacccaggagtctgaggttacaacatgtgcctctgcactccagcctgggcaacagagtgagacctgtgtcaaaaaaaaaaaaaaaaaaaaaagtctaatctataattgtaccatttttggaaagggatacctggaaggaagttgttctgctgtgcctggccaaataaatcccagcctgtttgcagggataacaagttagaaaaaaagtgagaaaatgcaacctatttaatcgctttcacctaggaatggaggtggtgaccaaaggaaaaagagaagataggtctggctcctgaggccttgggaagactgggaaaacttggaaggatttgggaagaattggaaaaggagtgaaccaaatattggcagatcattgtgcctttctgggtttaaaggaaagactcttgtggctggcaccatttcctgtggctcactgctacttgaaagtgtattgtgtgagggggaaagtgcttatcagcaggtttgatggaatagggagtttgtgaagatttcaggtgaaaagttccattcagtctgtgtggcctgtggtaggataaatctcatcgaagggcaagtcggaagacccgatctagttcctggacccagcctaagtgcttgccttgatgtaaattatcactcctccgtatgtttcactttcatctttaataaaaagaatatgataataactgccctatctctgtggatttctgtattaattgaaataatacattagaaatgctgtttatcagctgggtgtggtggctcacgcctgtaatcccagcactttgggaggctgaggcaggtggatcatttaaggtcaggagttggagaccggcctgggcaacatggcaaaaccctgtctctaccaaaaatacaaaaatttagctgggtgtggtggcgtgcgcctgtaatctcagctactttgggaggttgagggggaggatcacttgggcctgggaggcggatgttgcagtgagccaagatcctttactgcactccagcctgggcgacagagcgagaccctgtctcaagaacaaaaaaaggaaagaaaagaagtgccctttgttgtactgttgaagatcacattacctttgcaatattatctcttgtaaattacctgttccaggaacatggatctagtcactgactccagtaaacctttcactttcagtcagaaactttggtttctgcctagacttcctctcttctctgtttacattcccagtctctccctatttaaacgcctctagtatcctaatgaagcacttttaaactggtgaacagtcttcatttcccttttctaaattaagagcgggatataatttggggtagagtcaccaccagttgtggtgtaagggttaatcaaatttatttcagtatgaatttctgttaatacctgaccatgagacctgcctgtagctagtttctcagatcagaggtcagaattaagctttcaatgttgacttttagagttctccttgagaagatccagattttcagtataaagagttacatagagaaatggaagatccctctgacattttgtcattacagaaattttaataacttcaatgtccaattttacatatgtttgacgtgtaactttgctttccttcaatcatcaaaattaaaaacaatttttcatagtagaaaaaatgggtaagaatttgctagtttgatatggtcaactaatttttgataagggccccaagaggacacaatggggaaaggatagtctcttcaataaataatgctgggaaaatgatttccataggccaaaagaatgaaattggaccttatattacactgtatacaaaaataaactcaaaatggataaaatacctaaatataagaacaaaaactgtaaaactatacccaaaggaaatgaaatcatcgccgtaaaaagatacttgcactcccatgatcattgtagcattattcacaatagccaaaatacagaaacagcctaagtgtctgttaacatatgaatggataaagaaactgtagtatgcacaatggaatattactgagccctaaagaacaaaatcttgccatttaccacaacatggatgagcctgggagacattatgctaagtgaaataagccagacacagaaagagaaatatggtatgatcttgatctcgcgtatacacagaatctgaaaaaaaaattcagagatagagaatgaaactggttatcaggagcagaggggcataaaggggaggaaatgggaagaggcaggtcaaaggatacattacagctttgcaagatgagcaggtctagagatcttatgtacaacctgaggggtataggttaaaaaaattgaactgtaaaatgaatagattttagctgctcttgccacaaaaacaaaaaaatgggtaactatgtgagatgatggatatgttaatttgcttcagtttagtaccgtttccatctatctacatatcccataacatcatgttgtatacataataaaatttatctttaaaaaagaatttactagtttgaaaagaatttactaggttaacagaattgttctctgtaagacactttgggattctttcaaaagattctgggtgggatgtgttgtttttcatttttgtactgtcgtgatgactgcttagttttgtttgccctttcttaaattgtttcacagtttccaagataaacttttaagaacgtgctcactggaactgaatatgatattttatttattttatttttcaagacagggtctcgctctgtcacccaggctggagtacagtggcactcactgctcactgcaccctcgacttccccaggcttgggtgatcctcccacctcagcctcctgagtagctgggactacaagtgtacaccgccgcaccaggctaatttttatatcttttgtagagatggggttcaccatgttgcccaggctggtcttgaacccctgggcttaagcaatctgcccaccttggcctcccaaagtgctaggattataggtgtgagccgccgaacctggactgtgattttctgcttactactagttttcattgatttaattacgatgtgccttgatgggtgtttaaaaaatatttattctgtttggggtttgttgagcttcttggacatgtaggtttatagatttcatcaactttggacatttttcatcatttatttcttcttatatttttcgtgccccatccgctcttttctctttctaagactctagttacatatgtgctagactgctttctgttgtcccaccactcgccgatgcacagttcaattatttttagtcgtttttctttcgtcattttggatagtttccattggtacatgcttattgatcttttcttctgtggtgtttaatatgctgttaatctcacccagtttattttacaattcaaatattgtaattttcatttctggagatttcacttgagtcttttcttccatttctgtttataattttcctgttttcctctactttcttgaacatgtggagcatatttataataactattttgatatcctcatctgctaattctattacttctgttcatattgattctgattgtattctgattatatggattttacttctagttgtcaattatattctcctgcttctttgcatgactggtaattttttactgaatgccaaaccttgtgaattttacctttgggatactagatttttttcccctaagatgtactttatgatggctgtagttaagttgccaggaattacttggatccttttgaggctggattttaagttttgttagggctgtccagagaagccttcagtctagggttaatttatgcctgctggtaaggcagtacacttctgagaactttacccaatgccccaagtattaatgaggctttctgctttgcctggtgggaacatgaatgtcccagccatgtatgagctttgagaattgtctgaccttcaacattgcagtgcttctctccctggcctttgttagtttcatctcattcaggcacagatgagttctcagccgaagacggaaagatacccttccgtaagacgtccacaacttatgctcctctctctgtgcagctctgtcctctcaggcactctgcctcacaaatcctaattgccttgaccttcctgaactttgtgtttctcttaaacacagcatgattgctggactctgttctggtcatgggacctgcactgtggcctggaaactgactctgggaagttagctggagcagtcgcagggctcatctcatttgtttcccttctgtgagggatcacaagcctgcactgcctgtaatgtttgaaaactgttttttgttttttgtttttttaaaaatatattttattgcctttctagttatataaggtgggagagcaaatctagtccctgatactccattgtgaatggaagcagaggttggcagttggcccctaaggtcttttttcacagcaaaaatttaactgagtaatttcaaatctgtggcataatgcatagtattatattaaaagagccatggatgtaagaatcaagatcaggatcctaatccttactcagttgtttaactttgtgtttcttacattgtggacttctgtgaccctctacctagatgacttaaagcagttaatttgatttctcaatttaattcgcatctgtagaatgagggttagaaatgttctttataacacacggggtgctacaaagtgtgaagccttaggttgagctattttcagaaagcttattatcacttaacaatctttattttatttacattttttataggcaccatactggacataccttttatgtgcactgggactttttatttaccagtcactggatgctattgatgggaaacaagccagaagaacaaactcttgttcccctttaggggagctctttgaccatggctgtgactctctttccacaggtaaattagtggagttttttatttttttatgataccttaaaaataaaatgaactgagctgtttggtcagttttttggatggatatacatttgggagcaaatgtatggagttgtttaaaaagtatgtcaagaattcattttgataagtgtactttattttaatgccatgattatttccttagagctctgtatttctaaacagcatagggcaattatttcataaattatttttaattcttaatgattcttaaactttgtttctttcagtatttatggcagtgggagcttcaattgccgctcgcttaggaacttatcctgactggttttttttctgctcttttattgggatgtttgtgttttattgcgctcattggcagacttatgtttcaggcatgttgagatttggaaagtaagtatgctttttaagttgtacattaaaaaatataattgaattcatttgcacaatctgttatgtcattcatcgataataaggagaacaaatcttcaatcagtaacttaaattaattcgtcggagtactcataaatgctacaccttaagtcttttaggtactctgcatgttataaatagttacattatttgataataattttatttttcttctcctcttctccaacttaatcattagcccaagtttacaatagagaggattaaaagaaaattaagggacctgaataatatagaaaagggatatgcagtacttaaataagcatttgattcatataataaaataatgcagtgtggagtctaaggtccttttttggtcgaatcttcatgtgcacagaaaggggacccgccttgacaacagtcaccagcatcaggtaattgtgagactctcaactgtggtaggcaattggtgagataatgtaaaagcaccttgtaaatgctagtgctaaacattagatagtattatctgcctctgttgcctctttcttagagaccaggaaatagtgcacaaagcaggaatactattctctgttcctctttttcatatagttccctctcggtctgatccttttaagaactttgtcatttgctcattttggctttggcttcccatgcctactgattctttttagccccactttattgctgaaaaggagaaacagtagctctgaaaaaactctctaatgataaatgataggagaagcttaaaactatggatcatttagcagagggcaggcttcaggcagttgattctcaattatggaataattgtatttaccacctatcgagcacttacatgtttcaggcattgtactaagagcttcacaggcattatcttatttattccttacatttatcccgtaaggtgggtattacctccatctaaagacattggggcatccaggcagagatgtaaagtatgtagacagatataaaaatctacagctcaggaaaaaatgtagattggagataaggatttagaagtcattagcatatagatggtagttttaagtatagataaaattgttcatagactataagaattccagatggaattctgaaagcatcatttaagatatgaatgaagaggcagtctaggaaggagcgtgagaagagctccagcaaggtaggaaaatcaggagagaacatggaatagataaaaacacagcagagcttttcaagaaagagggtatgatcagcatcttaaatattgtaaagaagttatgcaagataattaatgaaatgtatcccttagatttgtatcctttaattggaattgaaaattgaaggtcaatttaccttaaacaattttagtagaataatggggccaaaagccagactagagtgtgttaagcaacaaacgtgaagagaggagaaaattacaaatgttgactaattttcagtgagcctattcgtggagcataggagagagagtgacagcttcaggggaatgcagactagagggactgatgctgattggttagtggttttttgagaaatttaagcatatttactaggggaaaaatgtctatggaaactaaaaaaactacagtgactattagtacctcaataaagaagactattggaattttccctgctttttaagtgaaattgacctgggagtatttaaatttgccttaaatcatatggttgtttttattataatttttccttatgtacacaagtagtgggtaattattgtgaaaaaacttcagactttacaggagttcataaattagaaaataaaagtctttataacatcagtgataactattagcaatttgatatatggtatatatttttttccctctgcatataccgttacctatgtgtgagcacatgttgttctgtaacttttttaacttaacagtgtagtcaactgataattcaataatggaagtaaaggtaaaaataaactaagcctacagagatttttacatctttgctatttaatatgtgatgaacctccatattcaggaattttatttacaaacaccttatctattctttgtccttcctctttagagtggatgtaactgaaattcagatagctttagtgattgtctttgtgttgtctgcatttggaggagcaacaatgtgggactatacggtaaatctgaatatttaaatttatatttaagtacttttcaaatatttaggaaaaagtattgcattgttaattttcttcaaaaatccttggcattgtatttaattttttttttttaattggtgtatttaatatttgttccatttcttaacatttttttcttcattttataatgtgtattatcctatataccttatggcatttcctcctatgcttgagtatattgccacatagaagaagacaacctcatttccctaatactaaataaaacaaaaacaacaacaaaaaacacacattggaataactttttccagggtgaaataaaataaatattttaaaaataaatccagtaaaatgttttacatttaaaacttgtcactcaatattaggaaagtagttaatttgcatttttataatctactttgaggtgaagattcccatattaaggaatgtttttattttctgcctgcttggtgacctcagtagtttcataaaagttggctcttaggaggccactgtcataaattcaagcttttttgcaaaagaagaacatttctgaagaaacagttgtcctgttaccacaacgtaagtccaccatactggctaactgactcacactttctgctcatagtgttaagaataataataataaggatatcaatagtcaacaactaacagtcattcaatacttatgttcctaaacattcaccatctgcccctcagttttatctgcccctcagaacaatcctataaaatagatattattagtattatgctttataaataagtcttagggtgattaagtaatttgtccaaggacacatgagaagtgctggagctaggaattaaacagactgattccagactgtatgtaatcactaagctatatatctagtaaaaatagtaagtgatacaaaactaaacatagttttgtggtaaacatgatcagcagtcacactccttgttatttacctaaatgatttgaaaacttatgtccacacaaaaacctgtacacaaatgtttacagcagctttattcataattgccaaaatttgaaagcaactaagatgtccttcatcttagctggataaactaatgctaaaaagaaatgagctatcaagccatgaaaagaagttatgcgaggaacttatggagttccaagaagttatggaggaaccttaaatgtttgttactaagagaaagaagccaatctgaaaagtctgcatattgtgtgattccaactatatgacattctttaaaaaggcaaaattatggagacagtaaaaggatcagaagttaccatgggttggaggaagaagggatgaataggtgaagcacagagaatttttagggcagtaaaactattttgtatgatactaaatggtggctacatgtcattatacattcgtcatagcacacagaatgtgtaacaccaagattgaactctaatgtaaactatgaactttgggtgataatgacgtgtcaatgtaggttcaccagttgtaacaaacgtaccacgctggtgtaggatgttgttggcagagggaggggtggctatatacttttccactcaaattttgttgcaaacctaaaaccactctaaaaaattaagtccattaaaaacacagtatgaggccaggagttcaagaccagcctgggtaacttagcaagaccttgcctctacaaaaattctgtaaaactttagccaggcatggtggcatgcacctgtagtcccagctactcaggaggctgaggcaggagggtcaactgaacccaggagttcaaggctgcaatgagccattatcatgccactgactacactcctgcctgagtgacacagcaagaccccatctttaaaaaaaaaaaaaaaaaagatttccctgtagcatttagtatcagaattgccaattatcatttgtcagtaggctccgaaatagactttgggcatgtttttaagtagtagtgatagattcttcaatacattcatattccctctcatcatgtaagagtaaatagaatcaaggatatgctactataggcccatacaagataacagagggatgctatgcgttttttgtagtaactgttcaggttgtgcccgtaagaaggtaaatgtacgggcagatcacctgaggtcaagagttaaagaccagcctggccaacatggcaaaaccctgtctctgctaaaaatacacaaattagccgggtgtggtgatgggcacctgtaatcccagctactcgggaggctgaggcaggagaatcacttgaacctgggaggcagaggttgcagtgagccaagattgggccactgcactccagccctgggcgacaagagactcgtctcaagaaaaaaaaaaaaaaaaaaaaagaaggtaaatgtagacctagaagcagttagacaactctagttattaagtcaggtgtggttgtcttaaatttggaattgaatcttaaaattgtttcactcaatgttttggcaatatcgtaggaagaaaacatacctgcttattcttaccaacaagaatgcttacttttgattcaggttttctaaatttaattattaacctgtagtttccacaaattttggtacattatttcagtctattttctaaacatagtagcctctagcttctggcaattcattgttactgttttttaaatcctttgctgcctttggaagttttcttgaacagcagttgaccaacaggtaaatatattgctagagatttaatcctggatattaactacacagatgttttgcttgcatacacatcatgatatttgttacatttatgatgcaaatcatggtgtctccctttcctgtgatgctactttttagaagctactaaattcaaatgaactatcctttttcatgtttaagtcagatgaaatcttatgagattaaacatttagtcatagttatataaacagactaagctggtttggtggattcatctttcacttatgaagaaagcagtttcaaaaaaaagtcactttaggctggtccaatggtagtcagttatctcaattgattgctcacagtcagttacaggtcaaactccttgttcttctcttttcccccctcactactgtacttggctagtctacaaaaaataataaaaatttaaaaactaaaaaaaaaagttaaaaaaaagtttttaagttatcactttggattatattccagaagttaaggtttgatcacaagaaaaaggatagcttattgtacagggcttatcattatgtttctttattatttaataaaaaaccaaaattctgttgtcttaattgtttctttcttctacccctaaagattcctattctagaaataaaattgaagatccttccagttcttggatttctaggtggagtaatattttcctgttcaaattatttccatgttatcctccatggtggtgttggcaagaatggatccactatagcagtaaggcaataatttcatcattcagtgtcaattttatgatacattttcttatcaccagttataaaaagattaaaatatgccaaagttcaagaatggggaaggaaactaagtatcttaaagaattcattttaggcacatagtacaaaagcattttaaaaacagtttaaactgatattttcctctttctacaagcttgctctgcatagacttttctgacatctagtttcattactgcacataattaagagttgccatttgttttcctgcattttgtgccttgaactaatagcagagaggagaaagggtagggaatgtatgagttcctgattgaaagcaggaaagtggccagaggtcaatggtttcacatatggggggatttattactcatcaagtaaattttattgaaatttcactgaaatatatttaaaagaactattctaatatttcaaaaggtaaaattttaactttaattcttaagtgggtatactttgtgcttgtgttctttacaccttgctcatgcaagtattaaatataatgcttttgtattttttcacatttgttttttaaaacttcagtacttttaagtgggcaagagttgggattcctgcaaactttttaaacaaatataacacctatgtttttaaaaagcctattgtcattttcaaggtagttgaacagaagaagacaagtacttattccagtgataccatcttataccaaaccattgttataatgcctttttcagggccgggcacagtggctcatgcttgtaatcctagcaattttggaggccgaggcaggtggatcacttgaggtcaagagttcgagaccagcctggccaacatggtgaaaccctgtcgctaccaaaaatacaaaaaaattagctgggcatggtggccatgcttttgtaaatccagctagctacttgggaggctgaggcaggacaattgcttgaaccaggaggcggcggttgcagtaagctgagacggtgccactgcactccagcctgggtgacagagcgagactctgtttcaaaaaaaaaaagaatgcctttttaggattgctttaaactatagcatattcactttaatttcttttgttgtatagttcaaaatttctatcctttaaagtcatttggagcaaggtctaataagatattaaacattagatatagcatttttagtaaaaaaaagtctcattcttttaaaagacgtgtaagtagactttcgagacaatttcaaagggatcctcataattgacaaattgtcaatatttatgaatacactttatatacataattcaaaagcaaagtatacaattcatctagaaatataagttctgatatatttggaaaagttgtcattttttgaggtgttttgtcagttgatctcagtatagtactgtgcttaggaatacatgttgcttgactgtggatgataacatagaacaatagttggaacgttaagttccattgaagaaaacaagatgtagtaatgatcattgtctactctaaagaatatttttgaccagatgcggtggctcacgcttgtaatcccagcactttgggaggccgaggcgggcagatcattaggtcaggagttcaagaccagtctggccaacacaatgaaaccctgtctctactaaaaatacaaaaattagctgggcttagtggcgggcacctgtaatcccagctactcaggaggctgaggcaggaaaatcgattgaacctgggaggcggaggttgcagtaaggcaagatcatgccactgcacttaagcctgggtgacagagctagattccatctcaaaaaaaaaaaagaatattttcattaaaaaaactgttagatgtttgaaggatgacttaaacacaagttaggaagtggttggtttcaaactcttaaactggtatttttccaacttttttaggagcagattttttttcttgaatgagatttaagaatcataatataaagcactattagatttttataatttattactatacagtgtcatgtatataattttataatatggtattactgtaattttatagtaagttctaacttaaaacatgtaaacttaataaacaagagtaaagctgttcttgtgaacccatttaaattggttatagatttaataacctcaataccaaatttatttcaatattttatttaggataagcagtgccgagaggatactaattcacatagataaaaatgtaatggtctggattttacaattttacataaaagaacatttgcagtctgaatgcaaaaagaaaggaggtggggatgttggtgtagaaagaaactaggataagctgggtgtggtggctctcgcctgtaatcccagcactttgagaagctgaggctgggaggatcgcttgagcccgggagtttgagactggcctgggcaacatggggaaaccctgtctctactaaaaacacaaaaaattaaaaaaaaaaaaaaaaaaagaaaataggaaaaaagaaggaaacctgaatagaactaaactattcttactcttcttcatcagtgatattttgtagaattggcagaataagctctatttcagtatctccacaaaattatgttaatttggcaatccacatgtggactgccttcgatgtagtaaaagttgatatagaataaactgcattaatttttagccagtttaaaacgtgtgtgaatatcaaactggaatcagacatctgtggcactgtattatgtctctgtcaccctcaggttctatgaaaccttggaaagcacaactcaggtttgtatactcctgtaggccatacactacatcacactgttctttaggcctcttgcacaaaatagatggtcagaaaatgtctacattgtaataaatgcagtgttaaaatgtgatactgattttctgctttatcccttagggcaccagtgtcttgtcacctggactccacataggactaattattatactggcaataatgatctataaaaagtcagcaactgatgtgtttgaaaagcatccttgtctttatatcctaatgtttggatgtgtctttgctaaagtctcacaaaaattagtggtaagaaatttttattattcatgatataaataatatacttagtcgtcaaacacaaagctggaaattatttcataaaatgtataggttttcttttgtagtgtaaaatcataataattagctatttgtgctccaagcaaaactgtgataagagttatattcagttaaattgtttagctgtagttatcatttacaactttctgatatcaagaaatttaaacactggaaactttaataagctacccagttgtgaatttgagaaggtgtagaaaagtattcttaaatgtgagattaaatggtctgttttaatactgaattaaagttataattaattctgtcgtaaaagctaacacatttaaaacttaatagtaaaattattttgtttaatttttttataggtagctcacatgaccaaaagtgaactatatcttcaagacactgtctttttggggccaggtcttttgtttttagaccagtactttaataactttatagacgaatatgttgttctatggatggcaatggtaagtatttttctccattttatttattttttaacaatgcttaagagctatttcagtgagctatcagtagcctcaagatctagtctaggccaggcgtggtgactcacgcctgtaatcccagcactttgggaggccaaggtggacggatcatttgaggtcaagagtttgagaccaacctggccaacatggtaaaactctgtctgtaccaaaaaatacaaaaaattagccaggcgtggtggtgcatccctgtaatcccagctactcaggaggctgaggcaggcaaatcacttgaacctgggaggcagaggttgcggtgagccgagatcatgccactgcactccagcctgggtgacacagcgagactgtgtctcaaaaaaaaaaaaaaaagatctagtctatacaatatatacaataaatgtttctgagtatttaaaattacttcttctaagctgtgaataatattatattgtgtgtagaaatggccacatatctataggccaggtttccaacaacctggattcttggaaacacaactgtgtacctaaaaatagctatatttttctcccccaaaataccagtacaaagatgccaaaaaccactttactctgcccaaagactttattcccagtttacagcaagtaacaggaaaattagatggggttagtactagcaaaggtgggcactttattgcatcgagaattgtcagctaatattgaggaaacaaaacagaatagacagtgctactaaatacaggattctcagaccattttatgctagatgtaaggaaccctttttatgtgtatggcccttgaggatagtgtataatttgtattaatgatgactcagtcatcaattaaattaaattcgctttgattatatcctgcttaaggaaacgacgtggatgacataatttctattcaaaatgattataaaatacagaatatagtgcttgagagagacacgttagccatctaaggaaaagaaaatcaatattggtaacacttcaattacaaagttggataaatggagcattattacattttttttctattgagacatatctttatggttggtctccaattaatggtggctttgaatagttttcttgtatttctatctctggacccactggttgtcaccaaattcatagtgatatataaatataccgaagtacaccaaaacaaaaccccccaaaaccctgcagtgaatcttttgataattcaaataatctcaccgtatttgttagagttggatatttaaaaaaatctgtatctattctgtgcatggattacaggagtacatctaatggtcccttactaggttgtgtagtatgctttttctggagtaacttaataacgtaatattcattcatagtccattcagaagtcttcattcttcctatggtggcagtgagatatacttaattctttgaggtggacaatgaacgttttcaggcaaaattaaaaaaaaaaatgtttaaaaatcagaataatgtcctttaatttggtatccactataaatatttttagggctcccaaacaatccagtttaaaaaataggggataattaatcaaaatatctaaaaactcaatgtaagttttcttttagtgaacttaggtatgtattaccaagtggaattgctgaattaaaataccaggtgttaaaaaaatcaatcatctgtcgtaacgagtaattggcctggtttacacctgtgatggagactggtaaactgaggaagtcaaattcaatttttatttaaaacactatgtggatgacaaaaaaaaaaaaaaaaagccacacacacaatgtggtacttttcaagtaagcttttaacataaatgatagagattttcccctcatgggtgagaattccctctccaagggcagagctatgagtctcctttttctcctgggtttcattttctgaagagaagcatttgactgtagactctgggcaaagtttctaaatagaggccatctttaaatttgtaaacacaattctgtatatgcttcaagtatggtatcttttctagaccttttaccttcttacaactaacctcaaagaaacagaaatgtatatgatggaattaattcattataagatgactgataacttcttctagaaggaaatttgcagcttcgtggcacagcaggaagttgaaacaatgtggagtcaggagagttgggttctgttactttctagtttctgtattttagtcgtcttttttacctctgagcctcagtgtctataactgtgaaataacctgcattttccagaggactacagtgaggtccaaatttgaaatgtattaaagtgctttaaaatgtagtatttttggtgaagaattttaggttaaggtttgatatttgggggagaaacagaatagtgctacttgagaaaagatagatcataatcgattttatattttcttttttgcttctaaaggtgatttcttcatttgatatggtgatatactttagtgctttgtgcctgcaaatttcaagacaccttcatctaaatatattcaagactgcatgtcatcaagcacctgaacaggttcacaagcatattgactgactaatagcccaaggaaaagaggagatgaagttaggggaatctatgagtgaaggaaatccccctgtgcaggaggctagtataccatcaataaggttatatttgaatataaaacataaaccctgtagatttcattgtgtcttatttcagttatgaagcccccattgtatcatcattttttatcacagatgttctcagaattgtctacatattaattagaaacaagactaaagaaatgtcaatcctgaggacaacagtgaacccctgtaattctaagtagcagtttgtctctgagacttatcagacacagggttttcactgccaaaggattacataaatattcagaacataaaggattttagccatcttgagggtgcttactttgactgctaaaaactgaaaagtgattcaatactgcttaagtgcatggcttataatgtaattattgaatcaagttatgttctaagaaattttttatactaatcatttttcaagaggcatattagtatgttataaaatacttgcttttagtatactagaatttaaaagggctacaggaattttttaaataaaatttgtatttaataaaaggaatttgttgtaccagttcagaaaaacatacgaatctttatactgaaggtaacttgttccttgatattttgagttaaaatttcactgtcactgaaaagtggatgttaaatattccctttcatgaaaaatgaaaacagtagctaagagtcagttgacatgtaagaaaattagtaacttagaaaaacttacttggtaaaaaaaatcttccttttagaatacaaaagtttactttaagtacacactgactcatttgaggtgataagggataaaataagtaaaagttattcaaccactaagtacattaggtactgatacttatctttccactctaattgaaatgtatttagattactcattatgaatactactagaactatcacaaagatctctggggatccaaatcttcagattcccatctgaccctatttatttttaattttatataatagttcaacagaccatatgtcatatgatgaagtaatcaaaaaaaaaaaaaaggagtaatttgtgtactacatctgttttaggcaagaaaaaggtatattgaagaaaacagtgaaagatgatattccttaaaagcaaaaaaacatacttatgggaattaagtacacagaaaacactggagtacttattttgcctctaactaactattggtaaaacttcccaaataaggactttcttacaaggatgaatagtacttatgatttatattctaataatatatactttggcttaaaaggaaaatcctttacaaagttcaaaaatttaggaaataatgtcaaatattcgttaatggtggaagactaatttcttcctgtacaagtaggttgtcacaattagaaaaagtttatctgtaggcacctgtttttttaaaacttggaaaaccttattataactaagataagggtgagttatacaggcaaaaattagaatttaaaacatagaaaagcaggaggccaggcatggtggctcacacctgtaatcccagcactttgggaggccgaggcgggcagatcatttgaagtcaggagttcgagaccagcctggccaacatggcgaaaccccgtctctactaaaaatacaaaaataagctgggcgtggtggcaagtgcctgtagtcccagctacttgggaagctgaggcaggaaaatcgcttgaacctgggaggcggaggttgcagtgagctgagattactccactgcactccagctggggtgacagagtgagactccatctcaaaaaataaataaacgcagatgtgatatatataaaccataagaaattaggtatgttaatgatgtgctcttaatttaattgcagaccaagcccaatgaagtgacattatgtctttgtggcaatgacatattcacaaatccatgtcttaaaactgttatttatatattgttctattgctagtgatttaatgttcagaggttaatgattttagcaatttattccagaacacaaatttaaatgcatcttattgtcattagaatcggttgtacaacttaagtatatagaaaaggatgtacatgtaaaatagattttgtattccgttttttccttaaagaacataaccttctatacttggttttctaccttttgggattgatagagatacaatgaagccaaacctaaaattaaatcgtctttatttaattgacagtgttagagagaaaaattcactatcattactaaagagctgaaagcttaatacatattctttaggaatagttgctaactaactcataactatttagatttgacttaacagaaagggaggtcttacaatgaaacaggtttatgattaaagatgttacaattaaactattctaaagacttacaatatgcttcttagctaacgttataattgtatcatattacttaggttcaagttctttcttcaaagagtcatcagaataacatggattgaagagacttccgaacacttgctatctcttgctgctgctgtttcatggaaggagatattaaacatttgtttaatttttatttaagtgttatacctatttcagcaaataaaatatttcattgctta

SEQ ID NO: 1149 - DNA, 10732 bp, Homo sapiens
ttgcaacaatttaaaaatttattgcattacagtagcatcacatcagcagtcaataatgccactttaagcaaaagtctttcagtatttccgttacacattctgttaacaagaactcatacattggtaaaattcattctaagaaaacttggcaaataacgctttggcctggaattggcatttctttctctacttttccttcccaccatttcttccttttaaactacaggatttatattttaaaatgttttatttcagaacattaagatagcagttacattttttaatatttatattattttaaaatgactctttaagatacagttttaaacccatgggctagaaatcatacgactgttaattagccgcattatttggtctaacattttttatcattctgaaactggatttgtgtaatacattgataaattcatacaatttggaagagtcagttgaagttacaaggacccaatatctgccctctttcagtgaatgccggcaaatctgttattccattggcaaaatcgtattgctgctctcctgttaatctcacatttataaaaggatcatgaggctgccaagtgctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattgaaatgcattcattcatcatgcataggcacaatcacagaaatattgcacaaagtatgtccctgactgaaaatgagaggtacaaaaacgtatttcactcttcgtaaagaagtttgtgaggaaatacaactctgcgatcgtatagacatgtttcctgataatacagacattcacaaacagtagattgcaccacagtgtgtaaacattttaagttgcataaacttctccttgattttcaaagataatataatactgtctactaaaattcctttttgtttcaactaagtactctcacatatattagtttataataatgtttgttattactttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatttcttatgatcttcactaaatacattaagaagaatgccaaccagcgccctttcgtgtactgggacaggtagtcatgtgattaaaacagggaacacgaactctgactttaaaatgtattgtagatacaaatgctctaagctaggaaaggtttttcacacccacagccaatgatggcagcctttcattcctcggaaataagccctttttaggtcactgaaaaagagtgcaactgctgcagctcacgatgcaatatcttcatgagcccagagcacatacaaatccaaagggaactgccacagtacactgctcattcttggcaccggaacagatgaaacacactgtatcctgcacatacctgccagagcaggccactttcctcttctgtgagatttagaaagctcccccaaaaggttatcactcccatcaccaatacacagaaaatggaggaaaggctgtttccagttctcggcctttaaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctgaaggatgccagagtgaacatcagtgagagccacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcacgactggctgtgcagtagggttgtcctgggaagaaccctccctggcttctccttgtgcaggctccacgctgttggtgaggctcgcctcacaaagatctttggagagagggaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggc

SEQ ID NO: 1150 - DNA, 58398 bp, Homo sapiens
ttgcaacaatttaaaaatttattgcattacagtagcatcacatcagcagtcaataatgccactttaagcaaaagtctttcagtatttccgttacacattctgttaacaagaactcatacattggtaaaattcattctaagaaaacttggcaaataacgctttggcctggaattggcatttctttctctacttttccttcccaccatttcttccttttaaactacaggatttatattttaaaatgttttatttcagaacattaagatagcagttacattttttaatatttatattattttaaaatgactctttaagatacagttttaaacccatgggctagaaatcatacgactgttaattagccgcattatttggtctaacattttttatcattctgaaactggatttgtgtaatacattgataaattcatacaatttggaagagtcagttgaagttacaaggacccaatatctgccctctttcagtgaatgccggcaaatctgttattccattggcaaaatcgtattgctgctctcctgttaatctcacatttataaaaggatcatgaggctgccaagtgctaaaaatggagatggtctagtaactagaaaactccccaccccagggagcacacctacatatctccctacaacctaataatgtgatgtgttttggaacacagacattagaacttcatgaagttttaactgttgattctttcccaagcatcatcaagttatgatttaggcaatgtatgattgaaatgcattcattcatcatgcataggcacaatcacagaaatattgcacaaagtatgtccctgactgaaaatgagaggtacaaaaacgtatttcactcttcgtaaagaagtttgtgaggaaatacaactctgcgatcgtatagacatgtttcctgataatacagacattcacaaacagtagattgcaccacagtgtgtaaacattttaagttgcataaacttctccttgattttcaaagataatataatactgtctactaaaattcctttttgtttcaactaagtactctcacatatattagtttataataatgtttgttattactttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatttcttatgatcttcactaaatacattaagaagaatgccaaccagcgccctttcgtgtactgggacaggtagtcatgtgattaaaacagggaacacgaactctgactttaaaatgtattgtagatacaaatgctctaagctaggaaaggtttttcacacccacagccaatgatggcagcctttcattcctcggaaataagccctttttaggtcactgaaaaagagtgcaactgctgcagctcacgatgcaatatcttcatgagcccagagcacatacaaatccaaagggaactgccacagtacactgctcattcttggcaccggaacagatgaaacacactgtatcctgcacatacctgccagagcaggccactttcctcttctgtgagatttagaaagctcccccaaaaggttatcactcccatcaccaatacacagaaaatggaggaaaggctgtttccagttctcggcctttaaacagctctaaatgtcagtactcacagtggcatattacaaagtaataaacagtgcacacttgagggcaaaccgcatattgagctatagaagagctcactgtgattaagatgagatcaaacatcatagcagaacattagcaaattttatctgaattctgtaatggacatccatgctgcaataacattagaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctgaaggatgccagagtgaacatcagtgagagccacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcacgactggctgtgcagtagggttgtcctgggaagaaccctccctggcttctccttgtgcaggctccacgctgttggtgaggctcgcctcacaaagatctttggagagagggaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggcagcgtaaccagggccacagtagaatgcagaataggggcgtggccttaatgcttcaagcccattggccaacgagaaagatgacagggaaagggggcgtggccaggcggcagtgtgtccagagggacctgtggctcatcaggaaagctgcccatgcaaccgctgtccccacccactctgagagaggggaggggccgcccgctctgggagagtggaggggctggcttttgctttaaaacccttaaaactttaaaaatcatatgtgtgtatactttatatatatgtgtgtgtctctctgtgtgtatccatgtgttcctccagagctgtcttcattaaccagcttctatgcaaggtctgtcattttggcctatatttttcatcttcaaatactgtataaaaattaccagtattacctgaactgagatacagatcctataaaagtgggaaatccacagcatgcttgatgattaatgaagcagactatattatccaacattccaatgagataaaataatcaaaatgatttcttttttggaaaaatgtttctcttattctcctacattgttgctgttttttctttttaaacaggaaacatggttaatatccgtaaaaacacaaagcttttgggctgggtgcggtggctcacacctgtaatcccagcactttggggagcccgagtctggtggatcacctgaggtcaggtagtggaagtgtgagccatcacacccggccggcttcatttcagaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttggacaagcccattaacagtttctttttttttaggtgatttttaattttaatttttgattttgattgtttcttttctgttttttaaatctagcagtgtttggtaaacttcaacatctctatatccccgtgtctctgccccgctggtctctgcttggaataatgtctcaaggttttagtcacctggaaaaaatttctactcacccttaaagaatcagaaataaataggctgggcatggtggctcatgactgtaatcccagcactttcgggaggccaaagtgggcggatcacctgaggtcagtagttccaagactagcctgcccaacatggtgaaaccccgtctctactaaaaatacaaaaaatagctgagcatggtggcagaggcctgtaatctcagctactcgggtggctgaggcaggataattgcttgaacctgggaggcagaggttgcagtgagctgagatcgtgccattgcactccatcttgggtgacagagtgagacatcatctgaaaaagaaaaagaaaaagaaaaagaaaagcttaaataataccttctctgagaagcctttatatcttcctattctttcaggaagtgttgaaaattcctcaacttttgaaacatttgtgcctctattactgtgtatcaggcagtgaactgagtgcccaggatagaaagatgaaactgtagatcctgcccttacggagctcatggtctagtatggaaaacagccatatgaacaaataaccacactataggtcttcagagctcaagtcctatcctaaatactgtgaaattaatgttctgtgaggttttgaaagtactagggccagagacaatatggctgcttggatgactttccatccaagttaacattcggccctcatcacaaagggaatacatgcgtgcatcttccttgcaacccaccagtgcctaacacatcatatcaccacttttgaaatcaggaaacaggctcagaagtccaagagcttgaccaaagtaactcagctggtaggtagcagagccaggtcagtatgattcttcttcaatatcctgccagccacatgggcaagtggcctcaaaatcaacaaaagacaggtagaggttgacatgcatcaatggagagaggctcaaaaggaggattttatacacaagaatagaacagaaatgttctggaagtatatctgtggatgtgaagcaggagggggcacaccaggtttcaccttggtcaagtgaatctataattccaaccggggcctcgccgccccccacccccccgagctccagacttagctatctgtctttcttactctaatataaaatccacagggcaggaccttaatctctagcttgttcacacagattaaagcagagtctggcttataataaggacttaataaatacatgaatgaataaataaactatcaaagaagctaaagaaacattccacattcttgcgggaagggattaccatgaaacagaccctagcagtcacttacaaatacagttgaccctcatcattggagtatcccatattttcaaattagcttacttgctaaaatgtctttctaagtcccaaattaatacttgtggcactttcaaggtggctcctggatagacatgcagtagtgaaaactctgtcactctttgcacacgtcccaagctaaggtcaaacagtgaccttggtctgcttgtttcaactctcatacaaagatgacctgaggacagagacagtagaggacactgcagggtagcgcaagaagctgtggctctggggccagttgggcggggtctgaatcataacactggcacctgttagtggagtggcctcagacaaatcacttacaattctgtacttcctttattcttttggaaagaaagaaaattcaatctaccaggatgagttgtttttaggaattaagatgataacctatatgacatatgtatttatgtacatatttaccctggaaacaagggtttgctatttgattaattcagtgttccaggcaactttgtagaatattactcctgcaaatagtaagaattggctgtaattaaagaaataacagagatgtagacaaaacaattatttgggtgagctacaggcagtcttcaagaagcttctgaagaaacagaacttcagcaggcacttaagctgtagaaaaggcttgcaaggagatagaacagcacctacagagagaggtccaggtggggtcaggaaatggcatttcaggaagtctagagcagtagaagatgaggccagaacacggcgccacagtgctgctctgcaccctctatacaccctgtactgcagaacctcactctctgcatttagttcttggtttctaattctctcttccattaaactgtgagcccctcaaggtcaaggtctctaagaagaaaccatagctacagtcctctaaatttgaaaacaagttattaaacacagatacacccaagaagaccgtacaaaaataatgttggatttcaattgcagtcatagaaattcacaactggtatacatttgcaatctgtccaggatttttctctgatgactgccgtaactctgtcataaacccttttcattatttgagacaccgagacatttgttagaatgtttgggaaagacattctaaaagggcaagaaagaccttgatcttttttgtgtaactgattgactggttgactgactgagatgggatctcattatgtagcccaggctggtctgaaactcctaggttcaagcgatactcctgcctcagcctctctagtggctgagattacaggcgcacgccaccatgctgggctctagtgtgatgtatttacgaggcttaaacatatggttcattacacaaggctggcacctcagagtaaagattttttaaagttcactctaatagacttatttctctatatgcaagatacaattttaccacagtaaaacacaaggaagcatactgatatacatatatgttacaacaggataaaaaaaagcaatataattttctccacaaaagcttgcaaaatcctggccaaaacacagtaaagaggatgttaatctcacagctcacgtttctccactgagacccaggaaaaacaatgccagtttttgtacagtcacaaaactaagcactgtgagaatttacaagatttggttaacttgtatattctccccaccctgacagacaagtcccaaaggagcctagcagttttaccccaacatttcaatctcctccaacctccaaaataaaaccctcactgtccaatatctcaatttatattttcaaacgtctaaaatcttaatcgaaacaaagagcagtgcattagctttgccgccatagaatgcttggtataattttacttaggcacatcacagattgtgctattgcctaaaaacatatgggtagaaccaacattcctagaaaccaaacgcatatattacgaaggtgaaagggaatagggagtgttgtttttaaacagatagaacgctgtgattgtccactcataggttaggtgtgatcaaatcacatcgtgctgtacagctaagtatgtcctatattgtatgacaaagtagggtaacacattatttattgaggacctgttgggtacacagaggcacaccacaagctgtaaaagacttcattcttgccctcaagaaacttccaagtttctagacagcctgatagaaggtagtcgaaagcaaatacttcaagcactagccatcacaattaccttaggtatttacgctacccttctacgagtctctgaatatttcgaggccccctttcctatttcccatgggctctatggctcaacattctttacagccacaggctttcctggactttacgttattattgaatcaacattgctcactatccgcctcctttgccaattaaaattccactttacatccaaccaccactttggctttgaagccactgcctgatactgacgctctgtcgatgtacaatgactattcttacacgtctctgtctactgaggaggatcctactcttttaacagaaacagtgccattgacttccaatcaactagtttccataatatccaaaatattagataatattccattatactcccaaaacaaataatgagtgatgttctctcaaatacacgtataatcaaatgtgacattgagaagatggggcgacctttgactcagagattgtattcaggcctttgtagatgcatttatttgacataattatgcatttaaaacataagttaaattgtcatcagcctgaaattataggggcttttgttggtgagaaacctattttatatataatcgtttacccatagaaatgtttttgattaatgttatctgttaaagacttcagttcacaatatttcccctgttaatagtatatatgtttttggagttgatctggagaatttgaggaccacgttctaatcgctatctgatgctattctgggaggacaattcattgcctttgggttgctgggggttggaacttgaaggcgggtctgagtctggagaccttgccactgacttttggaaagtctgttgattctacctttggaagtgcctttacatgccttatggaaggccgggcatggtggctcacgcctgtaatcccagcacctcgggattattgatgaataaatcaatttgggaaatgcttggtaaattcaacgggacctctcagaacaatgaatttatatggccacgatgttgttttctggtttgtttgtttttttgtttttgttttttttgcaaagagcattcggaagactttctagtacaccagtttgggaactgttggtggaggagtcagggtaattaggctttggactattccaggtacaggttgtcactgtattcaaggaattgttcttagtctttgtatatatccgaattaactatagcaaattaacaagcagaaatataagaattgggccttggagggagggagagggcgagagagaggggtagatagaagtttcctattttaactatggttcaattctaagcattctaaaatttcattggattcttttaactatgaattacaagggtgtttaatttccaagttcatgaagcctttggttaatctcttcattattaacttctaaccttaactgcttcatatttaaattatcaattttatggtgtggattgtaccaattgtttttcaatcttctgacgtgcttaatggattaatacataattaatgtttctcccacagtccacatatgcttgagaagaatacagaatatctgattattgggtacagaggtctatatttgtccattacatcacgtccattcacgggttattcaaatctatatatgggcattctgtgtaacttacttatggtaagcagggtatgttgaaatctccaaatacaatggcagactcgtcaatttctccctgtggttttatcagtttttcctctgtattttgagtctattttgataggtacataaaatatgaaaattgctacaacctcctaattaacagtcagttggcatcaagctgttactaatgctttgtgttccaacatcctatcttgtttgaaactgaagctccatcagttgttttggttaatgtataccggcatatctttctctctctctctcctttataaaaactttcaatcttttcacatcctcatagtttcaataagatggattagaacagctggatatcgttttattagttccatctgtctaactggtaactttagtccatttacagttgttgtgactcatttatgtggacttccttctgtcacctttagaacttccatttctctcactttccaatataattttaatatctcctcctgggattccactaagacgtattttagacctcattctgatctccctctccccgccaaccccaccaacttctgccctgtcatttatcctcatatctctctgtgtaacatatggacttactttttggagataatggtctaaccaattaatcctttcttctggtgtctaatccatccactcggtttcttatttcaacaattccattttatatttccttatttcattttattctgagacagagtctcactctgtcacccaggctggactgtagtggcacgaacctgcagccctggcctcctgggctcaagtgatcctcccacctcagcctcctgattagctgggagtataggcaggtaggtgccccatacacagcttttttcttcttcttttttttttggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggagaatgtcaggattacacaaggttctcaaatttggctccccaaccttgctcatttatatacagaagactagactgcttagtataggtgatgactcacttcctcctaccctggaaaaaacaaaacagatctctcatctgaatgtgatcacagactaggaaattctgaaggtgaataactggaggctgtaggcagcagggaaagacaggtgtctttcctgaccatagaaataggtcacaagctgccctaaaggctgtgtgctccaccaggatttcactatttagctcaaccagcagtccctctgtaagagtgaacggaagcttcttagagcaccacgctgcctttaaaccacaaattcttgctaaaagtcatggtcatggtaaaaaacctatggctttgcaaggctttcttggtaatgtcctagaattaaggttaagcctgcgtttcatggtaactgaacaggaaaccagcctgaccaacatccttctccccaatggcttgctctcagctcctcttgcttgggccttgggcagccagacggtctggttttaatccttgctctgccacctgtgaccttggacaagttacctaccttcagttacctcatccacaagatgcagatattagtaataccctctttttaagttattaagaggattgaaagagttaataaaaagtaaaaaaaagacttggtaggcataggcacagaggcgggaaaaaagcaataataaagaaatgatacttctatattttctatagatcatctttgtaacaagaagaaaacaaaccaaatgaaaatgaaacaaattctctcaaaaagaattaagtcaagacaggcagaaggctcacaaagtaatataaaatatatcttatggtttatggaaaattcttaataaaataccttctttgctccaagctgcactctggctttgcctttgagtcacgtggcatttctttgtacgatgaccggttctgtcgagtaggcactgcttcagccctacaggaaggaaaaaacatctctagaaaacagcagcattcctgattcccacttgaggaggcctaacaaaacggcatatgcctcaacagcagcacatcagtgttaaaaagtctggagtcaaggggaaaaagtaaaattggaccatttccagaatctcaccaaaaacaacaaacggatgttgcaagtggcctacatgagcaaattagaaccttaaataaaggtcactcttaatgcctatcccagcatagatgcagcaccaagtacagtgtcattttactgggttacctttttcattcttgaaagtaggagctatgaaaaaaaaaacactaaaatttcttgaagagaaccttctacttacaacctaacttacgtaatcgaaacactctattgagggtgaaaattgagtattataagaaaataatcacctgttttgtgagaagttcaatacgtaatgctcctccacacaatacataccttagaaagaaaaaaggaaacatacaaaactatctcgagaattattcctgcttaaacaatttctacatgccattactaagaaagtatgcacacagtaaacatgagaagagaacatgcaagcatgaacatacttgttagggatacaggactatgggtaacttaaaaactctgttggtattactctcatgtaattgctctgaaattctagtcaactatttgcaatggctcttagaacagaatactttgaatttttatgatatcaaaaactaagaacttagccaagtattcccaagaataggaatagtaagcatacttagtaagtattccaaagaataggggcagaagaacgcatttctttaaagcactacctcagaattcaatttagtaattccgatgctgcctgtaacatcagaaaacaacttccttaaaaacatagcaagttggatttaccaagttgctgaccaggtcgcattccctcctgccctcaatcccatctttgtgttatactttatctccagtaccattttgcttagtattcatggtgctcaagttgtcactgtggacatcagagcctataaatatatattgttctggctccttcctgtacatctttccaagtcatacctgctattctccaaagtctgtgaatcccgacactaataacttggaaattcagtttaaggtcctcttcagaaggtcagttagctcaaggcatcacatttttctcaggactcttaagaaatactccaaccacagaaaaaggcccttctttctggtatcaggagccattggccacaaacacaaatccaatagagtttcagccatttacctcccacatcgtcccttccctgaagttctagctaaagcaggaaaaaataatgaaaacaccacctgcagtcacgaatcctccagtttcctggccaagatttcgtatttccttcaagatacctcccaaagaggacatgacgagggaggggcacacagggtgctacaggtactgataaggttttatttcttttatatatatgtattttttgagacggagtttctctcgtcaccaaggctggagtgcaatggcacaatctcggcccactgcaacccctgcctcctgggttcaagtgattctcccagctcagcctcccacgaagcgggggttacattacaggcgcccgccaccatgcctggctaatatttttgtatttttagtagagaaggggtttcaccatgttggccagcctgctcttcaactcctgaccgcaggtgatctgcctgccttggcctcccaaagtgctaggattataggcatgagccaccacgcccagccaaaggttctatttcttaagtttggtgttgggcatatggatgtatgatttaatgttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatactttattaaatataacacatacattcagaaagttacataaaatatacctgaaggtataccttaacaagttattgtaaattatttgcccatgtaaccaccaacctggtcctgaaatatattccagccagtatccaagaagcccacagatgtccctttcaggtcacacatccctacctcccacctggatggactccttcccctaacctctatgtgatcacctctttgttcttaatagttttactgcccaagtatgaatccagaaataagtgtttctctgttttcttttcacttttgtccccctaagaagcctttttagaagttttcttcctaattctatccccactccccatggaattttaacaccacagatatactgtatgtcggtttatgttatacggccctttggagggcagcagaccattataataggtaagattttctttcactctaaggaccaattttcactccactgcaggcgatattgcctccactaagaatgtatgccctaaccaacattagttttccctattgttgaactctatatagaggaaattgtacaaaataggttttggggctctggtctctttcgcttaacatagtgttcaaggttcgtccatctttcccacatagctgtaagccattttatgaataccacaattcttcattttcttggaatgaacacctgggttactttctgtttggggttatgatacatgatgctactctgaacattccggtgtctcctggtgcctatgtactcatttcttgtggagtatatatccacaagattcctgaaccatagtgtatgagtatcttccactttaccaaattgttttccaaaacacttgtacaaatatacactcccattagaaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactcccttttcgtttgtttgtttgtttgtttgttttaagagacaaggtgtctcgctctctcacccagggtggaatataatggtgcaatcacagctcatgtgcagccttaacgtctccaagctcaaaagatcttcctgcctcagcctcccaccatccatagtagcttgtactacaggtgtactacaccgacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatctcacttcctagatatgtaaccatgacctcatttcctatctataaaatatgagaagtttctcctatctctaaactatgaagagcacctatttcacacagcggctatgaagactaaatgagagcatctataaagtataaagtacttaacatagtatcggtcatgcaaaagtgttcaataatttatacttgttttgaagataactcaaactggaatcgatcacaagacacggaaagtacagtaacattatttcaaatgctacaaactcagttttttaaataagatatgagaaatggactaaatttctttcctctgggaaaaattactaattaaattaatatataactaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatacacacacatcattctcattgatttttcacagcagtcatccaaaaggtatgtactatctatccatactttagagttgagcaaagtgaaaccaaaaaaggtgtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgtggctagggacggtggctcatgcctgtaatcccagcactttggcaggctgaggtaggaggatcgcgtgaactcaggtgttcaagaccagcatgatcaacatagtgagaccccatctctactaaaaatctaaaaaatcagcctggtgtggtggctcatgcccatagtccaagacacttgggagggtgaggcaggaggatcactggagcccgggagatcaaggcttcagtgaactatgattgtgccaccgcactctagcccaggcgacagagcaagaccctgtctcaaaaccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaatttttatttccttttttaaaacagagtctcactctgtcacccaggtgggcgtatacaggggtgatctctgctcactacaaactctgcctcccaggttcaagtgattctcgtgcctcagtctcctgagtagctgggatttcagacacccatcaccacgcccagctaatttgtgtatatttttagtagagacagggttgcaccatgttagtaccagcctatctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggtggttgggcatagtggctcaagcttgtaatcccagcactttgggaggccgaggtgggtgggtcacttgaggtcaggagttcaagactagcctggccaacatggtgacactctgtctctactaaaaaaatacaaaaattagccgggcgtggtggcacgcacctgtaatcccagctactcgggaggctgaggcaggagaattgcttgaacctgggaggcagaggttgcagtgagcaaagattgtgccactgcactccaggctggccaacagagtaaaactccatctcaaaaaaaataaacaaataaagccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacattacactccacacacaccacacatcacactccacacacaccacacgcacatatcacattcacatcacaccacaccacataccacacaccatacacagtacactccacacaccacaccctccaggacgtcccaccaccatacacacacaaacaccacacacccacaccatactacacatttaccacatacacaccacacacactgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccaggccccctctgctcccacctctctctcccctcccacctctctcccccctcccacctctctcccccctcccctccccagaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactctgccgtcatttttttaaacattctcttatttatgggtacttaggttgtttccagttttttaagagattgcggcaatgaaaatcttcagctatcatttttcacagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaatgtgtgtgtgtgtgtgtgtgtgtgtgtgtgtgtgtctgtgtactgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctgggtttttttttttttttttttgagatggagtcttgctgtgttgcccaggctggagtgcaatggcgtgatctcagctcactgcaatctctgcctcccgggctcaagcagttcttctgtctcaacctcccgagtagctgggattacaggcacccgcaatcatgctcggctaattttcatatttttgtagagacagggtctcaccatgttggccaggctggtctagaactcctgacctcaggtgatccacccacctcagcctcccaaaatgctggggttacaggtgttagccaccgcactcagccttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttcacatgcaatagaatttcattcaccctgaaaagggaaggaaattctgacacaggctacaatatggataaaccttgaggacatcctgctagagccagtcacaaaaggacaagtactgtgtgattccacttctctgaggcacccacagtagagtcacagagacaggaagtagaatgcgggtggccaggggctggagagagcagggagtggggagctggtgtttaatgggtgcagaggttccgttgtgaagatggaaaagttctggagatgcatggtggtgaagacggcacaacagtgtgaatgtacttaatgccactgaactctacacctaaaaatggttaagatgataaattttacattatgtatatttaccacaataaaagaaataagaaataaaaggtttttggatgatgaacgggctcgagccaatttggaccctctaaagctaagttgagccaggctgaacccatgtagccagaatcatactggattaggctgttctagcacttcacgtggtgagaatgggggagagagagagagattgattgatcagggggctgtgcagggggcgtgctacacacttgtaaacagccagatctcttgtgaactcagagcaagagttcacctatcaccaagaggatggcccaagtcattcatgagagatttgccccatgatccagacacttacctcccaccaggccccaccaccagcattggggattgcatttcaatatgagattgaggtggggacaaatatccaaactgtatcacccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtagtaatacacttgtaacataaagtttaccactttaaagtgtacaattcagtggcatttagtacaatgttgtgcaaccacctctgatatttagttccagaacattttcactgcccccagaggagaccctgtacttattaagcagtcactcctcattcttccctctccccgcagcccccacaatgaaaaatctgttttctcactttggatttgcctattccggatattccataaagacgggatcagacaatatgtgccctttagtgtctggcttatttcaccaacataatgttttcagggttcatccctgttgtagcacgtgtcagtacttcgttcatttctgtggctgaatgatattccactgaatggctatgtttttattttcatttttactttttgagatggagtttcactcgtcgcccaggctggagtgcagtggtgtgatctcggctcactgcagctgaagggctatattaagtttcatttatccattcatccactgagggacatttgagttgtttctaccttttgattaatgtgaattctgctgctgtgaccatgtgtatacaagcttttgggaaattttatttggctagtcgtaactttaagttttgttttggctatttattgttgcttaaccaattatcccaaaacttaatggcataaaacggcaaatttgtctctctctcactattgtatgggttaatgggctagctggacagtttttctgctggtctcatttggcagctctcactgtgcagttagacagtgtcagggactggtcgtctggatgctcagctgcagtggaacgtctgagacggcttcttcacccacaggtctgctgccttggtgtttcttcatgtggcctttctacatagcatctcatactcttggccctcttcatgtagcttctctttctccaagaggatagtcagttcttctttttggcttccagaagcacaaaagtgcaagctgtcagatgttcttaaggcttagacctagaacaggtccagtttcatttctaccacattctataggttaaaggaagtctcggagccaaccttgattcactgtggaatgggcccttccgaggacctgaatgacaggagttgtggctcattggggaccaactccaaagatgaagcctgagttctgagaactttttcttctctgattactccttattcatattttatgttttgttttatagatgtaatatattcacaagtgtctttaaggagctattttgatactcttttgtcctctccctagcaggtcttttttctttaataatttttttcttagtttattttggtcttagttttctttcaaaagcctttcccaaaatatctattctatgttgctcatcatttgtcatcttttttaaaatgcccccttttgttcattcatatttgagagaaggactaaaagactgactgggaggctgggtgtggtagctcacatctataatctcagtgctttgggaggctgaggtgggaggatcacttgagcccaggagctcaagactagcctgggcaacacagtgagacccccatctctagaaaaaataaaaattagccggatgtggtggtgcccgcctgtagtcccagctactcaggaggctgaggtgggaggactgcttaagcccaggagattgaggctgcagtgagctatgatcatgccactgcattccagcctgggcgaaagagtgagacattgtctcaaaaaataaataaataaataaataaataaaaaagaagtttgggagttctttctggccaagacttgtcaactgatagcttttaggggaaagggtttttagggggaatttatgctgattcccaattgttatccccacccctctatcttatctctttgcgcaatcataaatgatggcaggaactactccattcctctggaggtgaaatctacgttctcttgcctgaggtagatacatgtttgctggggttctgcttaaggaaatgtgggagaacaatgtgtttcagggcctggaaaatgtgttctgtatgtaggcttttggttaatctgttttcagtcttgcctatcagtcccactctccggggtacctggtgtcggagtctagtgcctctgcagggtactgtgggacaaattagcctccttgttatcggtatccccctaacctccacctttgtttgctttgcttcattaattaaccatttcccatttactgtcattgtctattggaggtgaattctcttctcttggtaaccccatccctttttttttgtaattgtgtgtgtttatacaatctttattcttcactgtaattcccatggagcctcaggaaaaagagcagatgggagaaatacgtgttcagtgttcagttttccttctgtaagacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagatttttgccccccatgggatgtttggaaataatctggagacattttcggttgtcacaactggtcatgatgggaggtgctattggcatctcttgggtagagggggtgttactaaacgtcctacaacacacaggagaaccctccacaaattgtctggcccagtatatacacatcgctgaggctgagaaaccctggtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatccatttctctttttttttttttttttgagacggagtctcactcttgtcgcccaggctggagtgcaatggtgtgatcttggctcactgcaacctccgcctcccaggttcaagcaattctgtggcctcagcctccctagtagcagggattacaggcgtccgccaccacgcctggctaatttttgtatttttgtagagacagggtttccccatgttggccaggctggtctcgaactcctgacctcaggtgatccacccgcctcggcctcccaaagtgctgggaatacaggcttgagccaccgcgcccggcccttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccgtttctttctttctttctttctttcttttttttctgagacggagtttctctcttgttgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcactcacatgtggcacctggagtcgtcaaattcagagacagaaagtagaatggtggctgccaggggctgggggaggcggaaaggggagttagcggacacagagtttcagattgcaagatgaagaaagttctggagatggatggtggtgatggctgcacaacactgtgagtgtatttaatgccacagaatcatacacgtagaagtatttcagatggtaaatttcatcttttgtgtatttaccataatttttaaaaactaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcagaggagttcgagatcagcctgggcaacatggtgaaaccccatctctaggaaacatttataagtcagctggatatggaggcacgtgcctgtgatcccagctactctggaggctgaggtgagaggatcacttgagctcaagtggtcaaggctgcagtgagccaagatcacaccactgcactccagtctgagcaacatagtgagatcccgtctcaaaaagaaaagaggttgccagattaatccagtacacacttctttaatcccgtagtaaattttctctttatagccaattcccaaagtcaagtatattgactcataaaaataccttctgggaagcatgtgactgatttccagctgagaggccctgccactggatggttaagttcataggccccagagtcagaagggggttggaatctcccctctgccatgcctgctacttggccttgtgtacgctcgcgctcgtgcgcttgtgcgctctctctcgctctcgctctctctctctcatgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagcggccgggtagggtggctcatgcctgtaatcccagaactttgggaggccaaggcaagaggatcacttaagctcagcagttcaagaccagcctgggaaacttggaaaaaccccacctctacaaaaaacacaaaaattagccaggcgtggtggaccccgctacttgggaggctgaggtgggaggatcacttgagaccaggaagtcaaggctgcaatgagccgtgttcgcaccgctgcaatccagcctgggtgacaaagtaagacagtctcaaaaaataaataaaataaataaaataaggcttatctattcaaaggaatataggagaaaggttggcggagaatgaaaaaagaagaggaatgaagaggtaatggccctttaagataactaagtcttaccaaaagccaccgtaacttacacggtagatagtggcacaacaataaagcagtaaattagaatggagaatccagaaacacaggagaaacactcagaacacagcagctacttaacccatgacaaacctgccaaaacagagaggtcaaagtggctgactaggaaattaggttggaatcctataaaaaaaaaaaaactacatccacaaatcacaccgtatctaaaatacattttagatcaaagaagagatgtaaatgtaaaaaaatcgagactatcaagtattagcagaatatgcaggagggtggttatatacattagggtacagaaacccattctctaagtaagatacaaaattcaggagtaattaaagcaagcttgatagttttaacaatgtaaaatttccaaatttttacattgccagagatgtctttaaacaaattcaaaggacaagtggcatctgagagaaaatatccgcaatatatatagaaaatgaggaataaccctgtgtaccaagaacacctagaaatcaacaaggaaaagcttcacaaatcaagagaaaaacaggcaaggatgaaaaagagaattagaaagagaaattcaaattagtagtaagcacagaagaaacagcttcttataattcacaatttttacaaacacaaaatgaaataagctatcactttacacccacttgactgaatgaaacacaaagactgatcatgtccagagagcgtcgatgtccagagagtgtcgatgtccagagagtgtcagtggggacaccgctgccccacacactagcatcatttagaatggtcaccacctgtcaagagagcaatctggcaatatctgttgacactctgaatgcccaaaccattcagccccgcaagtccacttctaggaatctatgctacgaaaacaaccccatgcagatgcaagggtttaatgtacgagactccacctgtcagcattctccgtgagtgtgaaaaacggaacaacccaaaagttcaataaataaacagtcacatattatgcaagcgtcagaataacgctgcttgcgcaaaggacaagggaccatctctaagacacacagctggtgagcggatcgaactgcaaatcttatttacagtaggatcccactttgttgaaaaatacttttaaaatatgtatgtatttaaaagacaagtaaaatacgtccacagacagaaaaagaaaacgggaggaatcgccaccaaactgtgaacaatgattatctttgtgggcactgaatggggcagtggtgaagttagggggaagctttcattttctattctacatgatgcatttctgtaaagttctaatctttataattagtacatttgaatttcataatcagaaacagatatttaaaggatctcaagatctatgttatatagctctatcatatgttaggcgccacccccgttgatggagccagggtccttctcaactccaaattccactgccagaaaaatggcacctttcttctccagagatacaagataattgcgagaaggcaaaatttttttaaaacagagacatcaagccaggtacagtggcatgtacctgtagtcccagctactcaggagaccgaggcaggaggattgcctgagcccaggagttcaagtccagcctagagacaacatagcaacacctccatctcaaaacgcaaaacaaaaactacagatggcagatctatttaatgattagctctggtggggagcactgcccctcagaccttgacctacccaagcagcctctagttgttaaagacttctcagtattggagaataaaacaaaatagacaagcactttaaaattcaccagaagttaggccgggcacggtggctcacgcctgtaattgcagcactttgggaggctgaagcaggcagatcacgagatcaggagatcaagaccatcctggctaacacggtgaaacctcgtctgtactaaaaatacaaaagttagccgggagtggtggcgggcgcctgtagtcccagctactcgggaagctgaggaaggagaatggcgtgaacccaggaggtggagcttacagtaagccgagattgtgccactgcactccagcctgggtgacagagtgagactccgtcacaaaaaaaaaaaaaaaaaaaaaattcaccagaagttcccaaggaatttgcttccacacatagaaaataatcgagtccgttttttctgaaaacttgctttaaagtccaattgtggggatttgatgtagatggttccattttaacttcttcagccagaggaaatctaaaaattcttccttccagctcaacagagcaaatccacctactgctctgcaaaaggaggacaaagatcctcctggggccgcagaattcagcagcttttccttggattcctaggacaaccaacagctgtgggacactaggccaagcttcaaaaggcagcctgccagccatcggactcccaggcacctgtggagtcctaggcggttgaggaactgggggagggcttggtttcaacctatttgccaaatcaccagcaaaacaagacatgttcaaaagaaacaagtgcacataaataagccagggctctactccccagcccatcaggtcaccggcccagcccctcagtgtgctggtgagcaggacaatcagaaaaggcctctcttcctggaataactaacagtctctcaccatccccactcccactgcccgatgtgtcatgggaagtctctgaaattcaggtttgggaaatcagttgacatgaactacagcataatattagatgtctgattaaaatcatcaagatgatacaaaggtctaatcgcagaggtgctctccactcccaacccccacatcaaatggagctttctctccttcaaatcagacttctttttttttttttgagagagagaagttctcactctgtcacccaggggagggcagtgacaccctcacaactcactgcagcctcaacctcctgggcttaagcgatcctcccacctcagcctcccaagtagctaggaccacacccgtgagccaccacatctggctaatttttctatttttttgtagaggtgaggtctccctgtgttgcccaggctgatctcaaactcctgggcttaagcgatcctccctcctcagcctcacaaagtgctgggattacagcatgaaccaccgtgcccagccttcaaatcacatttctaaggagcctaacaagcagcaggcctttccagttacagcgcatggaagtaacaaaggcagcctcagccagcatccagcgcagtcccagcagacagggataatgaagcggacgtgggcctcacgggagggaatactgtcccccacctccacaccatgctagtgagaaaaacagactgcctgcagctccaaaacatacagcaacttacctatcaaacagggacctctgacgcttcacattatcacgtaagaaatgtttcttgcccagcagcccccagaggatgaacagctccctccacctgaaaggggaagagggcccaagctgcaggcgccctggcctatcgaggccgtggacaggaggcacccgaatgtctccccagaccccaccctgctgcagaggcctctgcagcccatcaccctgcagcgctgctgttcccgctgcttcttggagaacaggggcaatttaatctacaaatcctgtaaatccttgttaaaaaaaaaaaaaaaaaaaaagaagggtaaaataaaacgtctgcactagcaaggctgggacttggcatcagctgccacctcctacagaacccagtggggagtgggctccagagcctccccgtgatgctggcagtgcctcggccagacacctgcccccgccaccctcctgcgtcctcactgcacccctccccaccccatgtcacatcttctgctcatacctccccacaccctcctctcgcctctggatgcacctctcaacacgcccctgaccgcgtcttcctcccatgctctgaactgtccactagggaagccagctgcagaaatcactctcctagaattcacttggtaaaatatgtgttgttattggcccacctactttgctcccaacccacagcaagggctctccagggctaccaagcccctaatggtcaggaactgccccccaacccccatctccagctctgacctacacaaactacataatcctgctgccaaaaacttggccctccctatgcccagggtgccacactccaggctggcccttctgccgagagggctcttctggcctgggctctgaacgggcaaacccacccactcttctaggatggggtccatgatccaccccaacctaccgtggggctctcacatcttccagactgtgcctctctaggagggccttggacccagagccagaatggggctctgatgccactgcacattctccagcaaccccttccatgcccttcctcctgatcccacccagctctaaactgggaacaagaaagctggaatatagtagcttctcagaaaatacctactgagtacacggctggatagatggacagtgctccaggcaaagggactcgggggtaagaaaagtgaagggtacctgctcccggttgtaccactgcagagtccttgagtgtcaaaggactgagaggtgaatgacgggcaaggtgagacctaccaggttagtgtcccgcacccctttgtttccactattagattaagccaccctatgtgacagataaaaggagcaacacatacaaggagttaggccggggttgccaaagtgaggagtgggaatgctgccagtccaggggtcccccacggcagctccccaaatgaaaccaagacaagttggagatgaggctgcctctaggtgtatcaaatcaactgaagtagcaccagtcctcagtgctgattaagcacaggcacgcctgtgatcaagaagaaaaccattacttaataaaatgcagttaatttagaagctgaaatctgtgaaagctcaagggaaagacacaatcaggagttcttggtctggaggggcttctgctctcaaagcttccaacccaacacagcacaaagacgtcttccccaacaaccgcacatcccacctgcaaaacgatgacacgctcctctccaggtacctgaaccttaggactcaaagggtagagaaagttcacaggcagaatcttcacaatacatgcacaaaacaaaggcacttctagtaggagctgtgggtcaggaaaatctcgacttcacccaatgccattcccgagacaatcagccatcaatctgacccactcagtcctgcctcaggggctcagaatctagcagtcaggccaggtgggaagtgcagggacctgtggccaaaatcggcccactcatcactcagctgacagctttcacgcgtactagccagaatcagttagaggctggaggtagtgccaggtgtctgaaacccagcaggcaggttggtaaaacactcacacatcctaaccctggtgactgcactgactgcgtgctttactgtagcagaacagttgcacacatctcatctcctccatccatagtaactcagtggctggtgaggaatgggacacagacctccacgtgcccttctcgggatgagtcaagacaaactctgagcagtgacgctctacagctggctcacacgtggaggcagagcctggcttcccagagcttccagttcctaacacacgcctggccccactgcaccacacccgtgacagctgccaccagctccggataattcagacagatgctagagcacatggctcacttattacaccaaaagactgagaaacagaaactgtgttttaattgtacaatgcacacacttgcttccagagagacctgagaaatccatcatccctaaatgcatgcggttactcaactagtggctttactatttttgaaacaatggatttttccaagacagttgataatcaaaccaactgcgggaaaccataaacgatacttgtttattaaattaagaacagatacaacagttcagaggaattcatatttagagctgccttgctggagaatcaattccaggaatgccaaaccaaccaaatgaaaaaaaattatatatatatatatatatacatatatatatatatatatatatatatatatatatctcacacacacacactcgtgtcacttaacgacaggcatatatatgtatatatatatcacacacacactcatgcgtcacttaacgacagggatgtattctgagaaatttatcattaggcaatttcatcattgtgagaacatcatagaacatacgttatacaaacctactacaacacactaggttatagggtacagtctactgctcctaggctgcaaagctaggcagcatgttactgtgctgaatgtgtgtatctaaacatagaaaaggcacaacgttaaaatatgctataaaagataaaacatggtgcccctgtctagggcactttccatgaatggaccttccatgaatggaagttgctcgggtgagtcagtccgtacactagtgcagactttatagacattgtatacctaggctacattttaaaaaaatatatttttattttttaaatattttatatatttttttaaaataaagtaactgcactacaactttaccacaatgtcactaggcaataggaatttttgagccccatgatattcttatgggacctctgtcatatatgctatcattcaccaaaacaatgtcatgtgatgcatgacagtacatatgtatctcaactgaaaatcctaaatgtcaatagtgttctccgactcactatttactaataagagtttcctcagaactgtctttgcctgagagtttcacgaccaaacgtctctctgcacagttgattctagggacaagaagtgctaagaatccatgttggcttcaagtgcaaaatggaaaacaccttagtgtcccaccaaccacgtcagccaccttcctggagggctagctcccagacccttttcccatcgctgtatagggcccacgtcatctgtggcatttccacgactctccgatgccagccatcagtctctcggcttgtgttgaaaattagcacctttacgtgcccaccagtggtcatgagtcctagtcatgcccaccctgttaaaaacaaatctgatacaaaatgggccccagcaggagacagggacagaacacggacctcacactctctccagctcagactcaaaggccagcactgccccatcacagccgagtgctcttaggcaacccacagctcagctacctgtccccagcctcctcgttgcaaagttaagacaagacctgccttctagatttgtcgggaaattatttaaaatgataaacaaagagggatggaactcaacacacagaattgcccgatgatgtgtgtttcattccagtggtttcgccatcaaaaccatctttaaatgttggagtgtttccgtttccagacaactagagatgaaaatattttcacagtcactcaacgcaggtacctcaaccacgtattttttctcttaattttgatccttgaaacacaaaacaacagatgcaccaccttacattaaaacagccctttagagtttagagtttatgacaggccgcctctgcattctctcactaggccgtagctgtaactcacaaacctgacccttaaaactcccaggacaataagagaagccacaccatggagctcttgctgtcataaaatatctcgcatcagttcaatattgcatctcgtctgtgcctcaaaacaaccacaggcaagaggcctcacgcgggtattgcagatgctgagaaagactctcaagccagaagactggtcctgggccccagggattagtggcagggccaggctggaactgagctcctgttactccaaatcccatcctcttttctgacctcccagtccctttctcataaaaccaaagcatcttctccaaccaggccaggacacacgcaggagagagtcaggcaggaggaggcttctggaagggaaagcagagtggctgagagccctgggacagagtctgacattaggtacaggacaagtttggaaagatccagatggagcgggaagggaatctgggcgtgggggtgcctccttccaaagtgcatccacatccgaggtgactgcagggagacgcagcgctgactttggcagcagggaccacccgggtgcagagaacccaaacaactgaaaatccaaaaaggaatctcagtgcacagtaagaaagctcattctttgggctggttaccttcccaaacacgttctcctctggcctatgtgaaaccgacgttgcactgtacaactctgaagctctttcttgactgcccactgaatgagggtctgtgctacattccaggaggatccaaatgtgaacacagctaggttccagctctgggactcgggaaaaggaggcacaggcagcaggacatgtgctgcaaggagactactgctcccgtgtttcattcactcactcatccaacaacagcactaaggctctgctgtgtgccaggcacttttctagctactggggatccagaggtgaacaaagtcttttacaattgagtggtaagagactgacaataaacaaacaagtatataaataacacactgaatgttgagtactaaggagaaacacaaagcaaggttaacaagagaaggggaagtaacgctaatttatgtagggctgtcagggagccggcaataagtgaggggccggccaggtgggcatctgggggtggctgatgccaagggggtgggaacagcaggtgcaaaggcctggaggcaagagtggcctggcaaatccgaggaccaagggataagatgaaagagcctacattcagttaggatctccgggatggacatgggccaagatgacaggtggggatggggtggggacaacccagggcagatctgggcaatgagcctgtctgcctggagccaggagagcctggaggggccattcttgggagcgagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagaggcgagaaacgacagtgcccatgacagctgactcagcctgtgccagcaggctgctctgagacatgagctggacccaacccaggcggtgggcagcaggggggtggggaggaactctgggaaaggaaggagccagagaagtctccctgtgggcgctcgggccaaccaccacccaagggaacaatgagcacccccagcccccgatgggcacacaggctgcctcctggtgagcaagcgtctcaaacctgacctacatctgggaggcctgcctggtcaccagggactaccttacaccctacctgtgcctccacgtccccagtgctcacggccacctggcaagggtgaggaactgagactgcgttgaggacacacagcctgtgagtggtacagccagggccgctgcccaggcccagagctctctccgtttctctaaggaccaggctgcaaggcagggcatgtgatctctgccgaagacattcaagccacccagtgatgtgtgctgggcctcgatccccaccgaccgccagtcctctcctcccctggacagtaaaggtttctccaagacttcagacgacggtgtcacctgaggccctcacctattaagtcaccggggcaggtatgcatggcagaggacacggaggagtgccggagaggagctgaggcctggagggggcctctgcagccaggctcaacccccactctccccactccaacagccctcactgcagccaccgcggcccaatccaaacaaagcccagcctgatgccaatctcaccatcaactgtttttcctctgacttcctcagttttgtctaggaaaaatcaaagtgtcttatcccatctctaagcttccaggggtgtgatcagtgtcttttacaattaccttttacttttatccagcatttcttagctcggttggcaaactggatatttatgcacctccatttcacaatccatctccaccgattattcctgtaaaacatttttttttttaaagtttagagttacttaagaaggttatgtaaacaagttaaccagcaagccacaacttgggtctgcggtgtcagagaaaacatgcaaggtgcaagagaatgaggagctgatggtcaccagctttacctccttccagcacccactcctgctcacacacactcacaccccgtgggactcagcctgcagcttctcccagcccaagagccagacagtggggaggagcacagaccacacttcctaacaaatgagagggaagacttcgtgccccattgctactgccatcacccagtcccagcccagagagggagcccactccaagggcccccctgccagtactgctagagcccaccgagggctgccagcacacagctacgagctccagctttatctactcacgccctggacactgcccggagccccagcaggttccacgtgtccttgtcaccccagccctcctgccccgcggatcctaagctcaggagaccctctccagcccaggctgtgggggaaggcagcccccacggtcacccaggaatcagcgcagagtgcagggcatcctggactccccggactgggaaacccagttcctgtccccctgcgtagtggccacacctctgggaggggagaaacccctgcctcacctcactggagggaccctgacccagaggcctgagaaaaagccaccggcaggctcctggcacctgccaacctgcaccttaggaaaacttgtcccacttcaacctgcaaagctctcaggtcattacttctaaaaccactgtcctttctgaaacaggaaggaaaatagaaaaacaaacaaaaacaaagaggcacagaaggctgaagacgccagaggcagtttagcccaaaaacaaagtgccagacacaagatgccaagtttggggcgcttcctccaccgcatgcctgtttaggagctgactgcactcaaccacagatttacgtctggtgcctgccaggtcgttatctgaagagatctgaaaaagtaagcctttcttctgccagtaaatactaagttaagactagcaggcccctctaaggctctgctctccactggggtgctgcaggacaggcccctccgcgggcgttccccgcaccctccctccgcgtcggcccggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtcctcgccgcgccgccgtcctcgccgcgccgcc

SEQ ID NO: 1151 - DNA, 146303 bp, Homo sapiens
ctgcgggaggacagggctcagacgctggggcccctcccatagccctgcagctccccctgccgtgccctggcctcccactcactgatggcatctctctctccggtactggatgaatccaagttccagtttctccacatgctccctcaggtccgccttctcctccaggaggtccataaggccgctctggagccaaaataatggggtcacatctcagcagcgacctgccccagccctgcccttcttggcccatgctaggactcactcccctccagcttctccatgacttcctgcagggcccggagggtctccccactcacagactcgcccccagtccctgaggctgggactgctgcctctggctccttctcggccgaggtgagcgtctccatcacctggcccagcttctcctgcagctcctttacttgctgctccaactgcagtgcgctcttgttctcgtgcttctggacagagagaagcaatcagcagccacccactgcagctggagaccccagaacttggtgtctgcctcccatggcaccgggaagggtggagccaagttagaaaaatactctcctctctcccacagccaccagagcaaagctctggctcacaggtgcctttggaagtaatatttcatgtgagggctacactgccccattttacaggtggggaaacaaaggcctggagggctagggaggagggcaggctccccaggtggggcaacccaccagctcctccaagtcgctctgtggctcggccagctgctgaagcctcttctcccgttcccgaagcctctcctgctgctcctgaagcctctcctcctgctcgcgaagcctctccttttgcccacggttcaggagactgatgcactgattgttttccacctgagcctggagctctcctgccactctctccagctccttcctcaggtcttgcagctccacctcagaggacactgctggggcatccgggggcagtggctcagctgagaaaggaagcagatcataagggcctctggattctcaaaacaaaaatcaaaacagaaaaaacaacaaaacaccctcctgttggcgcacagctcctctcaggctcccaaacttggcttcactgctaacgatccctcgcacccggatggtagccagtcttccaaaccactttcagatagagagcactgcgggtggctgacaacgggccctctttgctcatggggacactgaggctcagggagatgacaagacttgtctcctggcacagacctctttccctctgcctcaaagccctgccatccacccacctccctggggcactctaagccacccccacagccctctgatgccagtcctgctcccaggtcatgccagccccatcttacccatctggtttttgagtctggacaagctcctctccagctcctctacccgatgcgtatcatgcttcttctcctccttcaatgtgcaaacctgcccaaagcacagggggaaagggccctggagagaggggctggtggctggacaggctcccatctccctctctgcccccacctccacaaagcccagacccaggaccacctctggctgcactattcccattttaaagaggcccagaaagatccagtgacctatcttaagttgttggtggggggggggtggggcgggaggctgaagggtcagatctcacctcctgcgacattttcctcatcctctgctgccactgggccctctctccttttatttgttcagcatattgatctctctccagctggacttctttaagcgactccttcaactgcaagaatggccacacaagttaggaagggccgtcactggtcctcacctgctcctggccacctggggtcatcttccttccacatccctccctctgcaaaacctcacctgtgtcacgtgtcctttcagcagtatctgctcccgtatggactgctctaactgccgcttgagaagtgctttactgcggctcgagaactggatggtgaagagtgagaagtttcgatctggggagcctgggccattccacacagtgccccttaaaagggctagggctaggctcaatatacaactcggtcagtaaagatcaaggcatttccaagcccgtggtctggttttgaaaaaaactcagtgaagttggaagggacaaggagagagatcagataatattgctattgttattactcccactgtttgaacctttgtggagtgcttcagcaggtaccttgctagcaatcccatttaatcctcgcaaccaccagaggagacagttactatgatgccctctcttgggtagatgaaaaaacatggagtgtttgaggttaagtgcttgcctaagatcacttaggcagagctaggatttgaacacccaggtctatcagattctctaagcccatttttctgctgggggtgggggcacggttaggaaggggaaaattaatcttttgttcactttttgaaaagatgatacattcacatagtccaaaactcggaaggtatcaaagggaagtatctcccagccaccctgctgctctctcctgagttgtttacgaacacttgcagacatgttttatgtatattatcatactatgtacacacacacacacacacacacacgtttcctctctctacagaaatgggaacatactaaaggtacccttctgtaccttcacagtacaagtacccaataccccacaccccacctaggacttggccaagaccacagccaggtaagggcagggcaggcacttggcctccaagctctgcatccagtgctcgctccccaccgcgccccccgactcacccacagcagctgactcagcctcaggctgcctctaacaaccatacacaaaagcagtgagaaatggccatgctgccttctgggcaggacactccatcctgcagaagggacctttaggctcactcctccatctgtgaagccgggctcccaggggacagggcaggtgactggactcaccccatccggcttcttcttctgtgtggcggcgacagcacagagagaccactctaactctcctatacgctgcgatgaacgttgcaggcggccggccagatccttggactcttctgtaatgacagagttgacatggggctcaaaggactccgccttacagacctgtcaaagtgccaggttgaaggatgacagggtgcccagattcccaccttcaaagtatctgagagaatgtttcatgtgatacaggtccgtatttagtttctttttctctgtgttcaatctctggatttgaccctttgggagaaaagccaagcaagtgctgaaatagaaggaaagaaacattctccggaggacaggaggaaacttcacaccctccactcacctctagctccctttcagctttctgtttctcattgtttgctttcttttcctataggaagaggaagacagagctcttaccagggggaggcagagaaggcacagcaagagatatgcccccagaatgccaccaatgccccaggacaggcccacccatgggaccaggttatcagggaccctgtggggatggggtggaatctgaggggtgagcctccttccccaggctgggagtgggtgagacgagactggggcctctacatctgagtgtcccccaaacccagcagtcatgtcgccagcaaacaaagaaatcacgttacttcttccagctgatgttccacttgtttcttctgttgtttctgtggggagagtcaaattaaagtgatggagggtggccccctcaactctattccccagacaggaagcggcaggcaggggccaggaatggattttaaaggcaaagttctcagacccaatgggaacaggaactgttcccaagctcccaaggacagaggatttgggtctttgttggttttcagccacagcctcacaactcaaagtctgaatcaggaatctcttgagaggacagtaacataaacctctagagatggagtttgagaaaggctcccccttctgccagcttgtgatttagaaaagtgtgttcattcaatagacatttactgagcacgtacgggccagggatggttcttcacagccgatataggatggaaaagaacagacaagagcccttggccctgagctttccattctagggggcctttaaatctcagactctcagagctaacacagacctttgatactcactacctcctctggaaacacgagcccaaaaaggagaggtggcttgtccagaatcaaagagcaaattagggactgagtcatggcagaaatacggggcccctgacaaccagtcaggccagcacttccccaagaggcaacaaccccagggcgtgtgtagcaaggactcgagtaggggtgcctggagaggagagagtcggcaaagagggcagcaaaagaagagccatgctgcatgctctggggtcccgccaggtgaggcctgggcgccccagctccctatctgcccttggcaccaggggcccccagcccccttcttcagggccccaagaggaaaccggagcccaggattggcagcgtggaatcaggggaccccactggactcttaccaaagatttgatggtgtcattcagtcgactgatttttatggacctcgagttcaggactgctgcttgttcttggcacgggctctgacgcgcatgcagagaggaggaggcggaggaggacttgggggagaggtagagagaacgatcattagggctgggttgtgtgtgggctgtctcagctggcagaggggcacccagtccccgctgcgggaggaggttggagggctggcctgcggggtcactgcacctccgcccagagcctcctacctccagatccttcagggtagcagatgatgtagggccctccccgtggatacctgttgctgactataagagatgagactgcacatggagatgttctgtccccctcagtgtctgagccctccgacttcctttcttccccatcaactggcaacattttcttttctgcctatcttggaccctttgtcccataactcctttgtgccaacttctctcacggttcttatctccccaccatcccaccctgggggccttgcagtgactcctgatgggaagtggctgttctcattgtcctggcttccccttgagactggggatgaggaaaatcaaacagcaaagaccatatcctgggtgtcctgggtgttgacagcaggccatgtactagggattaacataaaatcgacaattatcaatctcattgaaacttcacaaatacaagtcaaacaataccacctctatcatacagacgtgaaaacagaggcccaaagagctcaagcaacttgccctaaatcatatccctagcagacggagaggcaggattcaaacccagaattcttttcttttttgaaacggagtctctctctgccttccaggctggagtgcagtggcgtgatcttggctcactgcaagctccgcctcctaggttcacgccattctcctccctcagactccggagcagctgggactgcaggcgcccgccaccacgcccggcttttttttttgtattttttagtatttcaccgtgtttgcctggatggtctcgatctcctgaccttgtgatccacctgcctcggtctcccgaagtgtggggattacaggcgtgagccactgtgcccggccaaatccagaatccttcaccagtacccaacagtccatccacaatcttaacgattgccctctactgctccttgggccccctgtccccaaaagcctgtccaggcaagactcacagcctcagatgagtggcaaccaccagaagcggccgtctcagggctactgccatttgctttcgtgttcctcttcgctgctgctggaacaccagggcggtttctctgccaatattctttgaactgtgggaaagaagagcagtaatactcatgagaactatcagcccctacagccacatcctcctttatagtttttataaaatactcttatataccatctgatttaatgacaccaacaactctataaggtgtcacaatcatttagggactgagagggatcgacatcatggctagaaaaaaagaaaaaagaaaaaagcgatactggaacttggaaactcagtcttcccactctaagctctggggttttgccaggcaccaaacccagaggcagaggtagaaaagtaaacattaagtaggcaggagctgtatgtcatgtggtttagagtcgtacatcttcacacgtctgttattgggaagaagtgcaccagtacctctcaaacttttatatcaatgtgtcctcatggcagaaggcagcctttctgtgaaatctgggaatttatcagaaagaggacaacccaagcctcatttcagagagaagtctggtatactcttagaaacctatgggactgccatccctaagtacattcatgttttttctcttatctcaagatatctcaagagaatcaaaggaaactgatgcttcagaaagatgtcccacatttatcctgtggtactcaaagcaccccagcttgagataatatgaggaagattcaaactgtcaagttcagtctcccaagatctattccacagaagatgaggaaatctcacttcagagaccactgactgaaggtcccagactgaagtctggtcccagaaccatggagaattagaatatgaggtggagaactcggaaaaaaatgttaaaatctctttggaaagtagaagcttgggagaaaaaccaaaccaaacccattctcccatcgccacccagagacactgtcaacgttttgagctcacgggggaagtgtaggcttttcccactgtcaatgtctatggtaagggagtaaggcagcctgaaacctcttgctcccaggtcccatagtctccatttcccttccagctggaaatttctgctgtgaccagaagaaccagaaacggggtgacaacgtttaggggactgggtcataagaccagggccagtcttccagtaatgacagttagtaggcagactgtgacatcactacattccactcctcctagtgcgggggagggaccacatcagcgcgatgtccgagtctccactccacaacgcgggagggaaacacagggttgtgacccaggtccttggagacgccagcacaaagagctcagggaggtcgaccttgaggcagcaggaggggagggcagagtctgcagcagggagccccaggagtcaccagcccaaagtcacccagggacaactggcgagggcggggcctggggctggggggcccaggtccttggatatgcgagcccaaagagcccagggaggtccaacttggggcggcaagaggtgagggcccagtaatggagtggggcgccccaggagtcacccgcccaacgtcaccccggggtgatcggcgagggcagggactgagctgtttgctgaaggggcagggctgactgacaagacttttgtagggggagcccagaagcgccggggttggggggcaaagtccggtgtgcgtcaggagtagtatggactgtggcagcggtcttgtcgtcggaggggatctgtggctgggttagcgggccatgacccggtacgtctttacctttttcttggctgcagctaatttactctgtccagtttcttctgccattgtggggtggggagggaggcggggctggggccacgtcagccaaatcccagcgagcgctgatcaacacatccagtcacctggaagacagctgcgtaactgacccagaggcagcgtaaccagggccacagtagaatgcagaataggggcgtggccttaatgcttcaagcccattggccaacgagaaagatgacagggaaagggggcgtggccaggcggcagtgtgtccagagggacctgtggctcatcaggaaagctgcccatgcaaccgctgtccccacccactctgagagaggggaggggccgcccgctctgggagagtggaggggctggcttttgctttaaaacccttaaaactttaaaaatcatatgtgtgtatactttatatatatgtgtgtgtctctctgtgtgtatccatgtgttcctccagagctgtcttcattaaccagcttctatgcaaggtctgtcattttggcctatatttttcatcttcaaatactgtataaaaattaccagtattacctgaactgagatacagatcctataaaagtgggaaatccacagcatgcttgatgattaatgaagcagactatattatccaacattccaatgagataaaataatcaaaatgatttcttttttggaaaaatgtttctcttattctcctacattgttgctgttttttctttttaaacaggaaacatggttaatatccgtaaaaacacaaagcttttgggctgggtgcggtggctcacacctgtaatcccagcactttggggagcccgagtctggtggatcacctgaggtcaggtagtggaagtgtgagccatcacacccggccggcttcatttcagaactctttccccagcactccatatactatgaataattcctttcttcttctttggatagcattttagtcatatctctattaccccacttgtcacatgataatcagtggctcacccatccatctcccttgattgctcatgagctccttgagaagagtctgattttcagcaccttgaacagtgtgccacacatacatgcttcatacgcagagaaggaaatgatttcactacagtgtaattattcccagaattcaatatctgtatttctaaattgttctagatactctgccaacaacctgagaatgttatgttttttccccaaaacttccatccattattgtgtgtctatggtcatagttaactcaattgtgacgtcacctttggacaagcccattaacagtttctttttttttaggtgatttttaattttaatttttgattttgattgtttcttttctgttttttaaatctagcagtgtttggtaaacttcaacatctctatatccccgtgtctctgccccgctggtctctgcttggaataatgtctcaaggttttagtcacctggaaaaaatttctactcacccttaaagaatcagaaataaataggctgggcatggtggctcatgactgtaatcccagcactttcgggaggccaaagtgggcggatcacctgaggtcagtagttccaagactagcctgcccaacatggtgaaaccccgtctctactaaaaatacaaaaaatagctgagcatggtggcagaggcctgtaatctcagctactcgggtggctgaggcaggataattgcttgaacctgggaggcagaggttgcagtgagctgagatcgtgccattgcactccatcttgggtgacagagtgagacatcatctgaaaaagaaaaagaaaaagaaaaagaaaagcttaaataataccttctctgagaagcctttatatcttcctattctttcaggaagtgttgaaaattcctcaacttttgaaacatttgtgcctctattactgtgtatcaggcagtgaactgagtgcccaggatagaaagatgaaactgtagatcctgcccttacggagctcatggtctagtatggaaaacagccatatgaacaaataaccacactataggtcttcagagctcaagtcctatcctaaatactgtgaaattaatgttctgtgaggttttgaaagtactagggccagagacaatatggctgcttggatgactttccatccaagttaacattcggccctcatcacaaagggaatacatgcgtgcatcttccttgcaacccaccagtgcctaacacatcatatcaccacttttgaaatcaggaaacaggctcagaagtccaagagcttgaccaaagtaactcagctggtaggtagcagagccaggtcagtatgattcttcttcaatatcctgccagccacatgggcaagtggcctcaaaatcaacaaaagacaggtagaggttgacatgcatcaatggagagaggctcaaaaggaggattttatacacaagaatagaacagaaatgttctggaagtatatctgtggatgtgaagcaggagggggcacaccaggtttcaccttggtcaagtgaatctataattccaaccggggcctcgccgccccccacccccccgagctccagacttagctatctgtctttcttactctaatataaaatccacagggcaggaccttaatctctagcttgttcacacagattaaagcagagtctggcttataataaggacttaataaatacatgaatgaataaataaactatcaaagaagctaaagaaacattccacattcttgcgggaagggattaccatgaaacagaccctagcagtcacttacaaatacagttgaccctcatcattggagtatcccatattttcaaattagcttacttgctaaaatgtctttctaagtcccaaattaatacttgtggcactttcaaggtggctcctggatagacatgcagtagtgaaaactctgtcactctttgcacacgtcccaagctaaggtcaaacagtgaccttggtctgcttgtttcaactctcatacaaagatgacctgaggacagagacagtagaggacactgcagggtagcgcaagaagctgtggctctggggccagttgggcggggtctgaatcataacactggcacctgttagtggagtggcctcagacaaatcacttacaattctgtacttcctttattcttttggaaagaaagaaaattcaatctaccaggatgagttgtttttaggaattaagatgataacctatatgacatatgtatttatgtacatatttaccctggaaacaagggtttgctatttgattaattcagtgttccaggcaactttgtagaatattactcctgcaaatagtaagaattggctgtaattaaagaaataacagagatgtagacaaaacaattatttgggtgagctacaggcagtcttcaagaagcttctgaagaaacagaacttcagcaggcacttaagctgtagaaaaggcttgcaaggagatagaacagcacctacagagagaggtccaggtggggtcaggaaatggcatttcaggaagtctagagcagtagaagatgaggccagaacacggcgccacagtgctgctctgcaccctctatacaccctgtactgcagaacctcactctctgcatttagttcttggtttctaattctctcttccattaaactgtgagcccctcaaggtcaaggtctctaagaagaaaccatagctacagtcctctaaatttgaaaacaagttattaaacacagatacacccaagaagaccgtacaaaaataatgttggatttcaattgcagtcatagaaattcacaactggtatacatttgcaatctgtccaggatttttctctgatgactgccgtaactctgtcataaacccttttcattatttgagacaccgagacatttgttagaatgtttgggaaagacattctaaaagggcaagaaagaccttgatcttttttgtgtaactgattgactggttgactgactgagatgggatctcattatgtagcccaggctggtctgaaactcctaggttcaagcgatactcctgcctcagcctctctagtggctgagattacaggcgcacgccaccatgctgggctctagtgtgatgtatttacgaggcttaaacatatggttcattacacaaggctggcacctcagagtaaagattttttaaagttcactctaatagacttatttctctatatgcaagatacaattttaccacagtaaaacacaaggaagcatactgatatacatatatgttacaacaggataaaaaaaagcaatataattttctccacaaaagcttgcaaaatcctggccaaaacacagtaaagaggatgttaatctcacagctcacgtttctccactgagacccaggaaaaacaatgccagtttttgtacagtcacaaaactaagcactgtgagaatttacaagatttggttaacttgtatattctccccaccctgacagacaagtcccaaaggagcctagcagttttaccccaacatttcaatctcctccaacctccaaaataaaaccctcactgtccaatatctcaatttatattttcaaacgtctaaaatcttaatcgaaacaaagagcagtgcattagctttgccgccatagaatgcttggtataattttacttaggcacatcacagattgtgctattgcctaaaaacatatgggtagaaccaacattcctagaaaccaaacgcatatattacgaaggtgaaagggaatagggagtgttgtttttaaacagatagaacgctgtgattgtccactcataggttaggtgtgatcaaatcacatcgtgctgtacagctaagtatgtcctatattgtatgacaaagtagggtaacacattatttattgaggacctgttgggtacacagaggcacaccacaagctgtaaaagacttcattcttgccctcaagaaacttccaagtttctagacagcctgatagaaggtagtcgaaagcaaatacttcaagcactagccatcacaattaccttaggtatttacgctacccttctacgagtctctgaatatttcgaggccccctttcctatttcccatgggctctatggctcaacattctttacagccacaggctttcctggactttacgttattattgaatcaacattgctcactatccgcctcctttgccaattaaaattccactttacatccaaccaccactttggctttgaagccactgcctgatactgacgctctgtcgatgtacaatgactattcttacacgtctctgtctactgaggaggatcctactcttttaacagaaacagtgccattgacttccaatcaactagtttccataatatccaaaatattagataatattccattatactcccaaaacaaataatgagtgatgttctctcaaatacacgtataatcaaatgtgacattgagaagatggggcgacctttgactcagagattgtattcaggcctttgtagatgcatttatttgacataattatgcatttaaaacataagttaaattgtcatcagcctgaaattataggggcttttgttggtgagaaacctattttatatataatcgtttacccatagaaatgtttttgattaatgttatctgttaaagacttcagttcacaatatttcccctgttaatagtatatatgtttttggagttgatctggagaatttgaggaccacgttctaatcgctatctgatgctattctgggaggacaattcattgcctttgggttgctgggggttggaacttgaaggcgggtctgagtctggagaccttgccactgacttttggaaagtctgttgattctacctttggaagtgcctttacatgccttatggaaggccgggcatggtggctcacgcctgtaatcccagcacctcgggattattgatgaataaatcaatttgggaaatgcttggtaaattcaacgggacctctcagaacaatgaatttatatggccacgatgttgttttctggtttgtttgtttttttgtttttgttttttttgcaaagagcattcggaagactttctagtacaccagtttgggaactgttggtggaggagtcagggtaattaggctttggactattccaggtacaggttgtcactgtattcaaggaattgttcttagtctttgtatatatccgaattaactatagcaaattaacaagcagaaatataagaattgggccttggagggagggagagggcgagagagaggggtagatagaagtttcctattttaactatggttcaattctaagcattctaaaatttcattggattcttttaactatgaattacaagggtgtttaatttccaagttcatgaagcctttggttaatctcttcattattaacttctaaccttaactgcttcatatttaaattatcaattttatggtgtggattgtaccaattgtttttcaatcttctgacgtgcttaatggattaatacataattaatgtttctcccacagtccacatatgcttgagaagaatacagaatatctgattattgggtacagaggtctatatttgtccattacatcacgtccattcacgggttattcaaatctatatatgggcattctgtgtaacttacttatggtaagcagggtatgttgaaatctccaaatacaatggcagactcgtcaatttctccctgtggttttatcagtttttcctctgtattttgagtctattttgataggtacataaaatatgaaaattgctacaacctcctaattaacagtcagttggcatcaagctgttactaatgctttgtgttccaacatcctatcttgtttgaaactgaagctccatcagttgttttggttaatgtataccggcatatctttctctctctctctcctttataaaaactttcaatcttttcacatcctcatagtttcaataagatggattagaacagctggatatcgttttattagttccatctgtctaactggtaactttagtccatttacagttgttgtgactcatttatgtggacttccttctgtcacctttagaacttccatttctctcactttccaatataattttaatatctcctcctgggattccactaagacgtattttagacctcattctgatctccctctccccgccaaccccaccaacttctgccctgtcatttatcctcatatctctctgtgtaacatatggacttactttttggagataatggtctaaccaattaatcctttcttctggtgtctaatccatccactcggtttcttatttcaacaattccattttatatttccttatttcattttattctgagacagagtctcactctgtcacccaggctggactgtagtggcacgaacctgcagccctggcctcctgggctcaagtgatcctcccacctcagcctcctgattagctgggagtataggcaggtaggtgccccatacacagcttttttcttcttcttttttttttggtggtggtggggtattttttggagaaacgagttctcaccatgctgcccaggcttgtctccaactcctgggcttatgccatcctcccgcctcagcctctcaaaaagtgctgagattacaggtgtgagacaccatacccagctatatattttatttctgtaagttctatttcatccattttcctttcaggtcttcctcatcattcctggtggtcttactgctcctgctcgctcaattttatgagtccatctttttcttatataatacatttatttcacatgtaactattttctcacaattctaatatttgaagtctgtattctgtatctgataattccaaaacctacagtctttgggaaacattcattgtttctgataattctcaaatatattgggttcactacttgaatgctatgatttcactgaattcatagttgcctgcttttaatctttgggaatcctacaggcttaagttagagatggtttcctagaaaaagtatctgtgcgtgcttctgatgagagctgtggggacaactaacaagagacccctttaccaccgtccgtaatcctgatattctcttggattctcctggagaatgtcaggattacacaaggttctcaaatttggctccccaaccttgctcatttatatacagaagactagactgcttagtataggtgatgactcacttcctcctaccctggaaaaaacaaaacagatctctcatctgaatgtgatcacagactaggaaattctgaaggtgaataactggaggctgtaggcagcagggaaagacaggtgtctttcctgaccatagaaataggtcacaagctgccctaaaggctgtgtgctccaccaggatttcactatttagctcaaccagcagtccctctgtaagagtgaacggaagcttcttagagcaccacgctgcctttaaaccacaaattcttgctaaaagtcatggtcatggtaaaaaacctatggctttgcaaggctttcttggtaatgtcctagaattaaggttaagcctgcgtttcatggtaactgaacaggaaaccagcctgaccaacatccttctccccaatggcttgctctcagctcctcttgcttgggccttgggcagccagacggtctggttttaatccttgctctgccacctgtgaccttggacaagttacctaccttcagttacctcatccacaagatgcagatattagtaataccctctttttaagttattaagaggattgaaagagttaataaaaagtaaaaaaaagacttggtaggcataggcacagaggcgggaaaaaagcaataataaagaaatgatacttctatattttctatagatcatctttgtaacaagaagaaaacaaaccaaatgaaaatgaaacaaattctctcaaaaagaattaagtcaagacaggcagaaggctcacaaagtaatataaaatatatcttatggtttatggaaaattcttaataaaataccttctttgctccaagctgcactctggctttgcctttgagtcacgtggcatttctttgtacgatgaccggttctgtcgagtaggcactgcttcagccctacaggaaggaaaaaacatctctagaaaacagcagcattcctgattcccacttgaggaggcctaacaaaacggcatatgcctcaacagcagcacatcagtgttaaaaagtctggagtcaaggggaaaaagtaaaattggaccatttccagaatctcaccaaaaacaacaaacggatgttgcaagtggcctacatgagcaaattagaaccttaaataaaggtcactcttaatgcctatcccagcatagatgcagcaccaagtacagtgtcattttactgggttacctttttcattcttgaaagtaggagctatgaaaaaaaaaacactaaaatttcttgaagagaaccttctacttacaacctaacttacgtaatcgaaacactctattgagggtgaaaattgagtattataagaaaataatcacctgttttgtgagaagttcaatacgtaatgctcctccacacaatacataccttagaaagaaaaaaggaaacatacaaaactatctcgagaattattcctgcttaaacaatttctacatgccattactaagaaagtatgcacacagtaaacatgagaagagaacatgcaagcatgaacatacttgttagggatacaggactatgggtaacttaaaaactctgttggtattactctcatgtaattgctctgaaattctagtcaactatttgcaatggctcttagaacagaatactttgaatttttatgatatcaaaaactaagaacttagccaagtattcccaagaataggaatagtaagcatacttagtaagtattccaaagaataggggcagaagaacgcatttctttaaagcactacctcagaattcaatttagtaattccgatgctgcctgtaacatcagaaaacaacttccttaaaaacatagcaagttggatttaccaagttgctgaccaggtcgcattccctcctgccctcaatcccatctttgtgttatactttatctccagtaccattttgcttagtattcatggtgctcaagttgtcactgtggacatcagagcctataaatatatattgttctggctccttcctgtacatctttccaagtcatacctgctattctccaaagtctgtgaatcccgacactaataacttggaaattcagtttaaggtcctcttcagaaggtcagttagctcaaggcatcacatttttctcaggactcttaagaaatactccaaccacagaaaaaggcccttctttctggtatcaggagccattggccacaaacacaaatccaatagagtttcagccatttacctcccacatcgtcccttccctgaagttctagctaaagcaggaaaaaataatgaaaacaccacctgcagtcacgaatcctccagtttcctggccaagatttcgtatttccttcaagatacctcccaaagaggacatgacgagggaggggcacacagggtgctacaggtactgataaggttttatttcttttatatatatgtattttttgagacggagtttctctcgtcaccaaggctggagtgcaatggcacaatctcggcccactgcaacccctgcctcctgggttcaagtgattctcccagctcagcctcccacgaagcgggggttacattacaggcgcccgccaccatgcctggctaatatttttgtatttttagtagagaaggggtttcaccatgttggccagcctgctcttcaactcctgaccgcaggtgatctgcctgccttggcctcccaaagtgctaggattataggcatgagccaccacgcccagccaaaggttctatttcttaagtttggtgttgggcatatggatgtatgatttaatgttttaaaaaaggaagataccttcctagtttttttgtgttttgttttttttgttttaggcctgcgtgctttattcgttaccccgtatgaatccataaagaagtagccattagcaaattcaggcaatacataccggattcatacttcaggaagacaacccagttgacaacgacaacagtttctatgataacaaaagtgagagaaaatactgacattagggtcatatcaagaaagttcaatcataagatatatccacaagcaaaaatatacacacaaaaagctaagtacgaagcttttagaaaactactaccatccttagagtaagtacaagaaagtattcttttatgtctgtttttttcatcaaaataccgcatatagccatagattttaaaccattacatcttatctagattccattaacatttcttctagatcactaacatttcttctagattccatcgttattcctttgtaacctttattttcagtatcttaaaaatactttattaaatataacacatacattcagaaagttacataaaatatacctgaaggtataccttaacaagttattgtaaattatttgcccatgtaaccaccaacctggtcctgaaatatattccagccagtatccaagaagcccacagatgtccctttcaggtcacacatccctacctcccacctggatggactccttcccctaacctctatgtgatcacctctttgttcttaatagttttactgcccaagtatgaatccagaaataagtgtttctctgttttcttttcacttttgtccccctaagaagcctttttagaagttttcttcctaattctatccccactccccatggaattttaacaccacagatatactgtatgtcggtttatgttatacggccctttggagggcagcagaccattataataggtaagattttctttcactctaaggaccaattttcactccactgcaggcgatattgcctccactaagaatgtatgccctaaccaacattagttttccctattgttgaactctatatagaggaaattgtacaaaataggttttggggctctggtctctttcgcttaacatagtgttcaaggttcgtccatctttcccacatagctgtaagccattttatgaataccacaattcttcattttcttggaatgaacacctgggttactttctgtttggggttatgatacatgatgctactctgaacattccggtgtctcctggtgcctatgtactcatttcttgtggagtatatatccacaagattcctgaaccatagtgtatgagtatcttccactttaccaaattgttttccaaaacacttgtacaaatatacactcccattagaaaaacagagtcccgtaacaattttattaccttaaaagataagttaagcaaagtatctcctatgccttctttttcttttaagatctgaagatcactgtgcaaaggactagcagggtcaacccgaagaatcacaaaacaaaaaacagttcaaacaaaaagatatttttttttcaactaactcaaaaatgaaccaatctgaaagctaaaatagagcacctagggtaagttcaagaaagagaagatcttaagctgctctatatcctcaggaaaaacagaggtcactatagcttccagctcctttagaatgaatgtccaaaagagatcataatagcctaaatctaatctaataagggggttcagagtttgcagtcattctaaaggaaaacagtcacatgtatataattttctcaagaattcaaaagaagtttaatatgctttcctaaacttgtattattagtcaagcagttcaaggagaacaatttgccatggacggaactatgaaaagttaaatcactaaaaaatcggtatttttccacaactgtcctatatatagatttctaatatgactcccatcccccactcccttttcgtttgtttgtttgtttgtttgttttaagagacaaggtgtctcgctctctcacccagggtggaatataatggtgcaatcacagctcatgtgcagccttaacgtctccaagctcaaaagatcttcctgcctcagcctcccaccatccatagtagcttgtactacaggtgtactacaccgacgtattttaaaagtaataacataactacatctacaataagagttaattatattgctttcaaaactgggggaaaagtcataaaaatcaacttggcaatcattctctgtataatgaaatatattactcttgtttactttccaaccaatattattcaagcttgagctttttcctagaagataaaaatcaagcaagagttcactctatcaagaaaatgacaaaaaaatttcgatggacctataaaaacatttccaacactcaacatttcaagaagtaaaaaaaaaaaaaaaaaagtccaattaaatgaagcattatgaagtttcaagagaatataaaactagacacaagtctggttcgtttcctatttcttatcatctgaaaaactctagccaacatgttcagaccaccatggactccatgatagcacagaatttagtatgagtctattccaaaccccagcaatttttgaaaatgctagaagacactcaaggtgacacattactgactaagagagacttccattcataagactacaagcaagaatattacacagatggtctagttcacacattgacacactgagaaacacgtgtacctacatgcaactggtttcagtttttcagtgtggggacttctctaaagatgaaaacacatcgatatcttatcctaagactaagtagaaatggaactactttttagtcatgtgaaactaaaggttttaaagactgcactatactttgaaaaagaaaaaaaatcaagtttacgaagatctcacttcctagatatgtaaccatgacctcatttcctatctataaaatatgagaagtttctcctatctctaaactatgaagagcacctatttcacacagcggctatgaagactaaatgagagcatctataaagtataaagtacttaacatagtatcggtcatgcaaaagtgttcaataatttatacttgttttgaagataactcaaactggaatcgatcacaagacacggaaagtacagtaacattatttcaaatgctacaaactcagttttttaaataagatatgagaaatggactaaatttctttcctctgggaaaaattactaattaaattaatatataactaagactgaaggagggagagtaatctatctggtttcaacacttggcatctacttgcctaacaattcattccctgttttggagaacctgtgcccaagacaaagtaactggtcctcggctttcatggagttggtaaatagctctaatacaaggcaggaagtagtaagtgttcagacaatcatctgacgtttccctactctgtctgagcatttcatgtatacacacacatcattctcattgatttttcacagcagtcatccaaaaggtatgtactatctatccatactttagagttgagcaaagtgaaaccaaaaaaggtgtgtttgtcaccacactcagtgttcctttcacatcctgccacttcacataaaagagatgttaagtcaaaagagaagaattagttttgatttggtcagagcaggatggaccaaagtcaccttcacgaaggagaaataatttgagttgtgttttgtaggagagaatgaatgtgaatatacagatgccacagaaggaaagtaagcagagaaaacagcataaacaggctggaaaggggcatatacagggatcagcaggtggttccaggatgtgaacagcagatgaacagggtaaaaagtggctgttcatagatgagaaagataaccttgggcaagagaacatatgaccgtggctagggacggtggctcatgcctgtaatcccagcactttggcaggctgaggtaggaggatcgcgtgaactcaggtgttcaagaccagcatgatcaacatagtgagaccccatctctactaaaaatctaaaaaatcagcctggtgtggtggctcatgcccatagtccaagacacttgggagggtgaggcaggaggatcactggagcccgggagatcaaggcttcagtgaactatgattgtgccaccgcactctagcccaggcgacagagcaagaccctgtctcaaaaccaataaacatgtgactgaatctaccactaaggcaggaatggaggagagcagctgagattggcatgttcatgaattgcctgggattaactataattacttaaacaaaaatccaggctctagctatttatacacacttacgcagttaaatgctcttgtctttcagtcttcctaatttctctaatattgccaaattttctttttcaattccttcatcctccaactttttcccactaatgggctctgctttcatctcgtagtgatctaagtcttctatatcctgcaaaaagaagaaaaatgttagcttattcaacctatttttcttcagcagtttcttatgccaaaagttaaattattcttgactcaatgggggacaagaaacagaatatatctatcctacggggagagaggaaaagcccccacattccattcaagaggctcccaccttctatatcctacattttatttaaaagctacactctgggtaaagcagatttcaaagctttacaaagtcataactattaagaaataagccatcatttatttatttacttctttaatttttatttccttttttaaaacagagtctcactctgtcacccaggtgggcgtatacaggggtgatctctgctcactacaaactctgcctcccaggttcaagtgattctcgtgcctcagtctcctgagtagctgggatttcagacacccatcaccacgcccagctaatttgtgtatatttttagtagagacagggttgcaccatgttagtaccagcctatctggggctttataaagttaagaaaagagcctgtatgcatgctgaaggctgtgtgaccacagggcttttaaaggatgcttctgtgttcccacagttaggtgggagctcttggaaggatctcttttatcccagtgctcttgctaagaatggaaagcccctctgcataactgcagtagctggtgccatcctctgttcacttgcatcagagcctgggaggttgtggtctgcaaagctcacctctcataatgggacgccaatcaatagtatccgaagttgatatacccagaaagagagttcaaaaattatttagagaggtggaaaataatcaccagtagaattaaaatcagaaacgacaaagttggccagcggagtggggaagtccagattggggaatgtgatgtttcattataaggtctttcagcatttgcttgctttggtctgagtgaaagaattgtctcatttttttgagggccatgtacagcaaaggactcaccatctgtcagacacactggtcagttctggcaaggcagagttggaggttcctgtcctcaggtgggtgggcagggacggcagcttgccgtaaggtatccaacagcaccagcggcaggaaatgaaaagtgctcagtgattggtgggatagtggtgtctagcacaatgattcctgccaaaatcttaatggtggttgggcatagtggctcaagcttgtaatcccagcactttgggaggccgaggtgggtgggtcacttgaggtcaggagttcaagactagcctggccaacatggtgacactctgtctctactaaaaaaatacaaaaattagccgggcgtggtggcacgcacctgtaatcccagctactcgggaggctgaggcaggagaattgcttgaacctgggaggcagaggttgcagtgagcaaagattgtgccactgcactccaggctggccaacagagtaaaactccatctcaaaaaaaataaacaaataaagccacaaaaacaaacaaacaaaaaaacccaatggtgtgcaataaatgaaaatgctgccccagtcagacgggactagcatttttcagcaactttcaaggtcttgtgtcacaagaatgaagatccgagtatttcccacctgtggagggggctggtgaaggagttttcagtcccgggcaccctgggctgtgctgaaagcctctgcgtcacactgcgtgagttagctgggaaagagagctcccactgttctcttttaacccttgtccttttgtaccacagcaattgctttcctggagatcagaaccgtggctgggtttaacatcatctttggaaatcctaaaaggcaatgaagcaatttttctcttttcatttatatatttttttgatacagctgtgtcagtttgaaattttactttcgtatcagttctaatagtgtgtctgcttgacatagtttctattaaatgggcttgatatgaagttacttaaaaattcaagtatttagagtttcagggcccatcgtcttgatttttggggcaatacctcaatttcatactgtgttattcttttccagagagatgggtcactgaataacttacattttatgattgttttatgagaaactatttctggttacaaatggtaaacatctaggttttgcagtaagaaataatggattatgttagaaaaaaagaaccataagaagatgtgtttttaattttgacttcctgtaagtaccttctggagcagaaggttttctctttgtggattctgcatcttggatttggggactctgttgcactgagctgtgctctgtggggaggagcctgtggcagaacagtttgggttctgctggccgcctttccctctattcacggagtctgggtcccagagaaagatgacagcagttaggtcttgttgggaaaaaaacgcggctaccaaccctggaccattttgcttcccctgaacaaataagatagtcatttgcctacttttggggacggtgcctgtgctttgcacaggacgaggtggcagctggcttgcctgctggcctgcttcctggagataggatgctcagacccaccgctgctcttcaggggtcgtggaaggaattaatgcacttccttctgtcccccaatctctgtccctttacgtgtctctggagctgagcaggtattctttttctttcttcatctcagtagagctgttaaattaaatagatgttgcttaagccattcagaaaggtttcacattttaaaaaacaaaaggtagctgctgccatgattcctttgcccaccgctacaccgtgtcgttgtaggacagtccccacttggctgtgctgagcctgtctggaagtgtttctgattctaatcagaagtggaacagtttcagtgcagactataggttcatgttagtgatgaacttgggtggagatggggacacagcttgttctttcctcctggactctcatccagggtcctgagctgccaggggcctggccactctcaccctgagccctgccctggctgagctgatcaccgctgcatgtcccagctgccggtctgcctgtcacctgcagtgcacatgtgtgcatgtgtgtgcatacgtacatgcaccacacacataccatgcccacctcatacacaccacacacataccccatacacaccacacaccaaccacacacattacacacactgcatacatatcacacaccacaaacactacaccacgcacacaaaacatacatacacgctcaagccttccacactacattacactccacacacaccacacatcacactccacacacaccacacgcacatatcacattcacatcacaccacaccacataccacacaccatacacagtacactccacacaccacaccctccaggacgtcccaccaccatacacacacaaacaccacacacccacaccatactacacatttaccacatacacaccacacacactgtatctcatgaacacaccacacacccccgccacacacatttgcatgcaaactactcattgaatgaaaccgaatgatttagttttccccaaattaatactgcctgcctgtgcacccctggctgtcctggccggcacatcccccggtcctgccctcccttgggtcagcaccgcctcctgtgtctcaggtgtctctggctgtgccctgtggcgtgctcatgtcctgatcttgtgggaggctggctcctctgctccagtggctgccttcctagaggagaccagcttgtttgtcacctctcctgatgcccagagcagcagcccacgggggaagtcctgcttcctcccttcgctgtctgcccttccccacaggttgttttgtctcagtgctgatatctccccagctagaagaggagaccctcaaaggtgcacaggtggatttgattataatgcaggtgaatattaaatgcgttttggtgaaacactcaaccactacatacatctttaataaagtaaaatgtccaggccccctctgctcccacctctctctcccctcccacctctctcccccctcccacctctctcccccctcccctccccagaggacgtggctgacaagcctttgaggggtttcccctttctgtgtgcctttgcgtgtatgtatgggctgggcggtgtgtgtattctctagacatcttgacggacctgtaactgggatctacacacgtgcgcttgctgtagctcacttgccattttccctcaaaaataggcctgtaaaatccctcactgtagtacgtgttgccctgcctctttaaaaatgccaccaactcttccagcacgtgaactctgccgtcatttttttaaacattctcttatttatgggtacttaggttgtttccagttttttaagagattgcggcaatgaaaatcttcagctatcatttttcacagtgctgtgggagaacgtggttggaggtgctgtggcggtggagtggccccacacgtggccaggctttgtggggttctgactctgtccttgccaatgttcctccacacagtggctgcctctggggaatgatggctgtgtgagcgcccgccatgccccaccagaagagtctaccatggcccaccggaagcgtctaccatggcccaccagaagcgtcagagcgcggggagcagcatgttggaccacagggcaaggccgggtcctgtcccccaccaccaggagcccgagagcgaggacgtggagctgcccttggaggactatgtgcccgagggcctggagctggtcaccctgcggccagagagccccacgcccaagaagcaggagtgccacaaccacagccccgatggggactccagttccgactacgtgaacgacacctctgaggaggacgactatgatgagggcctccctgaggaggaggagggcatcccctactacatccgctactgccctgaggaccaaagctacctggagggcatggactgcaatgggcaggtgtacctggcccacggcgcgcatcctatggacactgacgggtgccaggatgcagtggactggacggcctgggcgggcctgcacccccatggtcacggggctaaaggtagccaggactaccctgatggccaactgcccatcacggaggatgtgtcctccgtcctggaggcccacgaccaggaagaagacggtcactactgtcccagcaaagagggctaccaggactactaccctgtggaggctaacgggaacaccagcgcttctgcctaccccctgaggtgcggggacggggacctggaggaccaggaggaggacatcgaccagatcgtggcagagatcaagataagcttgagtatgaccagcatcaccagcaccagtgaggccatccccgagcatggacctgagccagggcctgcggactctgcagagggctgcccacccatcaaggccagctgcagccccagcaggcaagaggcgaggcccaagtcgctgaacctccttcccgaggccaagcaccccggagacccccagagaggcttcaagtccaagaccagaccccagaagagaggctgaagtggcctcacgagcaggtaggactctagctgtcccggggaagggagcagaggggccctagagcaagggacctcagggtacaggcctcgcagatgctgaagcgaggcggtggggggtgctgggtgccttacagttctaatggtggctgagctcttcattggtccagttgggagacatgttgcgtggatgctccggccactcttaagctcaccgctcagactcaggactaaagccggttgagggctgaggggcaactcgtgtctcgcagaagacacccctcctcccaccctagaagacaggttcaatttcttgcccactgccctgggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtgtctgaaagctggggggccttggcctgacgggcaatcagctgtgaatacctatttggaaaaggattttttgacggtgtgacaaaacctcggggaagaaacgcatgctaatgagggcagtggatgtcagcataactgtattttaattatagcaaagtcagcgtgcattctaataaacacatttgaaaagccgccttccaaaaaaaagcctcactgtgagtatatattatagaagatgtgattattggactcgggtgaaggaacttctatttggccaattatgtggactgctttcatattttttaaagctttaactactatttttttctgagaagaattcatgaatgtgtgtgtgtgtgtgtgtgtgtgtgtgtgtgtgtctgtgtactgagagcttgggtttggaatggaaatcatattgactcctggattttcagcacttgtatcttaatgtcttgtcttctctctagaacacattgtgtcagttgacttcactttggggctgttcctgtcattcacagcaattctgtgtttacagggggctgtgggatgcataggaagtcctatggtgatggcaggcatgggaattttaccccaagggactatggtaatagggggctgaccaagaataactcctaatcctatgtcacataataccatgagcagctcaggaaaactacgcacaactcagacatgtgcagaaaggagatgtggaatgaaatggagccccctggccttatagaggcctccaagacctgccacacccacgtctgcccccaactccccagtcaaccttcagagaagagaaggtgatctctctccagctgagaccaagccaaggcccaaactgttgtagctgaaggatgtttgggctaggctcatagaagctgttccactcctgcagtgtcaacagctgcctgtggtccaggcttctgtctggtcctgggtttttttttttttttttttgagatggagtcttgctgtgttgcccaggctggagtgcaatggcgtgatctcagctcactgcaatctctgcctcccgggctcaagcagttcttctgtctcaacctcccgagtagctgggattacaggcacccgcaatcatgctcggctaattttcatatttttgtagagacagggtctcaccatgttggccaggctggtctagaactcctgacctcaggtgatccacccacctcagcctcccaaaatgctggggttacaggtgttagccaccgcactcagccttgaagagacactgggccttttaagagacactgggtgctgactcacttctgggtctgccccatgggtggcccaccgggtctgctctgggtgcagccaggctgtgcacgtcagggagcctgagctggacttaaggtggggagacatcgctccccaagagctgctcgggtgcgacatcagggtggaggctgttgctgtgtgtggcggcatcactcatttaccctcgtctcatcagcctctgtccttcggctcatctgcttgcaggtggcctctgattctgcctctggagcctgtctgccccctcttgattcattcattgggtcccaaatatgtgaacaatagcatgctagccacttttagaaatatttgtgttcatcttcaagagaggggggtcatccagccattccccagccctcaaaacccactccacagacaaagcagtggcgggtcagggctcctcttgctcttctgagccgctggcatagcgaacacggtacaaaagaaaaggatttcacatgcaatagaatttcattcaccctgaaaagggaaggaaattctgacacaggctacaatatggataaaccttgaggacatcctgctagagccagtcacaaaaggacaagtactgtgtgattccacttctctgaggcacccacagtagagtcacagagacaggaagtagaatgcgggtggccaggggctggagagagcagggagtggggagctggtgtttaatgggtgcagaggttccgttgtgaagatggaaaagttctggagatgcatggtggtgaagacggcacaacagtgtgaatgtacttaatgccactgaactctacacctaaaaatggttaagatgataaattttacattatgtatatttaccacaataaaagaaataagaaataaaaggtttttggatgatgaacgggctcgagccaatttggaccctctaaagctaagttgagccaggctgaacccatgtagccagaatcatactggattaggctgttctagcacttcacgtggtgagaatgggggagagagagagagattgattgatcagggggctgtgcagggggcgtgctacacacttgtaaacagccagatctcttgtgaactcagagcaagagttcacctatcaccaagaggatggcccaagtcattcatgagagatttgccccatgatccagacacttacctcccaccaggccccaccaccagcattggggattgcatttcaatatgagattgaggtggggacaaatatccaaactgtatcacccacaaagaagcaaaaacattttgggccaaatcaaaactattttgatgtagccacagtagggatgagctgtgattacacccattcaggcctgtggacctgcggacctggcgtgtgtggtcgtggggcggtgggtgggcacatccctgggaggtttcaggaggacattcaagaccaaaatgagccatgagtaaataatacaaccacatcctgagtgggagtgggggagcctccccttctctcctaggtcttgtatgggtcatgatcccaccttggcaggagtggaaggaacacagatcctacaggttgtggcttatagtaaagtgactgtggtcatgccttgtgagtgtcattaaaataaacagatatcgttaaatccactatcaaataacagcgatttctgctatcctttcaccttttccacaagtttaaatatcccagatattctactgtgtatattcctaaaagtagacaggtagatttagtgaagttaactggatcattggtatcttctttatagatcatctggtgaaacttgttttgcaaattatgagttgtaggcctttgttttaatgtctgtagccttaggcagttccattgagactaactcagtttttttcttattaggactaatcttattgaccggaactgtggactccccgtattaggagaacagagatctggcctgtgtaaatgagtggaagttaaatactgtagaaaatgccctctggaaactgaaatctaatgctgacttactattggtcatttaatttccttctggcttgggcaccatcgttacattcatttttcagatgtcaagctagttttctcagaatgtgtgcagggctcgaggccgagtgtggaggccactgggtgaatacaggagaggtcacaggtcaagcctcctgcgagaactgcaggcttgagccttcgatagagccacgtgaatgatttttagccccactaggttgctgtcattaaactatgcacacagggcttcttgcttttaagttagcaggatggaaaaattgcaggtgtttgcagcaaacatgaagaaccagccatgctggcccctaagcaatggtattacaaagggttggtgaagattttctcatttgagaactgaacaaaaccaaatggaattctccctagttctgcagctctgggggctgtaagcggcggagcttccaccttccctacaaacggacccagagtggcacctggtatgtgaggcaggtgaccaggagaagggggtgtcagtggttgatgggcagctgcctctgctgcctggttgacccagccccttcctgggtcatctcccactttgcctgggtgtcagtcactggagggttagcgcagtacaagctggcgggtgacctccgtagagcttaggtgaaggggctctcacagggcagtatgtttgagacccttagagggctctccttactcttgcttctcccattatttttaaattgtagtaatacacttgtaacataaagtttaccactttaaagtgtacaattcagtggcatttagtacaatgttgtgcaaccacctctgatatttagttccagaacattttcactgcccccagaggagaccctgtacttattaagcagtcactcctcattcttccctctccccgcagcccccacaatgaaaaatctgttttctcactttggatttgcctattccggatattccataaagacgggatcagacaatatgtgccctttagtgtctggcttatttcaccaacataatgttttcagggttcatccctgttgtagcacgtgtcagtacttcgttcatttctgtggctgaatgatattccactgaatggctatgtttttattttcatttttactttttgagatggagtttcactcgtcgcccaggctggagtgcagtggtgtgatctcggctcactgcagctgaagggctatattaagtttcatttatccattcatccactgagggacatttgagttgtttctaccttttgattaatgtgaattctgctgctgtgaccatgtgtatacaagcttttgggaaattttatttggctagtcgtaactttaagttttgttttggctatttattgttgcttaaccaattatcccaaaacttaatggcataaaacggcaaatttgtctctctctcactattgtatgggttaatgggctagctggacagtttttctgctggtctcatttggcagctctcactgtgcagttagacagtgtcagggactggtcgtctggatgctcagctgcagtggaacgtctgagacggcttcttcacccacaggtctgctgccttggtgtttcttcatgtggcctttctacatagcatctcatactcttggccctcttcatgtagcttctctttctccaagaggatagtcagttcttctttttggcttccagaagcacaaaagtgcaagctgtcagatgttcttaaggcttagacctagaacaggtccagtttcatttctaccacattctataggttaaaggaagtctcggagccaaccttgattcactgtggaatgggcccttccgaggacctgaatgacaggagttgtggctcattggggaccaactccaaagatgaagcctgagttctgagaactttttcttctctgattactccttattcatattttatgttttgttttatagatgtaatatattcacaagtgtctttaaggagctattttgatactcttttgtcctctccctagcaggtcttttttctttaataatttttttcttagtttattttggtcttagttttctttcaaaagcctttcccaaaatatctattctatgttgctcatcatttgtcatcttttttaaaatgcccccttttgttcattcatatttgagagaaggactaaaagactgactgggaggctgggtgtggtagctcacatctataatctcagtgctttgggaggctgaggtgggaggatcacttgagcccaggagctcaagactagcctgggcaacacagtgagacccccatctctagaaaaaataaaaattagccggatgtggtggtgcccgcctgtagtcccagctactcaggaggctgaggtgggaggactgcttaagcccaggagattgaggctgcagtgagctatgatcatgccactgcattccagcctgggcgaaagagtgagacattgtctcaaaaaataaataaataaataaataaataaaaaagaagtttgggagttctttctggccaagacttgtcaactgatagcttttaggggaaagggtttttagggggaatttatgctgattcccaattgttatccccacccctctatcttatctctttgcgcaatcataaatgatggcaggaactactccattcctctggaggtgaaatctacgttctcttgcctgaggtagatacatgtttgctggggttctgcttaaggaaatgtgggagaacaatgtgtttcagggcctggaaaatgtgttctgtatgtaggcttttggttaatctgttttcagtcttgcctatcagtcccactctccggggtacctggtgtcggagtctagtgcctctgcagggtactgtgggacaaattagcctccttgttatcggtatccccctaacctccacctttgtttgctttgcttcattaattaaccatttcccatttactgtcattgtctattggaggtgaattctcttctcttggtaaccccatccctttttttttgtaattgtgtgtgtttatacaatctttattcttcactgtaattcccatggagcctcaggaaaaagagcagatgggagaaatacgtgttcagtgttcagttttccttctgtaagacacctgcaacctgtgtttttcacagaatagaccatggacttaaagcataaagagctactttgtttttcatgattgtgccttcaattctatgtagaaatataatctgtgaattacctgatgaaattttcctaattttgaatcatccttgtatttctataataaacactgttagaatgcatacggtagtgttttatttttgcatttttacttttatattaaataagattatagttttgtttccttccttctaggctcttatttcatttccgtaccaatggtatgcagggctgacttgggaagcttacatgtttttctaagatctaggatgtagctctagtttacacagtaattttcaactgaaggagatttttgccccccatgggatgtttggaaataatctggagacattttcggttgtcacaactggtcatgatgggaggtgctattggcatctcttgggtagagggggtgttactaaacgtcctacaacacacaggagaaccctccacaaattgtctggcccagtatatacacatcgctgaggctgagaaaccctggtttaaataaatgtccaatttggagagtgagtctttgactgccatttttcttcttctatgtgttggtctccagatttcccactttttcagttagttgtagtaactgtagattctttaaaaaaaaaaaaaaaaaggattgcttcatctttacttctaggctgctgtaaagatgtataaggttttcactttttgcatcatattcacattagaaacagctgagttttggagggaacacattcaaacggtagcaaatttagtagagcaaattccaaagacattgagtctaggccagttgtcagtcctgggtataattttagatgttttcaggctctgaagctttccatttaaatgcaaatttcggaacaaagatctgtgtctctgcactgaccaaatagaaggtatgtgaatgttatggtcttgattgttttacaagattttttctgcaggtacttttgcaagtgtgtagggagagatgagaagttccaaggaaaagggtgtgaggtctttggggccagctttgagctggcaaggctaaattataggaagaaggcagagaggtgggcagagaccagatgtgggaggacttcctgtgtcatgccacggagtctggactccaccctgtaggtgacgggagccaagacagggcttggcacaaacacatggcacatttgtggttaagaaacgtcttccttgcttccttgtggccttgagggatgaattaaggggctggaaaaccgggagcaggacggcctgtgcccatggttcaggtgagagccgggtgggtggcaggggctacggagaaggcggttgagtttagccccagttcccaacaggtgctgtggggaggaagaatttccagctgccaggtcagcctcttagatccatttctctttttttttttttttttgagacggagtctcactcttgtcgcccaggctggagtgcaatggtgtgatcttggctcactgcaacctccgcctcccaggttcaagcaattctgtggcctcagcctccctagtagcagggattacaggcgtccgccaccacgcctggctaatttttgtatttttgtagagacagggtttccccatgttggccaggctggtctcgaactcctgacctcaggtgatccacccgcctcggcctcccaaagtgctgggaatacaggcttgagccaccgcgcccggcccttggattaatttcttcatgcttaaaatgaaggaaacgtgaatcattgataaggtgtcccctctttaacaaagcaacagatggtttatcagggcctctcttcgcaggcagtggggcctcatccacaaccctggaaaagaactggaaagcgttgctcagccaggtacggagggcagggccatgtgggactcccgtctccaggccccctctccccagctcccgtttctttctttctttctttctttcttttttttctgagacggagtttctctcttgttgcccaggctggagtgcatgttgctgtgcactttgagggcaggaactggctcctgctccagtttgcatcctctgcgcccggcaccaggcccgtctgctcaatgcaggataagcaggtagcttcgggctgtccacccagcccttgcagagggtggagctacagagagcatgagtggccaagatgaagccctcattggattctttgactctttctactatgtgagatattcttgatgtctgagggatgaacggcaaacaaagtgtggcctacccatacaatggggacagtagttagccctaagaaggaaggaagttctgacgcacgctacaacacaggtgggccttgagaacgtcacgctaagtcaaagaagccagttggaaaaagacaaatgattgtatgatttcactcacatgtggcacctggagtcgtcaaattcagagacagaaagtagaatggtggctgccaggggctgggggaggcggaaaggggagttagcggacacagagtttcagattgcaagatgaagaaagttctggagatggatggtggtgatggctgcacaacactgtgagtgtatttaatgccacagaatcatacacgtagaagtatttcagatggtaaatttcatcttttgtgtatttaccataatttttaaaaactaagaaaattaagatatccttgatgtcagatgccaggagagcggtgtcaggcatctcaccagccgattctcccagaagttttcctccatcgggtaaccacgagcctggggtatcacaaagagaagcctcagtgtaaaatcaacaatctcagtggagtggcttcatcagggagtgacaggggcgtgatttactactggaggacaaggcagcaggcagggaagatggcccaagcctgctttgaactgtaaggagcacgcagaacctcttatccagacccggagggctgccctgttgacagcacaagcagctcagggccagcggcgcaggaaaaccccagggtccagccaggtcacgggcacaggcctgcactcacgggtcactgcagtgaggatggaggtgtcactgcaaatgcgtaagaggatattttcagcaatagtaaaatttttaacagattttagaaatgaaagggttccccctgcatatgtcaagaacctgagtttctttctgaaacttgggtgggaccctttagagttgcttcaaatagaaaacacaccatcggcggccactcccctgaggaaaggcagacttcatggctgaaagcgtcacccgagtgctcccggttttcagcatcacacggagtggctcaggtgcccattcattttatgagtcagcctggggagagtacccacagattcggagtcacatctctgatgggacacaagctctaccctttccaagcattgatgatcctgaggttgatcaatactgagcattgatgtctgtgaaaacaaatcacttaggtgcagagacaccgcaatgaccatcccgccgggggcaaccgcctgattccttccacatcctggtcaacatccctggccaacagggcagcccacggacagctgctctgcctggctcctgctgaaaagccaacagcacaacaactctgccctccatacaaaaccacatgggccctcgagatcacactggggcgccccctttgcccccacttccttgggctgtggctggcctgtctgacatttgctctgggagatgagccagggtctgcccaggccaccacgggggcagagacgtgaaacaggcttcagctactaattttccattaaacgacaagaaaatcggctattgtgagaagagtcacatgaaggtacccaaaagttgtcacagtccactcactcgaaataaaacccatcccattaggaacactgtcattgcagcccatctccagcactctgctctgtataaaagactgactgtggcaagataagggtttaaaattgaaaatcaaagagccattcctcagtgatacccaggaaatgacgcacacgggctgatattaaacccacccacaccaagaatcctaaaagttaacgtacagattactcgttttcaagcaacacacaatgatacaagtaagtcctcaagaagactgcatgggttgaggcactggacttctaatcatgccatctctcagctcaggggtccacgacaaagctaaccccactgagatgaaaagccacttacccctttttcatcactcgcaatacaaatttcagaacccatcccaaactggaaggaaggatacgactgaaactcaactcatgcccagctaacctgggaagtacaccctcctcagataatggagacccaccaattcccgggtgtcagacgtcacacaacctcttctcccaccagggctggggaccctcaggaaagtcaggtgtccctgagaaacacccggcaacatgcagaaccacagagacaggaggcaaggttccagacaaatacacccagtagacagttaaagatttcagagctggagagagcttaggacaccccgattctcagactgcagacagcaggtggacaccactgagctggcgacagccccaaaagaggtcagcttgactgcgacgaggggacgtcttcattatctgtccagtgctctctgacatcaccccaccccgcctcctgtagcagtgttctatctacatgaaattaacctcacgtataaaacatattcctggttcattggcaaacaggcagctctgagcagcacattcagaagttgccaactttgggaggcagaggagttcgagatcagcctgggcaacatggtgaaaccccatctctaggaaacatttataagtcagctggatatggaggcacgtgcctgtgatcccagctactctggaggctgaggtgagaggatcacttgagctcaagtggtcaaggctgcagtgagccaagatcacaccactgcactccagtctgagcaacatagtgagatcccgtctcaaaaagaaaagaggttgccagattaatccagtacacacttctttaatcccgtagtaaattttctctttatagccaattcccaaagtcaagtatattgactcataaaaataccttctgggaagcatgtgactgatttccagctgagaggccctgccactggatggttaagttcataggccccagagtcagaagggggttggaatctcccctctgccatgcctgctacttggccttgtgtacgctcgcgctcgtgcgcttgtgcgctctctctcgctctcgctctctctctctcatgctgattctgcaggcattctacaggcctcccatgtcccaggagccagctctgtccacagtgctcttcctgctcctgctcctggccaaccctccaaccaaggtgtctaggagccacagggaagagcgggttctcttgctagttgctcttccactaggctgtgacacgctggccgagctccgcctccaccggctctgaagacagcacagacaactgttccacctcttccacttccactgagcagaggaactgcgtctgaatgaagccagaaatggggcatttggggaccgcaacagagaacggatgcctagcagatgggaagacgacaaactaacaaacacccaggccttggacccacgcctcccggtaggctccctctcctctccctctcccctccatcacacttcgaaccttcctgggcctggatcaccttcctggaaagctgaccacccccatgcctctgggcgccactcccctgccctaccaccacagggcaacatggggccacatcacgccaccctgcagctcctgttggaagaggctgaattcctggcaacacccacccatcagtcccaagccccgagcatcagtaccttcatgcaaaaggcactaggttggctgctttatctcataagatgagaaaatgatgcccatcaccataaacacattgttagctggtattgatagctgttaacaccctgaacaaagactaaatgaaaatgatggaaactagtgtaaaaagtctatgatgtgcaaaataacaaaatctaacctagcagtagccactccctaccacttgtcacaaggaagcacgaggaactcacagcaactggcagctcctgcagggcggacactgcaaggtcaacgctagaacataaatgacagggaacaactgaggatgaccctgagcttcacagactccagggcctcccctggggccatgggtcccagtggaaatttggtggcacgggcagcacctcctggcacagtcagggtgggggctcccctcaaccagtttggtccacctccatggaccctttggccactgagtcacacatgctggccccaccacctgctttgagaaccagggctgtgccctaccctcttctccctaccccctcatctgcctgtgcacccagggggccaccaccactgcctgggggtcctcacgtttggaggaagcagctgaggctaccagcggctgccagcttgctggcatgggtcccagacattgccaccaccacagccactgatagcacctgaggagaccctctgagccccctgcctgaggccaagcagcagagaaagccacatcctctaaggcccccatgggtgagtacccatgtgacagcccccgccagaccactgcccttgcctggagaaaccactccctaagacccctctcctccagcttgcccagccacacagggaaaaaaactcacttaaactgtccaccggcctgcttccactctgtgacacagcggctgccctggggactgctgagctacagggacccccagtcaaagagccaacccactgaccatgaagcagaaaggccctcctgaggagggccccagggatcgcagagtggactagtatcaaacacccctccacgatggaccccataacaaaaggcataaataacaaaaaagaaaggtcgacgatggcaaatgattctccaataaaaaaatacgagaggaagaatgacaaaccatttacatcaccagagagactgaagcaaggtgggcaggcagtccacaaatttaaaaggcaacaacttttctacagaccagccatgatcagctagaaaacaaggcaagaggaggggatgatcccagtgacaacagcagcagaagtgagagacgcacaaacatgcatgaataaagcaatgaagctccagtgatggaggcaaaggactttttacataaatcaaaatctggatgagaagaaaatacaaaagctctctcctctccccacccccaacccccaccataaaacccacagagcaaccttaatcaaaatcccaatcagaatatgggatgaatttagtttattctaaagtttatctagcggccgggtagggtggctcatgcctgtaatcccagaactttgggaggccaaggcaagaggatcacttaagctcagcagttcaagaccagcctgggaaacttggaaaaaccccacctctacaaaaaacacaaaaattagccaggcgtggtggaccccgctacttgggaggctgaggtgggaggatcacttgagaccaggaagtcaaggctgcaatgagccgtgttcgcaccgctgcaatccagcctgggtgacaaagtaagacagtctcaaaaaataaataaaataaataaaataaggcttatctattcaaaggaatataggagaaaggttggcggagaatgaaaaaagaagaggaatgaagaggtaatggccctttaagataactaagtcttaccaaaagccaccgtaacttacacggtagatagtggcacaacaataaagcagtaaattagaatggagaatccagaaacacaggagaaacactcagaacacagcagctacttaacccatgacaaacctgccaaaacagagaggtcaaagtggctgactaggaaattaggttggaatcctataaaaaaaaaaaaactacatccacaaatcacaccgtatctaaaatacattttagatcaaagaagagatgtaaatgtaaaaaaatcgagactatcaagtattagcagaatatgcaggagggtggttatatacattagggtacagaaacccattctctaagtaagatacaaaattcaggagtaattaaagcaagcttgatagttttaacaatgtaaaatttccaaatttttacattgccagagatgtctttaaacaaattcaaaggacaagtggcatctgagagaaaatatccgcaatatatatagaaaatgaggaataaccctgtgtaccaagaacacctagaaatcaacaaggaaaagcttcacaaatcaagagaaaaacaggcaaggatgaaaaagagaattagaaagagaaattcaaattagtagtaagcacagaagaaacagcttcttataattcacaatttttacaaacacaaaatgaaataagctatcactttacacccacttgactgaatgaaacacaaagactgatcatgtccagagagcgtcgatgtccagagagtgtcgatgtccagagagtgtcagtggggacaccgctgccccacacactagcatcatttagaatggtcaccacctgtcaagagagcaatctggcaatatctgttgacactctgaatgcccaaaccattcagccccgcaagtccacttctaggaatctatgctacgaaaacaaccccatgcagatgcaagggtttaatgtacgagactccacctgtcagcattctccgtgagtgtgaaaaacggaacaacccaaaagttcaataaataaacagtcacatattatgcaagcgtcagaataacgctgcttgcgcaaaggacaagggaccatctctaagacacacagctggtgagcggatcgaactgcaaatcttatttacagtaggatcccactttgttgaaaaatacttttaaaatatgtatgtatttaaaagacaagtaaaatacgtccacagacagaaaaagaaaacgggaggaatcgccaccaaactgtgaacaatgattatctttgtgggcactgaatggggcagtggtgaagttagggggaagctttcattttctattctacatgatgcatttctgtaaagttctaatctttataattagtacatttgaatttcataatcagaaacagatatttaaaggatctcaagatctatgttatatagctctatcatatgttaggcgccacccccgttgatggagccagggtccttctcaactccaaattccactgccagaaaaatggcacctttcttctccagagatacaagataattgcgagaaggcaaaatttttttaaaacagagacatcaagccaggtacagtggcatgtacctgtagtcccagctactcaggagaccgaggcaggaggattgcctgagcccaggagttcaagtccagcctagagacaacatagcaacacctccatctcaaaacgcaaaacaaaaactacagatggcagatctatttaatgattagctctggtggggagcactgcccctcagaccttgacctacccaagcagcctctagttgttaaagacttctcagtattggagaataaaacaaaatagacaagcactttaaaattcaccagaagttaggccgggcacggtggctcacgcctgtaattgcagcactttgggaggctgaagcaggcagatcacgagatcaggagatcaagaccatcctggctaacacggtgaaacctcgtctgtactaaaaatacaaaagttagccgggagtggtggcgggcgcctgtagtcccagctactcgggaagctgaggaaggagaatggcgtgaacccaggaggtggagcttacagtaagccgagattgtgccactgcactccagcctgggtgacagagtgagactccgtcacaaaaaaaaaaaaaaaaaaaaaattcaccagaagttcccaaggaatttgcttccacacatagaaaataatcgagtccgttttttctgaaaacttgctttaaagtccaattgtggggatttgatgtagatggttccattttaacttcttcagccagaggaaatctaaaaattcttccttccagctcaacagagcaaatccacctactgctctgcaaaaggaggacaaagatcctcctggggccgcagaattcagcagcttttccttggattcctaggacaaccaacagctgtgggacactaggccaagcttcaaaaggcagcctgccagccatcggactcccaggcacctgtggagtcctaggcggttgaggaactgggggagggcttggtttcaacctatttgccaaatcaccagcaaaacaagacatgttcaaaagaaacaagtgcacataaataagccagggctctactccccagcccatcaggtcaccggcccagcccctcagtgtgctggtgagcaggacaatcagaaaaggcctctcttcctggaataactaacagtctctcaccatccccactcccactgcccgatgtgtcatgggaagtctctgaaattcaggtttgggaaatcagttgacatgaactacagcataatattagatgtctgattaaaatcatcaagatgatacaaaggtctaatcgcagaggtgctctccactcccaacccccacatcaaatggagctttctctccttcaaatcagacttctttttttttttttgagagagagaagttctcactctgtcacccaggggagggcagtgacaccctcacaactcactgcagcctcaacctcctgggcttaagcgatcctcccacctcagcctcccaagtagctaggaccacacccgtgagccaccacatctggctaatttttctatttttttgtagaggtgaggtctccctgtgttgcccaggctgatctcaaactcctgggcttaagcgatcctccctcctcagcctcacaaagtgctgggattacagcatgaaccaccgtgcccagccttcaaatcacatttctaaggagcctaacaagcagcaggcctttccagttacagcgcatggaagtaacaaaggcagcctcagccagcatccagcgcagtcccagcagacagggataatgaagcggacgtgggcctcacgggagggaatactgtcccccacctccacaccatgctagtgagaaaaacagactgcctgcagctccaaaacatacagcaacttacctatcaaacagggacctctgacgcttcacattatcacgtaagaaatgtttcttgcccagcagcccccagaggatgaacagctccctccacctgaaaggggaagagggcccaagctgcaggcgccctggcctatcgaggccgtggacaggaggcacccgaatgtctccccagaccccaccctgctgcagaggcctctgcagcccatcaccctgcagcgctgctgttcccgctgcttcttggagaacaggggcaatttaatctacaaatcctgtaaatccttgttaaaaaaaaaaaaaaaaaaaaagaagggtaaaataaaacgtctgcactagcaaggctgggacttggcatcagctgccacctcctacagaacccagtggggagtgggctccagagcctccccgtgatgctggcagtgcctcggccagacacctgcccccgccaccctcctgcgtcctcactgcacccctccccaccccatgtcacatcttctgctcatacctccccacaccctcctctcgcctctggatgcacctctcaacacgcccctgaccgcgtcttcctcccatgctctgaactgtccactagggaagccagctgcagaaatcactctcctagaattcacttggtaaaatatgtgttgttattggcccacctactttgctcccaacccacagcaagggctctccagggctaccaagcccctaatggtcaggaactgccccccaacccccatctccagctctgacctacacaaactacataatcctgctgccaaaaacttggccctccctatgcccagggtgccacactccaggctggcccttctgccgagagggctcttctggcctgggctctgaacgggcaaacccacccactcttctaggatggggtccatgatccaccccaacctaccgtggggctctcacatcttccagactgtgcctctctaggagggccttggacccagagccagaatggggctctgatgccactgcacattctccagcaaccccttccatgcccttcctcctgatcccacccagctctaaactgggaacaagaaagctggaatatagtagcttctcagaaaatacctactgagtacacggctggatagatggacagtgctccaggcaaagggactcgggggtaagaaaagtgaagggtacctgctcccggttgtaccactgcagagtccttgagtgtcaaaggactgagaggtgaatgacgggcaaggtgagacctaccaggttagtgtcccgcacccctttgtttccactattagattaagccaccctatgtgacagataaaaggagcaacacatacaaggagttaggccggggttgccaaagtgaggagtgggaatgctgccagtccaggggtcccccacggcagctccccaaatgaaaccaagacaagttggagatgaggctgcctctaggtgtatcaaatcaactgaagtagcaccagtcctcagtgctgattaagcacaggcacgcctgtgatcaagaagaaaaccattacttaataaaatgcagttaatttagaagctgaaatctgtgaaagctcaagggaaagacacaatcaggagttcttggtctggaggggcttctgctctcaaagcttccaacccaacacagcacaaagacgtcttccccaacaaccgcacatcccacctgcaaaacgatgacacgctcctctccaggtacctgaaccttaggactcaaagggtagagaaagttcacaggcagaatcttcacaatacatgcacaaaacaaaggcacttctagtaggagctgtgggtcaggaaaatctcgacttcacccaatgccattcccgagacaatcagccatcaatctgacccactcagtcctgcctcaggggctcagaatctagcagtcaggccaggtgggaagtgcagggacctgtggccaaaatcggcccactcatcactcagctgacagctttcacgcgtactagccagaatcagttagaggctggaggtagtgccaggtgtctgaaacccagcaggcaggttggtaaaacactcacacatcctaaccctggtgactgcactgactgcgtgctttactgtagcagaacagttgcacacatctcatctcctccatccatagtaactcagtggctggtgaggaatgggacacagacctccacgtgcccttctcgggatgagtcaagacaaactctgagcagtgacgctctacagctggctcacacgtggaggcagagcctggcttcccagagcttccagttcctaacacacgcctggccccactgcaccacacccgtgacagctgccaccagctccggataattcagacagatgctagagcacatggctcacttattacaccaaaagactgagaaacagaaactgtgttttaattgtacaatgcacacacttgcttccagagagacctgagaaatccatcatccctaaatgcatgcggttactcaactagtggctttactatttttgaaacaatggatttttccaagacagttgataatcaaaccaactgcgggaaaccataaacgatacttgtttattaaattaagaacagatacaacagttcagaggaattcatatttagagctgccttgctggagaatcaattccaggaatgccaaaccaaccaaatgaaaaaaaattatatatatatatatatatacatatatatatatatatatatatatatatatatatctcacacacacacactcgtgtcacttaacgacaggcatatatatgtatatatatatcacacacacactcatgcgtcacttaacgacagggatgtattctgagaaatttatcattaggcaatttcatcattgtgagaacatcatagaacatacgttatacaaacctactacaacacactaggttatagggtacagtctactgctcctaggctgcaaagctaggcagcatgttactgtgctgaatgtgtgtatctaaacatagaaaaggcacaacgttaaaatatgctataaaagataaaacatggtgcccctgtctagggcactttccatgaatggaccttccatgaatggaagttgctcgggtgagtcagtccgtacactagtgcagactttatagacattgtatacctaggctacattttaaaaaaatatatttttattttttaaatattttatatatttttttaaaataaagtaactgcactacaactttaccacaatgtcactaggcaataggaatttttgagccccatgatattcttatgggacctctgtcatatatgctatcattcaccaaaacaatgtcatgtgatgcatgacagtacatatgtatctcaactgaaaatcctaaatgtcaatagtgttctccgactcactatttactaataagagtttcctcagaactgtctttgcctgagagtttcacgaccaaacgtctctctgcacagttgattctagggacaagaagtgctaagaatccatgttggcttcaagtgcaaaatggaaaacaccttagtgtcccaccaaccacgtcagccaccttcctggagggctagctcccagacccttttcccatcgctgtatagggcccacgtcatctgtggcatttccacgactctccgatgccagccatcagtctctcggcttgtgttgaaaattagcacctttacgtgcccaccagtggtcatgagtcctagtcatgcccaccctgttaaaaacaaatctgatacaaaatgggccccagcaggagacagggacagaacacggacctcacactctctccagctcagactcaaaggccagcactgccccatcacagccgagtgctcttaggcaacccacagctcagctacctgtccccagcctcctcgttgcaaagttaagacaagacctgccttctagatttgtcgggaaattatttaaaatgataaacaaagagggatggaactcaacacacagaattgcccgatgatgtgtgtttcattccagtggtttcgccatcaaaaccatctttaaatgttggagtgtttccgtttccagacaactagagatgaaaatattttcacagtcactcaacgcaggtacctcaaccacgtattttttctcttaattttgatccttgaaacacaaaacaacagatgcaccaccttacattaaaacagccctttagagtttagagtttatgacaggccgcctctgcattctctcactaggccgtagctgtaactcacaaacctgacccttaaaactcccaggacaataagagaagccacaccatggagctcttgctgtcataaaatatctcgcatcagttcaatattgcatctcgtctgtgcctcaaaacaaccacaggcaagaggcctcacgcgggtattgcagatgctgagaaagactctcaagccagaagactggtcctgggccccagggattagtggcagggccaggctggaactgagctcctgttactccaaatcccatcctcttttctgacctcccagtccctttctcataaaaccaaagcatcttctccaaccaggccaggacacacgcaggagagagtcaggcaggaggaggcttctggaagggaaagcagagtggctgagagccctgggacagagtctgacattaggtacaggacaagtttggaaagatccagatggagcgggaagggaatctgggcgtgggggtgcctccttccaaagtgcatccacatccgaggtgactgcagggagacgcagcgctgactttggcagcagggaccacccgggtgcagagaacccaaacaactgaaaatccaaaaaggaatctcagtgcacagtaagaaagctcattctttgggctggttaccttcccaaacacgttctcctctggcctatgtgaaaccgacgttgcactgtacaactctgaagctctttcttgactgcccactgaatgagggtctgtgctacattccaggaggatccaaatgtgaacacagctaggttccagctctgggactcgggaaaaggaggcacaggcagcaggacatgtgctgcaaggagactactgctcccgtgtttcattcactcactcatccaacaacagcactaaggctctgctgtgtgccaggcacttttctagctactggggatccagaggtgaacaaagtcttttacaattgagtggtaagagactgacaataaacaaacaagtatataaataacacactgaatgttgagtactaaggagaaacacaaagcaaggttaacaagagaaggggaagtaacgctaatttatgtagggctgtcagggagccggcaataagtgaggggccggccaggtgggcatctgggggtggctgatgccaagggggtgggaacagcaggtgcaaaggcctggaggcaagagtggcctggcaaatccgaggaccaagggataagatgaaagagcctacattcagttaggatctccgggatggacatgggccaagatgacaggtggggatggggtggggacaacccagggcagatctgggcaatgagcctgtctgcctggagccaggagagcctggaggggccattcttgggagcgagcgggggaacttgagaaaaatcaggccgagacacatggatgtggagggagcactggaaagccactgaaggcctgggcaatggtgacacacctggcctgggccaacttgcagactcaggggtaccccacagcccaacctgggaaacctcacagccggcacagaaatcataaagcacacagcaatggcaccccaccagtacgcagggttccacatagagagcctggctgcatgatcttgaggtcacctaactcccgggcctcccttgtgtgtctggacagggagagaggggaggattggcttcaggagaggcgagaaacgacagtgcccatgacagctgactcagcctgtgccagcaggctgctctgagacatgagctggacccaacccaggcggtgggcagcaggggggtggggaggaactctgggaaaggaaggagccagagaagtctccctgtgggcgctcgggccaaccaccacccaagggaacaatgagcacccccagcccccgatgggcacacaggctgcctcctggtgagcaagcgtctcaaacctgacctacatctgggaggcctgcctggtcaccagggactaccttacaccctacctgtgcctccacgtccccagtgctcacggccacctggcaagggtgaggaactgagactgcgttgaggacacacagcctgtgagtggtacagccagggccgctgcccaggcccagagctctctccgtttctctaaggaccaggctgcaaggcagggcatgtgatctctgccgaagacattcaagccacccagtgatgtgtgctgggcctcgatccccaccgaccgccagtcctctcctcccctggacagtaaaggtttctccaagacttcagacgacggtgtcacctgaggccctcacctattaagtcaccggggcaggtatgcatggcagaggacacggaggagtgccggagaggagctgaggcctggagggggcctctgcagccaggctcaacccccactctccccactccaacagccctcactgcagccaccgcggcccaatccaaacaaagcccagcctgatgccaatctcaccatcaactgtttttcctctgacttcctcagttttgtctaggaaaaatcaaagtgtcttatcccatctctaagcttccaggggtgtgatcagtgtcttttacaattaccttttacttttatccagcatttcttagctcggttggcaaactggatatttatgcacctccatttcacaatccatctccaccgattattcctgtaaaacatttttttttttaaagtttagagttacttaagaaggttatgtaaacaagttaaccagcaagccacaacttgggtctgcggtgtcagagaaaacatgcaaggtgcaagagaatgaggagctgatggtcaccagctttacctccttccagcacccactcctgctcacacacactcacaccccgtgggactcagcctgcagcttctcccagcccaagagccagacagtggggaggagcacagaccacacttcctaacaaatgagagggaagacttcgtgccccattgctactgccatcacccagtcccagcccagagagggagcccactccaagggcccccctgccagtactgctagagcccaccgagggctgccagcacacagctacgagctccagctttatctactcacgccctggacactgcccggagccccagcaggttccacgtgtccttgtcaccccagccctcctgccccgcggatcctaagctcaggagaccctctccagcccaggctgtgggggaaggcagcccccacggtcacccaggaatcagcgcagagtgcagggcatcctggactccccggactgggaaacccagttcctgtccccctgcgtagtggccacacctctgggaggggagaaacccctgcctcacctcactggagggaccctgacccagaggcctgagaaaaagccaccggcaggctcctggcacctgccaacctgcaccttaggaaaacttgtcccacttcaacctgcaaagctctcaggtcattacttctaaaaccactgtcctttctgaaacaggaaggaaaatagaaaaacaaacaaaaacaaagaggcacagaaggctgaagacgccagaggcagtttagcccaaaaacaaagtgccagacacaagatgccaagtttggggcgcttcctccaccgcatgcctgtttaggagctgactgcactcaaccacagatttacgtctggtgcctgccaggtcgttatctgaagagatctgaaaaagtaagcctttcttctgccagtaaatactaagttaagactagcaggcccctctaaggctctgctctccactggggtgctgcaggacaggcccctccgcgggcgttccccgcaccctccctccgcgtcggcccggagaaaaggaagttcgcccctagcctgggcttaccaaggcccgccgcccgacccatggagccctgcttggggaccgggggcctcgatgttctccttcaccatctgcggccagatctccctccagcagccttgccaggcagtgcctggcgtggagaaggggccctgcagaggcgcaggtccgcaccgtgcccccaacccggcgcctgcagcccaggggcaacaaggtgtggggtttttgagtttttccctctgggccttattatacagggaaagggaaggggcgaagatccgggctcgagttctcccagggaagtgaacccagaggcgatcccaaactcagtagttgccgcccggcacggggacttgatgccggcgccaagccgggcagcggaacgcaccagcggcccgaccagcccggcgagacgcgagcgggcggccccgccagacagcgccacttgccggcgccgagagtggcccctcgccgcggtgagcccctcccgggatgcgaaagccatcgcctagtccccgccgcacccgcccgcccatcgtgggaggaggatgggccggtccgagaggcgtaaggccgccgggctgcacccctagatcccagcggcggcctccccgcagccccgccgagtccggggggcagcgctcgggagctcttggcccgcagcttacgcgccgccccccacgcgtccgggtccccgcggcgccgcgggcggcccaaggctgccgccgccagcgagtcaggcagccgaggttccccagcttacctggccagggcgcggggctgccccggtccgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgccgtcctcgccgcgccgctgccgggtctctcccgggggctgagctcccgcagagctcgcgcctagccgcacacctcgactgctgattagcccgacagctgaatagcggcgggagcctaccgcgagcggagtacggaaagcccgcagggccgcgccacatggcgcacgcgcactgagctgcatacctaggtgacaaacgtgcacgttttgcacgtgtatcccagaacttaaagcatgacaaaatttttttttaaaaaaccctgatgccattattaggaacaatttgaatagatcagtcacaacctatatgctggcttctggtgtctcaatttgtcctgggaaaactgttgtaaagcaatagtatgtcagtccttatatacttatccatctccaatctggaaagacaaggcttatatgtttcctttttagtcccctaatttctctttatgacacaaatccagttggcagtattaaagatggggctgattctcctttacttatctggaatatgctaccattccagataagtaatagtaaaatggccatttcctcttgctaatcaaatgtcgtttttgaacacaaaagccactgggtttggagtatgaaacataaacataaaacatatcatacactatctgtgacgttttcataaactcacatgatccttttatatttttctcttatataaaacgaaatactttccattaaaaattgagatatttaaatgagaaaatgcttgccaatgttattaaaatataaaattttattatttattcaaagaaaatggtcacttttggtttgtgctaaaaaataacagtaacagtagaagcctgctttaaaatattttaagtgtgcgatatcatattacttctcatttactctttgcgtttctagagagccaagtttatttttttctcaattcagtttaaaatcagagggaacaaaatttgaaacgtgacataatatcaaggttaacatgctagctatgtaataactgtaaaatttggccacaaatgcatttgctttgagaaaaatgatcatgtgaaattcctaaatatttgggccatatggaagatgatatcagaagaataatatattctctgtatgtcaaaggaggaggataataaaaaccgtagttattaggttagtacaaaaacaattacagtattcgccattgccaaaaattgcaattgcttttgcaccaaggtagtaataaaagtatggttgagtttctgtagaattccggcaaaggatgagcatccttaatctgaaatccaaaactctcccaaattcgaaattttttgggtgcccatatgatgcctcaagtacaaaattctacacctgacctcatgcaatgtatcatagccaaagcacaggtacacaacacatagtttattcagtgctttcaagagaaaattaaaattaacatgaggctacatgtaaataaattttgtgtttagacttgggtcccatcccaagatctctcattatgtatatgcaaatactccaaaattcaaaaaaattcacaattttggatttttcaggtcccaagcattttgattaagagatactcaacctgtccctgtttggaagcagttccctctagatagattaaactggcctaacaaaaggtagtatctgttgctggagttgagaaagaataaatatttacatacaaaagtgagggcaaaagaagactacaaaaacattcttattgaaattaaataaaattatgcccttttctctgtgtagctctttggccagtttgaacaatgaataccaagagccaatgactgaattctaattatatatttggtgattatgctcagacagacttgaagagagaaatttcataagcatcattttggcatttgattttctaataacagagcatctcaaaatatttttattcttcataattcccagaattttttttttttggtaaatcttgcatatgactccaacgtgcaagttatttgtaacactaccaataacttttctattcttttggaggagaaaatattccatatatatatatgtatatatgtacacacacactacatatatagtttatatattccgattctgccctattaatctataaatgtatgcacgaagaaaatatgtaattactgggactgtaaactatatttatatcagataaaatagataaataattctattagttttatttttcaaatatatctgtgtattaggccgtttccttacagctgataaagacatacctgagactggacaatttacaaaagaaagaggtttagttggactcacagttccacgtggctgggaaggcctcacaatcatggcgaaaggcaaggaggagcaagtcacattttacgtggatggcagcagacaaagagcttatgcagagaaacctccagttgtaaaaaccatcagatctcgttgatgagatgagagcatgtgggaatgtgggagttacaattcaaggtgagatttgggtggagacacagctaaatcatatcaatccatttcctgaaatttgctctgtgataaaaagttaagagtcagattatctgagtcaaaaaaagatataaactggcattttagcttaactagttataaaagtataggttaatttaagaaaagctgagggttttaaaagaatatttagttttatgcatagaaaaaaggtataaaagtaaaaacctgctgctcatttgggtattaaaggtataagtgttaagtataaatgttatattttctaattggctagtaatttatgtacttttatttacatctttttgtgtattaatttttcccaaaacatactgaaagtttttgttttaatacttttctattgatcttcacaattttcaacttcttcaatccaaatttatcgattagtaatgatgttgcttttttctttttaaagtttttacctattatgttttctgccatattaatcagtattttaaaaaattactaatggctgtaataggagacacacacaatttgttaatgagaatgcatcaagtttctcaccattaagcataatgtttatctgtcttcatacagccatatatgttttatatatgtgtgcacgtgttcccttgtgtacgtgggttgcatatgtgtgtgtagttattatgttaagacataccatatcctttattaaactcattgaaattaagaaatgttaatatattcagatgcattttggtatctttggagataatactgtgatatttatttagtaatatgatatgatgaaaaatactaacaaagctattctcacattgttgccacgaatctctcgtggtcatcgactatctttttttttttgagacggagtctcgctctgtcacccaggctggagtgcagtggtgcaatctcggctcactgcaagctccgcttcctgggttcatgccattctcctgcctcagcctcccgagtagctgggactacaggcgcccgccaccacgcccagctaattctttgtatttttagtagagacggggtttcaccgtgttagccaggatggtcttgatctcctgacctcgtgatccactgcctcagcctcccaaagtgctgggattacaggcgtgagccaccgcacctggctggactatcatttttaatagaacgctcaattcagtttgctaatattttatttggtgcttttgggcatacattttcaggtttttaattggaattgcaatgtcatgctgacttcataaacataattccaagattgcctttctcttcaaatgttctgaaacattttaattatcaagggaattatctgttcctgaagtttggatagatattactcaaaatactggtgaaccctggtatctattactggaataggggaagtgatgagaataaaaagctgaggccttttgtatcttggtgatattctctttttatttattttgtctttattcagtaatctgctttgatatcctgaatcagtatttccttaggtggagagagttttcttatattgaatattagattctttctccaattttacttttagaactatagttaccattctgtacttagatctccacaacttattcatcctgcctaactgaaattttgtacactttgacaaatatctcttcattttttcttagctcctcatttattctctttttctattttctagaaacactgatttttacttggggtatatatttttatccccccatatatatccttttcttatctcttattgtctctttgtccctttcccttggatcctaaggaagactcctatgttttcattgacatcatttagtgttctatagctttaattcttttcttcattcgttctaatgcagcctctagtgttcctttaatattttaagtttccttacaatgctaccttcactcggttctctttttcttgccctgtaattggccagaaaaaatatttgctgtattttatattttatatcatgttttttcattttaaaatactttacagttacatattttaaaatatcttactcaaatattttaatatattttaacacaatgttttatctgaaatatacatttatatttcttgtaattattttattcacaaaccttttatctgatgttttgttttatcacattgttaaacatttctgaaattatcatgtactgtgtgtgtatatatatatatatatatatatatatatatatatatgtatgtacttatcattaaataaggcaggatctacacattgttttgatatcccataaacagagtatacaagtgtatcttggttccctctctatccatctgtctcagctcattttatgctgctataacagaataccacagactgggtaattaatttacaaaacagaaatgtatcggctcatatttctgacaaattcagaagactaagagcatggcaccagcatgtagagagggctttcttacttcttcatcttatttcttcatgttatggaaggcaaaatatgaaaagatgaaaagtgacaatgtacaaaccgtgtatgtatgtgtgtatgtacctaaaggtcccacttctcaccactgtagcattggtgactgattaagttcctaatacatgaactttgggggacacattcaaactataaccccatctgattattcgtagagttctcaacagatctcaggcagaaggctttttgataggtccagccctttatcaattgtagataattagaagtgatacacatctttaccaggcttcacgccttccttctgccaagcttacattcctaaacataaagcacatccacattcacttgaatttttcacctatattgaacttcttggaattcgaggcctcaaatcaatgcagaataaaaggagataacggtaaatttgaagaattaaatgatcatgaccatttttaagtcaggtctttcgcaatgaccgtggtcaataatggccaagacaaatggagatgaattatacatagaatgaatacattaaaatgtcatctacttttctttctccagaaggattcactgttctatgtgcgcctctcatctgcctttttattaattaacctttctactgaagtctggacgatctccaaccagtattcctagtttgtggtattgtagaaatatatttttgtgttttaacgagtcaacaaagcatttgtaagaaatcatcataaaaatctattaagcattcattttgcatcaaacatttattgcgtaaaataagcagatacaatgaaaattcttcttgatggtggaaaggtatcactgtaaaaaatcattatcatcttgggttgcaatacagcagtaaacacagagattttgatatatgtaggacctatattgctgagcttagctatgctctctgtattttgtttctttgcctttcttgtcaagttgtcagcaatcacttcacactactgaaaatataattaattgcctttagcagttccctccctgcttctaaccttatactttgaagcagaagcagaaaattactttggctgagagtcagagctaacctgaacgttgtattaagtggaggccaaaagtttctgaaaatgtactgggggctttattcatggatgaaagggtataaaacctttgttttattgatctgcacttcctaatttttatacttacaaccattgtccaaaattttatatattgcttcagatgtcttgtattccacaccaatggaaggtaccgcgtcttattcatccttcacctccaagttcctaccaaaatgcctgacatatgataggtacttactgaaaattgaatggaaccaacttactgattatctattctcccttggatatctcacatgcatctgaaacttagtatgtgggaaactgagctcattttccttcttccatgctcaacattgtcttttccctcctgtgtttcctattttgatgaatagcccatattctcaaccaattacctaggccaagagccttggagccaacctttctcttttcccctcactactcacaactaattgataaccaactgttgtctaccccctgccccccacaaaaaacagcagattaatccatgacctcctctccactctcactgcactgtcttggtcacagccgtcacaattcttcgtctggaatgtaatatctcctaatagtcctatccattccaattcactttccagattcctgacaaaaataatttttctgaagagaaatctgatcattaaatttagctgattgattgcaaaattaagttctccatgttagagatgagagtttgggaaaaagaaggcagcaagaattcacaaagaagaataacagagatcagaaaactatccacagagacagcttcagagattttcaggggatgtgcagatttattgaatcttccaattaatactgatcaacacaagtatgtgaggaaatggtcaaggccagggtacaaaccactagaaagggaaggcaaaaaagtctccagaattcacataaggtcataagtagtttgtgtttccattagccagggtagaaaatcctcgaatcagttagagtactcagaaggatattgtctcactaatgtggaaacaattctatctagactgaaaggtgctctggttctaccaagcaaagcttaaaagcaaacttcaacacaagcaaattattcctaagtaatttaactgcatcccagaataaagcttaactattcagcacaaaataaggtagaattcactatgtccagcattcgataagaatatatcaggcatagaaataggcagaaaaatgatacatattgaagagaaaaaaatcaatcaagagaaacagacccacaatgacacagttgctaaaattagtagataatgacattaaaacaggtatctatgtttgaaaaggtagaggaaagcatcaaatgagagacatgaaagagagagcaaaatgtgaaatcatcttctcgggattaatcaaacaaacatggaaacaatgtcttagatgaaaactatactggatgaaatcaaaagcagattatcaattgcagtaaaaaaacagtgaatgtaattgtttaacaatagaaagtatctgaaatgaaaaataaaaatgggaagagaacatcagtgggataacttcagtggcctattataagggtaactggattccccaaaggataggagggaaaaaagttttcaggaaataatgtatgaaagaatagttactgaaaacaattacatttaataaattgagctctcctcagcctaatgagtgtcaaaagtctcttcttttcttggactttctgctgacctgaacactgctttgagacaagtctacatgaaaaaaaaaatgaggcaaaggtaaagaaaaggaaaccttctcttggtcaatcagatgagatggctgaaaagaatgccaaatcctcaccacaagtgatggagtgaatggtcaccttggtccagagtgagaagactgtgagcctcaggatggttctaacacaggattacccactcacctggctgcagtccctgtaattcagacccatctttagggcttttcctcggatccacgagtcagcttcctgttttctcttatactcctcctgtctcggatcttcttagtctctctctaagctctacagaagtgtcttctttgttgtttccttatatactttatacctacctatgaattaccatcccctgaatgttatggcttctacgaaagataatgcaataattttatttttcttttgagacggagtctcgctctttcgccaggccggagtgcagcggcactatctcggctcactgcaagctccgcctcctgggttcacgccattctcccgcctcagcctcccaagtagctgggactacaggcgcccgccaccgcgccgggctaatttgttgtattttttagtagagacggggtttcaccgtgttagccaggatggtctcgatctcctgacctcgtgatccgcccgcctcgacctcccaaagtgctgggattacaggcgtgagccaccgcgcccggccaatgtttgtaatctagttatttcttagggaccaccagcactcactcttgtctgtgtttagcacaaagagcaaggggcagagtactcatcaactcaggaggaggaggagtcagtagagaaagcattcatgaaaaaaggcttacatctcagcaatttctaggcacaaaagacttatgaaattctaatattttattttgacagagttcttctttagcattatgttagatacaaaaatagattttgaaaaatcattttataataattatagtatttgcctatctgtttatgccacgtaaattctatgtataaataggtggagaggtagtcacaatattggggggcatgttgcatagtatcttgcaccatagctcactatcttttacataatacgctttagtatgttcagtaaaacacttttagtaaagggctcagaaattatgacagggtaataccagtcatagaatcaagaaaggcatctagttttatctacaaaagattttagaaataatcttataacatatccactaaattgaatgatgaacattagaccactttttattccattataatcttattttctctcataacgctatccattaaagtatagattctattgtaaaagcttctaaaaaagtatcaaatcttcctttgttccattccagctaagctgtgtttcccacctgttctgtgcttgctaaaaatataatgagaaaataaatgactatctaaagttgttttacaaaagactgtatcatagatcctgtgaaatccttcctgctttaaatcctttgagtggctggatatcttgaaatggcaaatgaattggccacagaacagtgcacactattcaaggtttgttcatggagtcttatttatcacagtgatctgtgggcatgataacataatctatacagtgttcatttttctcttaggtggtctgggcattcttcaaccatttattcaaacattatcttctcaattccaccttataatttttatttctaaagcgaagtgagcacagaccagatacctgtacctgggtagtggttttctaggatacagtaaaatgcaggatacattgaagagcaaatgggtgcagatgaattgaaaactcttccctctccacgtcaaagcccagttgaaggttggcatttgaacagaaaacattcatagacatgaatggggaaagttaatgctcagagttcacaagtgaaatgaaaccattcctactcactgcttctacaaatcactttataagtgatcctgaggaattctttctcatctctctctctctctcactctccctcctccctcatctcttccctctcctattctggctgaaactggcacctaagtcaaatgtagctaagcaaacagtgtctcagtacgagacagatatatatgtatgcacaatacacatatatatttacatgtatatatatatatacacacacacacatatatgtattattttttcctaattctacccacaaaagaggcactaataccttaagagccataagcgaattttgtgcccagatggtttttaatacctgtccctactgaaaggaacaagagcctcttggagaaatgtctggttccagggctgggacaaagaaggtacatgatgaaactggaacacctttttgtgccagaaagaaagggagtgctcaagaaaacaatgggaacatgtcaaaaagaaataggcaatagcttgaaggggctcctgctgaccaaatctagggacaatttgtctatcaaaataaatgaggattgcaacgattaaataaaataggatgattaaataaagtaggaaattattcatctattataataagcaaacaaagagatacgcgcatacataaatggataaataagcagaggagaaaagagaacatttctttattttattttatttttttgagacggagtctcgctgtcgcccaggttggatgcagtggcgcgatctcggctcactgcaggctccgccccccggggttcacgccattctcctgcctcagcctcctgagtagctgggactacaggcgcccgccacctcccccggctaatttttttgtatttttagtagagacggggtttcaccgtgttagccaggatggtctcgatctcctgacctcgtgatccgcccgcctcagcctccccaagtgctgggattacaggcgtgagccaccgcgcccagccaagagaacatttctttaaattagtgtgccacctgatacatgtgaaaggaagagtcatggagtggccgggtggagggaggcagggcggggaataccatttgcaactatggtggtaaaaaataatttaggcaagaagtatcaggagaatacttatctttgggaagagctggatgagaagcaggctgcttgcgtgttctcaaagtgtctcttcacagactgctattcattacaaggagaaaagtactaactaaacagtgaagaatgcaaatgacactttgaccttttgctgcaaagtaacctcaccaataagaggtatgtagatgtcttgtatttgggggatatatggtaccccgagaaggacaccacatcactgctgcattattccacttgcagctgtataaccaagtctaatcatgagaacacatcaatcaagctcaaatgaagaaacattctgtaaaattactagcctgaatttttcaaaactcccaatgccatgataaagaaaggcagagaaatgctgatagaataaagaaggtgaaagagatagaaaaactaaatgcagtatgtgattctagacatggaatatggactacatagattagatgaaaatattacttcagtgttaaatttcttgaattgtaccatcttcagatgcttatttgaggatatttaattcagtctggagagttttattgcagtttatctttcttcctagttggtttgggggaagaatttcttcagctgaaatgttttgactcatattttctgttttctacagcagcttttatattgcagtttttgtagttatgttttttattctgttcccaggtatcatagaaatggagttcctagttctagagtatccttttctataaatagagtaaaatgcagtttatttaataagagatgttggcactttgggcagaaagggagtggtaggcacgtggtacttctctttcatctggacatattccttaattttaccttctttttttcctttctgtgccatgactcctgatcaatcaaatagacaactgaaattattcacagatctgaaatgttttattatttctgttaccagatttgtagctcttcaatgcatgtttaacctgtgcacatagtctaattttcactgctggtgttgacagaaaaaaatatttcaaaaatggaagctgagggaggccgaggcgggcgaatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagtttgcagtgagccgagattgcgccactgcactcccgcctgggccacagagcgagactccgtctcaaaaaaaaaaaaaaaaaaaaaaaaaaatggaagctgaggattgtaacataatgtaggtatataatggcaatggcactatttctgcttttcctgtgctttgggtctacctgaagagtagtgtgcacttgctgtgaatggtagagcccacctacattaggctgatgatttattgttgaagtcaaaaaaactagtgaaattttactgagtagactcttgatcagcagggtagcagatgtctcccagaatattttgcttctcaaatttacagggcttctacctttcatagaaaaccatcctcacctctgactcatgtgacttatcttcgggtactgccttctcttggcagtctttgggactacctcaaagcagaattcatcctaccctgctcagtgttccctcgactcttcttccattatatggtagtccactggtgtctcaacaggtctgtacattatcagactgtgagctccctgctccctcagccagacagagattgaagaggacaccatctctttcaactaaattgtgtgaggccattacaaatggccgacatttgtaggccactacatatgggctactactcacttatgttttagcccagcccttgagtttgtaaagtgtgttgggttaaatttgtagttagacaatttagccgagggaagcttaaatgttctgtgtagagcagtgggagaaatatgttcttgttatttttgctcttcttgaaacaaaagaaacggaaaagggagagaagaggtgaataataaatacgaaagagtagaaatgcagtctgcaacagatgacagcagactgaagctagaatccagaccaggccaaggaactttatgattttaaggaggatgggtaacacacaactggaggtgttagcagtgctacagtggtcagttgtacacattttttctggcccttgaaaacttgagtaagttcagttaaaacacacatagcatgagtaagaattttgattttatgaacactaaggaaaatgctgtgtttgttacatgatagggcaaaataattagaaaaagaaccctacacatagaacagttgcataattttgaaacgaagttaaatcagaggaaatgtggggggcaggaggagaatgaccacaaaattataagcctacagataatttggaaaaatcctgaggaggattttcaagaaaatgttcagtgaaagcttggagcaatttcatctagtgtttaagaagaaggatttccttgctgatttctatgatgtgtttttattcatacacaggtacagcacctacgtagcacgtaataggctatttacttagatagcaggtgagcccaagatataatacctgtactttagctgttatctttagaaataaacatctaataggatctattttggcactgcaatggaaactatcaacattggaaaactcctaagtaagtgttcaacaatagagaaatgactaaacaaattacagtatatttgctctatttcgtacatgtcacaatcacaagattgaaatccatctatataagctgacatgttaagttcccttacacataatgccatgtgacaaaaaatatgttgccctactatacaactgccctacttatgcaaatgttcagaaaactatgtattaacagcaattgcccccagttgaaggatttgattggagggaaaaaaacagatcttcactttcctcttccaatccttttatgttacacaaaattttgtcatgagaatttatatatatgcacacaatatcaatatatttatattaatatttatcttattaatatatttatattaatacttgcataattaatatattattgttatatttatatttatattattgatatattagtaatataattattaatattacattaatattttaacatattaatatataaattaatacatgtatactataaaacagaacatctgtttttggaacatggttagttgagctaatgcaaaatgctttctgttacagttaacatggtggagaattataaaacttgtgcatagtgttgggagttcacagaaaataaatggagatggcaacccatagatagtgtgaaaaaacagaaagaggtgagattgcatgacaaatgagtaccatgtaaggtaaactttgttggacttatgactcagaaataggctctcaaaaatacaggtttggaagtctccttttattcaactttactgtagaatttcagaaggtgacattcactaattctacttgtacaattcaacaagttttgatagaagcatagttacataggccctaccacattcaacccttaaaacaatcccagccagaaactcctctggtgcccctattctatatatatataaatatatatatagagagaaatatatacatagaaatatatataaatatatatagaaatatatataaatatatatagaaatatatacaaatatatatagaaatatatacagaaatatatagatatatatatagaaatatatacagatatatatatagaaatatatctatatatttctaccatgcccagcttctgtgcccaggctggagtgcagtggcacgatctcagctcactgcaatctccacctccaaggttccagcgattctcctgcctcagcctcccaagtagctgggactacaggtgcccaccaccacgcctggctaatttttgtatttttagtagagacagggtttcaccacgttggccaggctggtctcgaactcctgactgggaatctttaaatgaatttttgtccttgtagttttgtgttttctagaatttcatataaaggaaatcatacatgaagaagtaagtaaaaagctaagatttttacttagcatcatgcattttaaagtaagtcttgtctttatatatattagtacttcattacttttttttttttggttaaatagtatttcattttatggatatgccccagtgagtttatttatttaccaattaatggacactacagttgttttcagtttggggttgttccatataaaattgctataaacattcatgtacagatactgtacagacatacatttttattttccttggtaaaaacctggaaatggaattcctcagtcatacaataagtgcacgtatgaatttataacgtaagtgctaatttataacataaagtgctaatctgttttccaaagtggctcatcaaaaacatatgagcgttgggttgttcatccttaccagaacatggtttggttttcttatctttatttttattttaaatgttccaataaatagtgatatttccttaagattttaatttgcattcccctagtgattaataatgttgatcatctttttgtttgtcatcactgtcattgttttttggtgaagtgtcttttcaaatattttacctaatttttttaaccaaattgtttggcttcttgagttgtaagaattctttgtatattctggatacaaattccttatctgatatatgatttgcaaatattttctcccattctgtggattatcttttaattttcttaatggtgatatttaagagcaggagttcttaatttttaggaagtccaatttttctacttttaatttttattatttatctcattttcttgccttatctaagaaatcttttcctaaccatgttcataaagattttctcaaatattttcttctagaagttctagagttttacatgttacattcaggcttctgatctatttcaacttaatatttcttataacaagaaaggtgaagatcaagactcatcttttttcatacggtcaccaagttaatcaagcatcatttgtaaaaaactctcttctttcaccattgagaatcaatcattgtagaatactagctgactatatatgtgtagatctatgtttagacactatattctgttccaaattattctgtacatttctatactttatctcaatgcaactttatcttactatagctttatagtgtgactttaagtcaaaccatatgaatcctccacatttgttcttttaaaatattgttttagttattctcaaggcttgcattttcatataagtttttgaatcagcttgtcagttcaacaaaaatacctgatgggattttgatagggattgaactgaatttataaatgaattttgggtagaattgagatttaaataatatttagtcttttattccataaacatagtgtatctctctattgctttattttatattgattttttatcaatgatttttaatttccagcacacaaagcttgcttatattttactagatctattctgaataatttcatgtttttgatatattgcaaatggtattatgttttttaatttcaattttcagttatttttagctcatatacaagggtgtgattatatatatataaacatatattatatatataatataaacatatataaacatatatatatatgttgacctggcattctatgaccgtggaaatttcacgtttaaatcagtttagcatttttgtagcctttctgagattttctaaatagctaattataacatctgttaataaagacagttttgtttttcccagtttgcatgcctctatcgctttttcttcccttattcttttcactaagacctcagcctaatgttgaatagaaatggtgagaaaagacatccttaccttgttctcaaccttaggggtactcatcagtctttcacaatttagtattgtatttactgtaggttttgtcaacttgaaagtgttccttatctttctgatttgctaagatctttataaccataactaacaaatgttgaattttatcaagtgcatttctgcatgtattgagatcctccaggtgctgggatgtcagtgctcctgttgcagggccaggcaacaagatttgtatgtgttttcacacaaaaagctgaatctaagctgcctacataggcccaggaataaatgcagcaccctcagttgacggggactaaaaaattcctcctggccgggcgcggtggctcacgcctgtaatcccagcactttgggaggccgaggcgggtggatcatgagctcaggagatcgagaccatcctggctaacaaagtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattccgccactgcagtccgcagtccggcctgggcgacagagcaagactccgtctcaaaaaaaaaaaaaaaaaaaaaaaaagaaaattcctcctctccagttggagacgtgacaaggaatctcggttctgctctgattctgcacaccgagcacataatccagcctcaagcagattttgaactctaatctgaaatacaatcataataatagagttcctgatttcagacattaacatcgaagttgtttttgagttcattatagaatcaaaggctaaaatattctgaagagacatttctgccatacaggccacatgctatctttaattgagaataatggaagctaactctcctaaactcttcttactgtattgaaatttaagtagactatatgatagagcatatattttttcattcattcaacaaatatttattgaatgtgtctgttaggggtccaggcatttttcaggctctgatatgatgaaaggaaaacatgaaaagccgtctcttgttccaaggggagattattattattatttacatggtactgcagccaaatgtgttcatcttattagagtacatattgattgagtataacatgatagcctctcttaggttataaagtacttttatatcctaaaacgtttgtgagaccttttctaaataatcactaataatctaaaatacatacatatatgattttatatatatatcttcacttcattattattttcactaagaatatacaaaactggctttgttctaggaagttactttgctttgtgatatttctgcgtttatttatcctctgtacacctcttattacatagaattatgctgagttgctacaaatgaaataagccaatttctatacattatttgttttgtcaaataacaccatgttcagtctttgcaatgtgtctattcttctggggttattttaagatacatgcttcagtttatattgatagcaccatactaatcattttataaaaatatatgaaatttaattgctgatgttcaatattagacatattttatgctattttatccaccaaagcaaagccttctcctagtgcagatctgagtaaccaccattcccctctgctatcaaatatttccaaattaattagttatttccatgtttttgccctattttgatttgtccaactatttaatttcgaattaaactcatttcacttaagttacaaaccaagcggatgtctagatttgttgtttccagatttatttcagacattaagaaagttatattctgtctttaatatatttaacagaacaaaactcaagttgtcgttttgctaattattcgctatatagattaaaacattaatccctgttaaaatcatgctatttagtactaagtttttttttgttttgttttgtttttaggcggagttttcgctcttttcgcccaggctggagtgcaatggcacgatcttggctcaccgcaacctccgcctcctgggttcaagcgattctcctgcctcagcctcccgagtaactgggattacaggcacgcgcctccacgcccggctaattttgtatttttagtagagacggggtttctccgtgttggtcaggctggtctcgaactcctgagctcaggggatccgcccgccttggcctcccaaagtgctaggattacaggcgtgagccaccgcgcccggctagtactaagttttgttggatgaagggaggatcaaactggggcatgtcattttttgacaacagagttaactgagtgagtggctctcaatggttcattacgtgtaactttcctctaacactgttacatgcgagcttccggtaggagtgccttctcatggagagggtggttattcatcagtcaagaggatttaagtgtgtataatcaccagctagaacgttcagtatgcaacaggcttccttctgccttcatgtgcaatagtggtctttaaagctggagcttttgctgaatgttgttgatatactacaacaatatccagaaaatgcactctatttcctcgctaatccaaagcagacaatggcatacttctaaattaataagaacactgaaaaccacaaacatttaattccaaaatcttgttgctgacattaggatacatgtaaaaatttaatccaagttcaacttaaattcttccatcagtttttgtttagttgctgtggagttttataggaaattcagatagctataggtttcccctataagttctcttcaataatttgattcctgccaataataaatctgtccatcatggtaagtgatgcttttgttattcacattgccttatgtttatttaacacaaaactccatttgtatatctccactggaatccttggtaatttgtgattgtctattaaattgtgttttaaaattggcattgagtttcaaatcatactgtataaactgccaatggtatgacactcattgtttattttaaagccatgataaggataattcccttttctgctaaatggactcagttccaagtagaattacaaggaacaacaaaatgtctttttttatttaatttaatttaattttattattattatactttaagttttagggtacatgtgcacaatgtgcaggtttgttacatatgtatacatgtgccatgttggtgtgctgcacccattaactcgtcatttagcattaggaatatctcctaatgctatccctccccccttccctctacaaaacgtctttgaaataaactttgtagtagagaacaaagtaaacaatccttgataagaatcaagaaatttagattatcctcctggccaagcaaccacctgcctgtaattttgtaaaacaaacttggcttcattgatgtctctctccttgtcagtaaaggaagagagaaataattgaattcattattctccctatcagtaaacagtttattacttttaaaacctaatttccttaaactttgaaacgataactttatgattattgtctttaattattggtaatactttgaataatttaagaatgctaggctaggcatgtccattgtactcattttatgccttaaaaatattcacaattgatggcttagttgtatttagaaaaacatgcatagctctaagtataaaaatgcaatgtcaatttgaggggttttgttgctgtttctcatcataagttcacctgtaagattttactttcaatgtagcatggtatcattgagtttacttatgtctgttatttttcatttttcactgagtatacaatatgtctaattcttcagtgttgttattgtttattatgtcaggtagcaatgctgatcatttagggtttggaatttttgaagtcaatgccgtaggctttcaggataacaaatgaaacagcaaaaggactcattttccatttggtatcttctaaatataattatataaggaaattccctttacccactataggattctgctctcagaaatgtctctgtttctagagattttcgaagcaaatggcctgcaaatgaaaaatctcacttaatacaaacatgcttccaaatgttttagacatattaccaattttagttcaagtttaatattttaataattgtgttatgaatactagcactaaagcatcaattataaatcagtattaggttctatgctggaaatacagtgcatatacaggccagatattcttgaaaaaccacataatactagagcttatgattgaatagtttaagaccttctaggaaaaataaacctgataagttaaaatttgcatacatttatgaaagtccctaaggagattttgcccattaatggacttaaaaaaaagacagcatacctcttttatgaataataattggtggtgtacagtgacatttttcttttagggttttcttttttaaatttttttaaaattttactttaagttctggggtacatgtgcagaacgtggaggtttgctacataggtatacgtgtgccatggtggtgtgctgcatctattaacccatcctctaagtttcctccccttgccctgacgtgtgttgttcccctccccgtgtccatgtgttcttcttgttcacctcccacttatgagtgagaacatgcagtgtctggttttctgttcctgtgttagtttgctgaggatgatggcttccagcttcatccatgtccccgcaaaggacatgatctcatttctttttatggcttcatagtattccatggtgtaaatgtaccacatttcctttatccattctatcattgatgggcatttgggttgttggttccatgactttgctattgtaaatagtgccgcagtaaacatacatgtgcatgtgtctttatagcagaatgatttatattcctttgggtatatacccagtaatgggattgctgggtcaaatggtatttctggttctagatccttgaggaatcgccatactgtcttccacaatggttgaactgatttatattccccaccaacagtgtaaaagcgtacctatttctccacaaccttgccagcatctattgttttttgactttttaataattgcaattctgactggcgtgagatagtatctcactgtggttttgctttgcatttctctaatgattagtgatgttgagctttttttcatgtgtttgttggccatgtaaataccttcttttgagaattgtctttcggtgaatttttatttaccttcctctaatttccagaaacttttcaagattacttccctgattgttttgttgatatgttgctttactgagagtaatatatatgtttagagttacttttgtatgcatgtaatatttctttcgatacttagaccatttctaattttatgatttactgatattgactccctctagctcaactgtggttatagcaaattagagtagttccaatctcttcctatcaacattcatcaactacctaagggttatctcatctcagcctccttcacttttcctgatgcttcttttccaaagttgataccactagtttattgccagttttacttctatttttttcaacctccagttccctggttgttttgtttgtttttgctaatatttccacaaataagtaaatcaaggtctatttttactaaaaccataacttctaaattgaggtaaaggataacaggaatgatttcagaataattaactggaattaatatctgcaaataatatccatcatctgaattcatagcttcttaggcattatatcatcttaaaaagtaactgatttgataaacatctaccaaaaaatcctgcattatacttaatggtgaggaactggaagtgtttttgctaggtttagaagcaagtccaggatgccctctcttacaactcctattcaacattttactggaagaaatagctgatgtaatatgtgaaaaagaaggaaaatgtttatagattggaaaggaatgaaataaaatgtcttcatttgtagatgacatggtttgccatggagaaaattccaaagaaatgttaaaaaataaaaataccaccaataaggtcaatctatctatatatctatactatcaataaggtcaataggatacaaagttaatatataaaataaattgctttcctatattccgcaaacaaacatttcagaaatttaaaaaagaatgatgcaatcacaatagcaccaaaaacctttttcattagcaccaaaaaatgaattacttatgtataaatatatagagagtctataggtagaaatctacaaaacatgataaaagactaaaagaagatctaaataaatggagaaatattccatattcatggattggaagactcaatattgtttgatgtcaactgaatatatagattcaaaataaaagcaataaaaataaaaattgtatttaatagctcttagcaaattgattccaaagtctacgttgaaaagaaaaagacctaaaataggcaagataatactgaagagaaacaaagtttgaagactcatgctacctggttttagtatttagtataaagctaccataatcaagacaacatggtattggttaaaataagatacacagatcagcggaagagaagagacggtctagaaggagcacacacaaatatagtcagctatctttgaaaaaggtgaaaagacaactcaatggagaaagaattatattttcaacaaatgatgccgaagcaaatatacatctgtaggcaaaagaagaacctagcaacaaaccttatacatgttgcaataatcaattcagaacagatcacagatctaactatacaatataaagctataaaaattctagaataaaatacatgagaaaaatctatgtgaacatgggtttggttatgcttttagctttaataccaaaagcacaatttgtggaagaaaagtttcatgttggactttattcagactaaaagtgcctgttctgtgaaagacaagtgaagaaaatggaaacacaagccacaaactggggaaaaatgtttgcatagcaaaaatctgataaaggactggtattcagcatatacaaacactcttaaaagtcaacactaaaataacaaacatcctaattttaaagtgggcaaaagatctgaacagacatcttacccacgatgatatacagatgacaaataagcacatgaaaatacactctaataatctgtcattaaggaattgcaaattaaaacaacaaccagatatgcacgtattagaatggctaatatccaaaaaaccaaaaataccaattgctgatgatatggaacaacaggaaatctcattccttgctgatagtaatgtaaaatgatagtcactttggaagacagagcttggcagtttctaacaaaggtaaacatagtattatcatttgacccagcagtcatgcttctgggtatttactgaatgttttttaaacacgtgaccacacaaaaacctgcaggtaaatgtttatagtggctatattcataatagtcaatttggaatcaaccaaaatgttcttcattaggcaaataaacacactattatactttgatgcaatggaatgttattcaacaataaaaaataaggagttatcaaaccatgtaagcacatggctaagtcttaaagtatatattgtcaagtgaaataaaccaggctgggccgggtgctcatgcctgtaatcccagcactttgggaggccaagtcgggtggatcatgaggtcaggagttcgagatcagcctggccaacatggtgaaaccccatctctactaaagatacaaaaaattagctgggtgtggtggcatgtgcctgtaatcccagctactctggaggctgaggcagaagaatcgcttgaacctgggaagtggaggttgcagtgagccaagatagcaccattgcactccaacttgggcaacagggcgagactccatctcaaaaaaaaaaattaaattaataaataaataaacataaataaaccaggctgaaaaggctatggcttcatactgcatcacttagtttatatgacagtttgaaaaaggcaaaattatagaggtagttaacagatcagtggtgtccagagtttcaacatggggtgagagtggtaaagcacagggcattgctaagcgtgcagaaaatgttctatatgatattgtaatttttgatacataatactatgttaaaaccaattgaactataaaacataaaaagtgttccttagtatatgcaaattaaaaaaaaaacaattattggccaggactggtggctcatgcctgtaatcccagcactttgggaggctgaggcgggcggatcacgaggtcaggagatcgagaccatcctggccaacatggtgaaaccctgtcactactaaaaatacaaaaaattagccaggcgtggtggtgggtgcctgtaatcccagctatttgggaggctgaggcaggagaatcgttttaacctgggagccacaggttgcagtgagcgagatcgcgccattgcactccagcctgggcaaaaagagcaaaactccgtcacacacatacacacacaaataaaatttaaaaaattatttagaggtcaagggcatccccagatagaatgcagaatgtaacaaaaggatctaactacattacaagctctctgagggtgaggaggatgggaatgctgaagtaaggaagtgctaaagcaaagcaaagcaaaacaaaacaaacaaaaataccccaaaacgctcagtgatgaggatatgtcagggacaaagaaaccaaatgaaggagttctcaacaaaagctatagcaatttgagcaacagaaaaaaatacagtagtattggattataactcaaagtataaataactacgaattcatacaaacaataaatgatgtgtaaatcaataaatgggaaaaatggataaatattctggtcagaagaagtccaaatggcttatgtggatactctgccctcagtgagatagggcataactccttgttttttaagtatgggctgtgcatagggacctctttccaaagactgccatatgtgagttgactgagtgtcaacttgattgaattgaaggatacggggtgttgattcctatgtgtgtctgtggggtgttaccaaaggagattagcatttgagtcagtgggccggggaaaggcggacccacccttaatctggtgggcacaatctaatcaactgccagcgaatataaagcaggcggggaaacatgaaaggagagacgggccgagcatcccagcctgcatctttctcccgggctggatgcttcctggcctcgaacactggactccaagttcttcagtttggggactcggactggctctccttgctcctcagcttgcagacagcctgttgtgggaccttgtgatcctgtaagctaatacttaataaactcccctttatatatatgtatatctatcctattagttgtgtccctctaagagaaccctgaccaatacaccatatgaaaattgaaaaaaaaatcgagtaactttgcagtggagaaatttgacaaacactaccccagccaagcaatcaaagtgaaaatgaacagcgatatgccttgttgataatatgtcattgaaatggtgtgacgaaaatggcacttttccactgtggtcttctccagaacacataacctcagtctaatcatgagagaaacatcaatcaaatcccagttgagggtcattctacaaaatacctaacaaggacttctcagaactatcacggtcatcaataacacgaagaccagaaaaactgtcacagacaagaggagtctatggagacaggacaaccaaatggaatatattattgtggttgggatcctggaacagaaagaggatactagagaaaaactaaggaaatctgaataaactgtgggctttagttaatactatatcaatattgattcgttaattgtaaaaaatgtaccataggaatgagaaatgttaataataggagaaatttgatgtgggctgtatagaagtctctttactatcttagtaattttttggtaaatctaaaactattttaaaattgaaagcttattaaaaataaatttaaaatgtgattgataattaaagtcgtataattatgcagctgatgctataattaaactaataagaagaatataattagattcacatgtactgatatggaagaaagccaaagatacattatgttaaaaaaaagcaaattgcaaaaacatcgattgctgtgacccactttatgcaaaaatgtgaacacatatgcatacacctaaatagttgaagaggtacacactaaagtatggttacttcaaagatagcagtaacattgaggtggttgtaaaaaatggagtgaatgtgggcataggcctttttttctatacatttctcttatttgaatattttataataaacatgtatttgtagatacgtataagttctttatgatttaaaatgcttttcttagatatatcttaacttcttttgctaccaagtctgccttaatccattattccctttcattaatgtaacatcaagtgtcttctccaatgcttctttttgctaggcacgtaaacaagactaagtttctcccaggttaaagaggaaaataacaaaacaaaataaaacaaaaagctaccttatgcctttcagttaccccgtattttttttctgccaaatttcctgaaggtgttgtctatggtcattatttctacttccctatgtagctttctctgtcagttcactgcaggctgtcttctgcctttacctctctactcaatccagtgtatggcaaccttcctgacagtgtggtggagagggtaaagctctgggcacatttgggctctgtgtctgagaatttgcatattttgctttactttcctaatctcaatttccttacgtctaaaatgaggacagtatccttcttgccaacttctagtatagaaactgatacataacatatttttaaaaatattgatcagatgatctaaaaagcaatctcgtcatagcatcatggcaaagatgtaatccctcaccatctttcctctagattcttgcggtggtctactagtgttatagatgaactaacctccctaaagagtctcagtgtgtctgccctcacaacccttcaaatctctgtcaacacaatatccagagtgggcccattgaagcctaaaaaatgtgcatgtctcctctcctcagaaccttccagagcctactattgcacaagaatgtgtttgtgtagtgtttgtatggcatgtgtatatgtgtgtgtgagagagaatgtgtatttgtggaggtaatcctaggaatcaacaacactggagtggaaaactatggcagggaagaaaggaagccattaaagttttgttatcaagcagcatactgctgtgggcaccaggtgcctaggctcagtaggaaactcagaagggtagggtgaatatgacccagaggagttccaaccaaggttctaagaagctgagaatttggtccacactatctggcagttattggttgatggctgctttggggaaggatgtggaaggaatgcattactttctaacatgtccaatctactttatctttaagcctggcaaactgtagcagccaaagagagcgctcagttgaagacctgtcaatagggagcatacccaagaatggtgaaagccaaggagatatggatgggttgctgacagcatctactaaaatgtcttcttttcaaatatctaatgtatttgtatttcctttttaaccctatgcatcatgtaaggttctttaggaaatagaaggcatattcacaggggataattaaagagaatttaacaaaatggctatttataaatatgtaagcagttttcaagaatttcacaagttagaagaaagctagatggactaaagctatttccattgtctaaaggagcaagggtagggaacagacacttgaacctattagatgtggctttaagtaacagaaatcaggcaccgccaagctacgcctcagcagggaaggatcctgagaaatcacactcagattgatctctcctccaacctctgatctgctctttgtgttttgttggtcaaagcaataacaagtcagagtatagaaagtgaagcagtactgaagagtcagtggccagagctcaaagctcactgaagtatgagaagtggagccagaggagcaggtggagaatattcagcatgactagggcaatgtaagttgtaagagagcctgatttttgtccccctgtttcctgcactatcccctacaaatagaacagtgcctcatacatagtcagtactaaatagatatttgttgaatgtttcagtccattcacaatacttttgctattcattgtaaattattccaagattgcacttcgtttaacttttgccttccaaaaagtgcaaattgatatctcgatattgtgaatgaatacccttaaaatgtttaagtgcttcatcataggggagtgtcacagcttcgaataatcgtgatgtaaagactggttttttaaaaaagtcgtcttctcttgtaactcaatatttccatttcctcttctcgatgaagcaataaaaatggttttcctgagttgccagataaagtccttattcaaaaactgtttgacttccatgaacccaaaataattccacttgataaagtatattttattagtatttaccatcaccttaaggaaaggcatatgtaggagattgcctagtgctgatattggaggaccatatatcagaaaaacatatattaaattacacttgatcatttctatatttctaacttgagagaatatttctgtcagtcagtgattcaggatcctgtatttaattagctgttaaacatttattacaatttttgattttgtcattttttattaaaatagttttaacaaacatgattcattgaaaataatattctcatcccacgttaaagatagttttctacttttattttttctactcaactctttttaccttatattcatcaaagaaaagtagaagtaaacgtatccccccaaaattcatttctacttgggctctgtgaatttgactttatttgaaaataagatattttcaaagataatgaagttaagatgaatttacactggattgctaaagatctgaaatccagtatgactgatgttcttataagaagaggggaatttagagacagacacaggcacatagaagagatgcgtgtgtagatggagacagaggttggagttaggttgccactggcaagagtaccaaaggttgatggcaaccaccaaaaactagggaagaagcatgagctcgattttccctcagagcccacagaaggagccaatcctattcacaccttcatttcaaatgttcagactccagaaccacaagagaatgaatatctgttgtttgaagtcaccaggtttgtggtgatttgttacagcagtccaaggaaatatatacagaataaaatacagtaccagatctgttctcatccactggcaaacattttttggaatattaaatctggaaatgaagagtggattgccactttcttttttttttttttgagatgaagtctcgctcttgttgcctaggctggagtgcagtggcacaatcttggctcaccgcaacctctgcctcctgggttcaagtgattctcctgcctcagcctcccaagtagctgggattacaggcatgctccaccatgcctggctaatttttgtatttttagtatagacggggtttcaccatgttggccaggctggtctcgaacacctgacctccagtgatccaccctgcttcggcctcctaaagtgctgggattacaggcgtgagccaccgtgcccagccaattgccactttgggagtatcaagagtcggcccttattagcaagtatttctatctgcccgtttgggttgagcaaaattagaactgacaacggactagatgcttctattaccagtatttcaacctccagaggatccagataacagttttcaagtaactctcatagtagcctaagcttacttaaactctgaaatgaaagaatagaaatagactcaggatgccaaaaagtcatacatttatgatttaaactcatcaaactgaaatttaaaataaaaattatcttgaaaacctgctacatagcaaacactgtgttaggttctgggaatacaacatcgaataagacaatttccctgacttcaaggaatttgaagtatgactgtaagatacaatgaaatgtacaatgaaaagggaaacaggaggctacagaaataaaatgaggcctatcatatttagctatatgctgaaggcatttgcaagtcgttgaggagtttgaagttgggaagcaacaggataaaatttgttgtttagaaaacagcacggggtagagtggagggtagtttgggcagatgcaagcctggaatgactgggagatcagctaggccagtatagctgacattctgagaaaaaggtgaggtggcttcacatagagttagcaatgaaaaaatgaaagtgaaaaaatggacggattacaaggatgtttaaatggttaatcagcaaagtttagggatttaattgggggtagagatgggaaggaaagacagtggggagggaaaggcagattccagttagtggaagttagtggcatcatggtgcagttttctctaggcaggaggcccaagatgaagggcagggtccaggtacacaacggagaggcaggtacaatgggctacattcaaggaaacagattttctgttatttacattcaagttatttatatacccacccactcacagacactctttttttattctttcaaatgaattagcctactcctctctatttatgaacagcatttggttgatttggctcattatttaactaaactaagttcagtcaactttcaaaaatagcaaaaacaggccaaagtgggaggatcacttgagaccaggagtttgagaccagcctaggcaatatagtgagacccctgtttctacaaaaacaaaacaacaacaacaaaaagtatccatgcctggtgttacgcatttgtaatcccaaattacaaaggctgaggacagatgatggcttgagctcaagtgttcaaggctgcagtgagctatgctctcaccactgcagtctagcctgggtgacagagagagaccatgtctcaaaatttaaaaaaagtatttcttgatattacacagctagatattttcaaaacataattaacaaataaaagaaataatttgaggtaattgtaaaagacataattttaagtaaaatttaaaaatcttcacgaatattccttgctctcattagatggtgaatatttaaccgaactttgcaggtgatggcagagacacaggctaataataaacatgatgacttgaagtagtaactcaatttattattttaatatatattaaagttaagtatgataaatttatttaaattaaaagaaaaagtcatatttaattttgtggaaatactaagtaaataaaaagtgtaaacattgttccagaaataaaactgcaaccctttaatgatctgatcctaggcctcaacctggctctcagttctaaagtcttttcgttctaagtgtttgctctaacactggatccctgtgtgttttactccaaatgcagatcccagggtacaaggatgagacaaattgcatataatcaaaaggggaaaaccaataactatgactaaattagagaaacaactggcacggaagagcgtgagtcagaactactagttttctagttttttcttttaattcaaaaattgaagtatggacaggtgtattctgtgtcctgtgaagctgtggggcaattttaaaggccatcctttcagtagtgtcaacactggtaacctcaatgttaaccacacgctctgcacaatgaatacttcaaattttccaagacaagtctgcagaaaacaggaaatggattcttcattctgcacttttttatttctaaggttacattcttttaacttttcagactgttactacagtttatatcacatactgaatgtttcctagaaaactaacaaagttgagatcacctgaattgcttttctattttcctgcacactggtatgaatcatacttctctaagcaaatatgttccttaatgtattacttttcttactttgaaaactctaaaactacctactctaatttataatatcacagaactttaccctgtgtttactatacatttacctcaattttatcatttttattctacatacaaccctcatgagattgtcactgtctttcttatcatctgtgtgagcattagtcatgaggctggaaacttcttggggtaaaaaatattccaatattcataattatatcggctagcttccagcatcatacatgacatagggattttatctgttgtttgaaattgacagagccttctaaaaccatataatcactcattggcttggcactctacatggcaatatttatcaatgactatgaagtgcaagacacaatacaaagtgtatatccaatcttatagagagcatttggggacatctatgttgcaaaatttagagttctctttatttggatttgagaatgataatgtgacatgtatgctgttttaaagccacacctgttccagcactggacagcaccacgttttgcctcccatgtttccagatcatgttttgccaccaaatgagttcaaattgtgtcaagtgttgttgaataatacaatatgtaaaaatctagttttaagagctggtattttggttttattgttgttgttgctgttgtttcaggattttaaactgtggaacacattgtcagtgatccaaagaaggaagagataggcatttcaggaaaatgacataaagtgtaagaaaatagagatgagggaaaaaaaaaaaagaaatactttagaaaagacatgtaatccagagagctgggagcgtagatcttgggaaggggtcaagtgcattacagctggagcaaggcatcagggttgaattataggagatgtatgttttgctcctattttttttcctgctttattgagatataattgacaaataaagttgtatatgtttaaggtatacaacatagtgagttaatatgtttatgtgctgtgaagtgattaccacaatcaagctaattaaaacacccatcacctcacatagttactcattttctgtatgtgctgagaacacttgagatctactctcggcaaatttcaactctacaacacagtgtcattaactatagtcaccatgcgtacattacatcactcgaacctattaatcttataactggaagtttatatcctttggtcaatttctcctcattctcccaacttcctagcccctggcaaacaccattctaccctctgcctctgtgaattcgacttctttaggttccacatataagtgagaccatatagtatttgtctttctttgtctaccttatttcacctagcataatattctccaggttcatccgtgttgtcacaagtggcaagatttcctctgtttcatagctaatattgtactgtgtatataccacattttcttcatccattcatctgttggcagatgctttaatctgtttccataacttggctattatgaataatactgaggtgaacatgggagtgcagatatctcttcaagatactgatctattttcctttgcatatataccaagaagtgagatagctggatcatttggtagttcactttttatttacttatttatttttaaggaacctccgtatggttttccataatgaccatacccaattaaactctcaccaatagtgtacaaagattcctctttctccacacccttgccaatgcttgttatttcttgtcctttttaaataataggcatcctaacatgtgtgaaatgacatctcattatgattttgatttgaatttccatgaaggtttgtgatgttaaccattttttcacgtacctattggccatttttatgttttttttagaaaaatgtcattcttgtgtacatgtaccctagaacttaaagtataatggtaatcaaaataaataaaataaaaaaaggaaaaatgtcattccagtcctttgcccatttttaaccaggtttttcttttgctattgagttgtagtttcatatataatttggatattaacctcttaacagacatctggtttgcaaatattttctttcactccctgggttgccttttcatttgcttgactttttttttttttgcctcttccagagcaattaaatacactattagctatgctagtccttatttattcatgactccctatctctagacagaaaactctggggaacaactggcccctatatcctcccacttactagatgtgcatgttctacagacactttaaattcaatttgtctaaccatattcatccattaatttaataagccattattagccaatgtataagacattggaggttcaatggtgaaagtcataccaattgcatttttggtgcaattacttcaataatgtaattattacattacaaaattacaaaccgaagcatactctgatggaaggaatgaatgtccttctcagagagtatctaagaaggtagcttttccacatctggtggggctgatgttctctgaggaagtgaaagctgatctgggatatgagagtgaaaaggaaaggaaggaaggctaccagaatggaaacaagcatgtgcaaaacccctgtggcaaggcagagtggaaggaatcagagaaagtgaaagaaacccgtgtggaaagaaagccaaggaaccacagcttgtatatgaaaccatcactgttagccctctagaagccttctgtctgctcagccccctttcttccactgaaggaatagtaactacactgttcaaatatttatggcaataattccttattatatttagttaccactcttaagaatttccttttaagtttatataaatggaaccataaagcatatagtctttgtgtatgattttacctacagtacattttgttttccaatttgtttgtgttcttgagtcgcacatttcattcattttggatgctcgagaggattctttgtttgaatatacaataatccatgaacctaatgctttgatgatgaacatttttgatgtttctgtgtttctagtgatcacaaatcatatatgattaaacatctaggcacacatatgcacgtcatttctctagaataaacagcaatatgtatatatatttgtatatatatatgaacatgaacatatgcaaacacaagttcatgcataatactaatataaaattatgtactattctatctcctttcacatattttctgtttttgtctctcttttcatcattattgatgttttcttcttccctttcttccatttaatgatctctctgcatcttatccattgaattcttagtttaggctatttcacatattacattgttttagttctagaatttctattactttcttttctgaaaaatctgcctgacagatctcttagtctacacaatctaacacgattttctattatgatggaaatattctataaatcagtattgcacaatgcagtattaaccaaccacacatagctattcagctcttgactaaagaattgaatttttacttttatttatttataattatttcaaagttaacattggtagcaacttttatattagatagaaggtcttctatgattctattttcaccatccacttaaacttaaaagaaaaaaaaaaacctaactcactcaggggaggcatggtggctcatgcctgtagtcacagcactttgggaggccaaggcaggagggttgtttgactcaggagtttgagaccagcctgggcaacaaagtaaaatccgatctctaatcataataatataaataattagctgggagtattggcatgcgcctatgctcccagctattagggagggtgagatgggaggatcacttgagcctgagagatgaaggctgcagtgagacctatcatgcctctgcactctgacctgggcaacagaacgagaccctctctcaaaaaacacaaaaaacataaaaactaaaatgctcaattggaaaaatttgaaaaaaaaatagacaatcataatcaattaagactcaattgtcaacactcatagtgtataaattatatacactaaatgagattgtgtgcatactatccatatctacacacatacacataaacaaaataaattttagtaatgttagtttatgtattttatagcctattttttcaaacaatatttataaaataattttatggcattaaatagtgtctaaaatcatagactgtaatgactgtgtaagattttactcttggttctataataatattgtcttattactcgacatttagacgactattttgatactgttgctaacatgattatctctagctgatttcttaggattattgagataaaagtaggattgctggaataaaatatccaaatattaaaacatttttggtatttattgtcaaattgtttttcggaaaagttataccagcttgaattgccattagagtaagataagaatgcagtgtgaatttaagtcctgtttctcctctaccttttcctatctcctctctttctgtatcaccatatgacatttgtcatagtcctgttcttcttcaatatctttgttccataacctctgttttaaaggttccctctccccattccatgttcagctctcctgtcttttttttttttttctgagacagagtctcgctctgtcacccaggctggagtgcagtggcgcaatctcggctcactgcaagctccgcctcccgggttcacgccattctcctgcctcagcctcccgagtagctgggactacacacgcccgccaccacgcccggctaatttttttttttttttttttttttttttcagtagagacggggtttcaccgtgttagccaggatggtctcgatctcctgacctcgtgatccggcacctcggcctcccagctctcctgtcttaaatgctaaatctcacatccatatttccaatctgtcatgtcttccaagatcaagttccacttttccaacatgtctgctatatatatatatgcgtgcttgtccctactgactctcatcgcatctagagctcaatttttaacattatctcttcccccagcctatcctaataactcaactccccatgtgttcagatttcccttttctgtaagcaatcctattgtcacttgagcacaaaactcccactctttgtcgcttttcctttatctcacaaatgccgacagtcatcaagaatgattaaattttcattcgcaatatgaatccaagacatgtcttcccttgcatactgctgcttccatgctagaacaggcctttatcaccatggcaattttcttttaaatactgttcctgcatttagactttccttccattaatctattctactcaatgcttctaaactaatctactcaatttatcattttgagggtaccactgtcttcatcaaaagtcttcaatgtccccctgttgtgttgtaagcaaccccaagttgcataatttgtcatttatccatttgtcttgccagccagccattcaaaatttatggagtgcctacatgattttttttcctttggagaactgctggctactggaactactggcccttgcttaaaaagggtgtgaagtgcctgggagtttatatccccttgagatttccactaaccagtgactgaaagatactgacaaaagcctcacatccatagtctgaattataatagctctgaagcttagtttacactccagtttccctatggaatcaggcgaaaggctgttcttgggctttgcacggcgatcacactcttgcctgacttccttgtcttccttgccctacttcactggttgccttatttatctaccctggagcccttccttaataaattatttttatgtgaattcttctcttaggttctgcttctggaaaatccaaagaaaaccacttttgttaagaaccaaagacatgatcactactgcgaatgaactcacgctgagtagaaaaatagacatgcaagccagcaatttaaattttaatatgctatctaccataatagtgggatttgcaaagtcctgtgagatgaggaaagaataaatacctatctcaggtaagggaagtcggactggaaagtcttcccctaaagtaatatctgatctgaaattcagataagatattttttttaggcagaaataataggtaaactagttataacaaatagtgtgggaaaaatttaatgttataagaacatgaaattcttcaggaactacaaataactcaacgtactattatcagaggcaatatgtgatacaagaggggggagggaactgattcgaacaggtgagtaagatggccgaaatgtgaattcaaaacattctctgagtgttgtaaaaagagctcatctagtttatctgtcaaagatggcaaacaatatggagaacccaggagggcaatgcctttgattatagagttgtagctattgctctggcagtattgtggaggactgcatgtggaatttgcaagtagggctagtctggagaaagaataatcagaaatcaaataccatggtgagcacaaagggctgagaagagagataatgtgagatattagaagaagaaatggcagtagttggtgattgattgggtctgtggtaagattctaggctttggatcaccctgccagtcaccaaatctgatagaatttttttgacttactttatcaagatagcagcattttccttccttcttcagcttcctgtttgattgttttgctaacttttgtacgttttccaaattatccatattgacaacatattattcttttacttgcaaagtggagtaggtggtaaaaatgaaatcatagcatatagacaacttactagaaattattgagttaatcagaaaaagcatgctgataattaaaatacatgtgaaaaaacgtccaacctcaatcataactgtttaaaaaatgtcaattgaaacaatatcagattaacaaaaattttagttgtaaaacattcaattttagcaaagataaaggaaagaaacatgctaatgcaccacctgtgagactataataggtccaaatttttgaagagccattgcaaatatctggcaaagtaaaacactcacttcctttcatccagcaatggcaccactaacaatttacactaagaatcaatctagatgaatatatatgaagatgcttattactgtattatttataatagcaaaaaagtccattaatataaactcattagctatactataaaatgaccgttccgtggaatattatgcagatgttataaagaatatgttaatataaatgtggtcaataaatattgcattacaaaaagaagagtagaaattgagcttgtagagaataatttcatcaccacttaatgagaatatatatacactgaaaatttctgaaaggatccatccaaaactgctaacattatttaccactggggcttgaaaatgatggagatttgctcttgtcatttatttttttccccaagaacaacagtaatttggcgataaaattaatggaaaggggcattaacaagataattgagggacagtgtttagtttttacatgtttgtggaaggagatgaggaattaaaactttatataattctgttgaaataaaataaaaataaaatccttagagtcacaactctaagaaaggacaagcacttacagataggaacatagacgctaaccccacatcctgtaagtgtcaaaccaacgactaggattcagctcccctgacccttgccccagtgctctttctatgatcctaagcgatagtatatctatgcctagaaaatcaagccaactgaggtggaaaagatctctgccattatttctgtcttctccgaatatacgggactgattttgagttcataaataaataagaaatgttgaagggttgtccatgggacactaaagttccactgtattctcaaccagaatttcttaattcagtaccattgctctaaaaggatgctttctcaagcactgaaaaatatggttccatttatgtccctaacttaagggaagagacattttgaattggaggcaaataatctatgttgtaacacttcaaagctaggtcaggaagcttatgctaaatgccttatgtgtacttgtgacttttgtattctgaccctgaatgtattacacagataagctgacatgtctccaataattttcctcctaagtacggtataaatgaaatattagctcatattatctcggcaccccaccaactgatcagtttgttgctataaagtgcaaatgcccaatcatataaaattccaagcattgctctgttgaaaatgagaaggcatcactagaatgtgagtgaaaagaatattatgtgcttcccttttctatatgttagattgcttcacattgaaaaaataagttcaatctgggaggctgaggcaggcggatcacaaggtcaagagatcgagactatcctggctaacatggtgaaaccctgtctctactaaaaatacaaaaattagctgggcgtggtgacgtacgcctgtagtcccagctacttgggaagctgaggcaagagaatcgcttgaacccgggaggcagaggttgcagtgagccaagatcataaatagtcttcactccagcctggcaacggagagagcctccatctcaaaaaaattaaaaaaatagaataaataaaatataaaaaataagttaaataacatactacccaaaaacttgtaaattactttatccatctacttctaggaaattacaaagaacaaatttcattattttagcataacagggatggattttcttttgtaatgttcaatatattaacgatagattttttttcctagtgttctttaggatacttcctgcaatacttcattcaagttatcagtgatttttactatgtattgtaaatgatacatagccaccatatataaatatttgctgaattcaagattactacgttaagaaactggggtaaataaaatggaaacaagacatccgtgaatatttaaggatataatatcgcaattgcatgtttctgctggcttttcatgatataataaaccttgttttttcttctaatttaaaaaatgctatcaataataaaaatgctaattatacataatcaatatttttatacatatatcaattcttacaaatgttctaattgcagtttagtaaactgatgtgtaaatatactttgtaagacagataattttttttctatttgtaggtattttatttttatgatattgtaaataatatatttttaatttttttattatactttaagttctagggtacatgtgcacaacgtgcaggtttgtgacatatgtatacatgtgccatgttggtgtgctgcactcattaactcgccatctacattaggtatatctcctaatgctatccctctcccctccccaccaaccccacgacaggccctggtgtgtgatagtccccatccaagacagacaattttataagaagattaacttgaagttataagtagactagtgaattaaaatttccatttcctatgctgcagagcacttttaatgcaatttggagggagaacattagtgttcagcatttataatttatcatttgacatttggactaaaaactctatttccaatactgcacatgctaccataatgcagggttttacaaagagattagcgtaattcaatggttaatcatatttcaaaaaggagctatattgtggactttatattcccctcatagttgcttctggaagggatctcatttgttactccttctcagcattgggttctattcagttcttaagtgaaaacgggaaaaaatgctaccctatactgaagcatttcaacacaattggaaacattatgcatgattttcaatagatgaggatatacatttacaaagtattcacaaaaagatatttttggccaaatttgaatttgttgaaagaaagtacatctctgatctacttttttagaattttctgggtttcaaggtctttaacagaggtgtgtacgtatgtgtgtgtgtgtgtgtgtgtgcacgaaaatgtactgtgttcataaaaatgccactgttggtgtttccaaaatgaagctactacaaaatacagaattggtgtaatctagagagggagaggaattgataatgcagagagcactttgaaaataaaactgtggaaaagaggccacagtatggaccagaggtaattacccgatcactaaaaaagagagaagagaaagaaaaatacacaggaaaacagggtcagagaggcagaaagtgaaaaatcaaacagtatatttggcactgtagagagtaaaagaatgagagattttccccctttctgttcatgggttatgaaattgaggttttccatataattaagaaaggatggatcttggcgaagggcatattgtcatctatgagagagctgcgagaagtgtagggaagattggagaagatggctgacattgctgctttggggtagttgctctaaaacttctgccattcagccatgcggatgaggtgagcaggtatttggggacatgtgtgacacttgatcacatgtaacaataatatatattacatttagaacaatttatatcataatttatgtgtggaacaggatgtagctcaacaatgaatattcagaaactttacctaaaagccaattcataagttattctaaaattgttgttaacctggtgggtgtattttctagggatttcaagtgagcaaaaattgccaagaaataaaatccgtcaggaataatgtctgctttgcctgtgaatcatagacacacttaagaggcatttaacagtttagttagagcaataaatgatctttgctttaaaattgaaaaatgtgttttctttaaactttggtttcattttcttaggcgtttattcaaataatacatatgtgtgaatgtatgtgatttttagactataaaatactttgaaactgttagataaatctttgctaataagacatttcgttatggaagaattttgggattccttttgctctcagtattgactactgtcattgtagaagttctgacaatatgatgattgtatgaagactctgtgttcaaatgcatcatcccaaggcactgaaaacatattttcatgttcttgttttatcatatttatgtataacggaaatgggaagactgaaagatttcattatcacaattttggagggcagagaaaataccgacaatctgcatttccaggctaagtttaagctattcagaagccaaaccttctcactattcagctggcatatcacattcagcgagaaaatgtttcagttttttcatagctatgtttaactttaaataagagattacataattaatgctaaaactgcctgtcactattatattccttaaggttttccattctttcttagcttaagtcctgatttttattttcattgttatcattgttatttttcttttcatagaaaagtactacttagctctataatcttttgtttgagattaagggatgaatatttttgacaaaggaaaaatatgcttgaataagtttgtggtcttccgtgaaggtttaaccttatagagttggattttttacatttttgataatagcaatgattacataaaccttatccaaaaattgttataattattgagattaattttgaatcaattaaaaagtttaaaaataaatattatttgaagtgtttataagatcagaaaacaactgaaaagattcatggttatacatcaataattgcttatagtgtaaatgaaaacatttgttaatttctagaaatttattgcatatttgattctactttccaggcaatattcccacattttaagtttgtcttcatttcaataaaactgtatccagaaaattaataaaactataatttgaatgtacaaaaatttcaaataatgactccatatatgctcaggaagtttaatgtcttgactttaatcataccaaagacttcttatattaatacaattttgtatatatgcaagggtttcacttctgtatgtaatcaagaactcaactaagctgtttatcctctccatgttcttccagaacattctcccttaaggatctaattcatggttacttcttactctatttttaaatttcaccatgattatgcatctcatttacattttatttcctgggtctttcctcacctctcaaaaactacccagagagcatgatagcagccttttcttgacttccacaccttacacacacacacacacacacacacactcttactttcacaaatatgtgataaggggaacagtgttgctacatttatattattcttgacagatgaaactgggcacctgtttgctgcatatcataggcttggccaacatcaggcagatgctgcccagatggcctttcttcatctagaaacatggagccatgctggccatctcactttcctcgcaccctcaacctaattgtccccaggtcccaatcagcagttgaatgcatttcctttccttcattttcctttctgctatccaggcatttgtcctcttggaaagcaagacgaagccttcctacctcatgcttaatctgctccagtggcattagcctaccctcattcctcagagagaacagatccttcctaactcagaatttcacacaaggcacgtacccaggagtcctcgccactctattccaccccatgtcccctcatattcaatagccataggctttagtctagaggtgacacctctgggacaatgtacctgaagccctagacaaggagctttgttatttgccatcacatattctacgtttttctacatgacatttatatcaataatttttgtttaaataatttttaatattttagtccctctcctcaacatacacgcttctaaaaatcagtgtgttgctcactaccaatttccagcacctagcacagtccttagcatatggttggaactcactgaatttcagcattataacgaaatgaattaaatggatgttgtacacatgtgtgaggagccatgtggaatgtaaatggcagcatacctatgtgtaaagttgtcagaatcaaggaaatggagctacattgggagccagaaagctaatccatatggatgtcaaggagatgaggcttgagacacagagcagtgagcaatgtgagggatccaaagggtagggaagtcccacaggaacacaggagatgattcaaagaacccgtggttgtcctgaaacattgcttttcttcatgggctagaggacttccttggcagagggctgaagacaaatgcgtgcaaaagtgctttctctaaatgtctcaccagcttatgttttcaatgtataattccagaactatatatcacccatctctccgtgctgttcagttcttttcatcctgctaaatcttttctgcatctctatttagatgatttctcattctttccatctgagactgatggttatttccatgtggggatgttacgaagaagagtatttagggtctagttagcaaaaacagaccatagaatttttttttaaggtctgcccagcatttaagaagatatcagcctgttctccaagtgtccagtcctatctcgtgtctaccagcttttagcctttttctaaggataagctctcgcttttcaaattctgtgtgacatttttaaggccacatacatgaacacattttcatttattccatcttgcagtcctgaagcagtaacgtgactacctgttgcagcaaaaaggctgctccttggcctgatctgcatcttccggggaacttgcctggcgatctacgatccatcaaattttccccttagtaaatctcagaaaaagatcacccataagcatagcacaggggtattctgaggtttgactagtatttcagagtgctgtagatcctaagatgaaagtagtaagaaagttgaaaaaatagtattatttattcaacagacatgctagaaatctcagagcttccctagtccctattttctgtcctaagcatgtaacataaaaccctgcaaaatcagaactgagttctctgtaaagacattcagaaataaacaagaccaaccttgaagggggaggccttgtaatccatggtttattcttcttgttatggctgatggcagcacctagattagagtaggtgctcagccatggattcactgaaataatgctttaaaagtatactaatagagaagaaaagagagaagaatcaaatagacacaataaaaaatgataaaggggatatcaccaccaatcccacagaaatacaaactaccatcagagaatattataaacacctctacgcaaataaagtagaaaatctagaagaaatcgataaattcctggacacatacaccctcccaagactaaaccaagaagaagttgaatccctcaacagatcaataacaggctctaaaattgaggcaatagttaacagcctaccaaccaaaaaaagtccaggaccagaaggattcacagtcgaattctaccagaggtacaaggaggagctggtactattccttctgaaactattccaatcaatagaaaaagagggaatcctcccgaaatcattttataaggccagcatcatcctgataccaaagcctggcagagacacaacaaaaaaagagaattttagaccaatatccttgatgaacattgatgcaaaaatcctcaataaaatactggcaaaccaaatccagcagcacatcaaaaagcttatccaccatgatcgagtgggcttcatccctgggatgcaaggctggttcaacacacgcaaatcaataaatgtaatccagcatagaaacagaaccaaagacaaaaaccacatgattatctcaatagatgcagaaaaggcctttgacaaaattcaacagcccttcatgctaaaaaccctccataaattaggtattgatgggacgtatctcaaaataataagagctatttatgacaaacccacagccaacattatgctgaatgagcaaaaactggaagcattccctttgaaaactggcacaagacagggatgccctctctcaccactcctattcaacatagtgttggaagttctggccagggcaatcaggcaggagaaggaaataaagggtattcaactaggaaaagaggaagtcaaattgtccctgtttgcagatgacatgattgtatatctagaaaaccccatcatctcagtccaaaatctccttaagttgataagcaacttcagcaaagtctcaggatacaaaatcgatgtgcagaaatcacaagcattcttatccaccaataacagacaaacagagagccaaatcatgagtggactcccattcacaattgcttcaaagagaataaaatacctaggaatccaacttacaagggatgtgaaggacctcttcaaggagaactacaaaccactgctcaatgaaataaaagaggacacaaacaaatggaagagcactccatgctcatggataggaagaatcaatattgtgaaaatggccatattgcccaaggtaatttatagattcaatgccatccccatcaagctaccaatgactttcttcacagaattggaaaaaactactttaaagttcatacggaaccaaaaaagagcccacattgccaagacaatcctaagcaaaaagaacaaagctggaggcatcacgctacctgactttaaactatactacaaggctacagtaaccaaaacagcatgctactggtaccgaaacagagatatagaccaatggaacagaacagagccctcagaaataataccacacatctacaaccatctgatctttgacaaacctgacaaaaacaagaaatggagaaaggattccctatttaataaatggtgctgggaaaactggctagccatatgtacaaagctgaaactggatcccttccttacaccttatacaaaaattaattcaagatcgattaaagacttaaatgttagacctaaaaccataaaaaccctagaagaaaacctaggcaataccattcaggacataggcatgggcaaggacttcatgactaaaacaccaaaagcaatggcaacaaaagccaaaattgacaaatggggtctaattaaactaaagagcttctgcacagcaaaagaaactaccatcagagtgaacaggcaacctacagagtgaacaggcaacctacagaatggaagaaaatttttgcaatctactcatctgacaagggctaatatccagaatttagaaagaactcaaacaaacttacaagaaaaaaacaaacaaccccatcaaaaagtgggtggaggatatgaacagacacttctcaaaagaaaacatttatgcagccaacagacacatgaaaaaatgctcatcatcactggccatcagagaaatgcaaatcagaaccacaatgagataccatctcacaccagttagaatggtgatcattaaaaagtcaggaaacaacaggcgctggagaggatgtggagaaatagggacacttttacactgttggtgggagtgtaaactagttcaaccattgtggaagacagtgtggctattcctcaaggatctagaactagaaataccattcgacccagccatcccattactgggtatatatgcaaaggattataaatcatgctgctataaagacacatgcacacatatgtttattgtggcactattcacaatagtaaagacttgaaaccacgcaaatatccatcaatgatagactggattaagaaaatgtggcacatatacatcatggaatactatgcagccataaaaaatgatgagttcatgtcctttgtagggacatggatgaagctggaaaccatcattcttcgcaaactttctcaaggacaaaaaccaaacaccacatgttctcactcataggtgggaatggaacaatgagaacacttggacacaggaaggggaacatcacacaccggcacctgttgtggggtggggggaggggggagggatagcattaggagatatacctaatgtaaatgatgagttaatgggtgcagcacaccaacatggcacatgtatacatatgtaacaaacctgcatgttgtgcacaggtaccctggaacttaaagtataataaaaaatatatatatataaaaaaagatatagataaatgcaggtatagaacatattgctggattgtaaggtatcatttctcctgaaattgatatatacacaatacaaatcaaaatcccatcaggcttttatggtcgttttataataaattgtgaaattaggtaaaaaaaaaaaagaagaaaatgtggcacatatacaccatggaatactatgcagccataaaaaaggatgagttcatgtcctttatagggacatggatgaagctggaaaccatcattctcagcaaactatcgcaaggacaaaaaaccaaacactgcatgttctcactcataggtgggaattgaacaatgagaacacatggacacaggaaggggaacatcacacaccggggcctgttgtggggtcgggggaggggggagggatagcattaggagacatacctaatgcaaatgacaagttaacgggtgcagcacaccaacatggcacatgtatacatatgtaacaaacctgcacgttgtgcacatgtaccctagaacttaaagtataaaaaaaaagtataccaattcacagaaatcctccacacttccaattacaataaaactatccatctattactctaaaatttgtgaatattaatcattctatctttccagcttttcttctgcatttgtgacccctttgtactatttttttctgttaggatacagtcaagaaaactgaaatcatggtagtaggtactttaaagacggaattggttaccagatgttagaaggctctagaagttcttgagcaggagtaattatagacatcagtttaccttaaatgggcagaattcagatagataacaacaacaacaaaaagagactgtggaggttattcatagtggactaatttgtttggaaaaaataagtagctataaatcagtatattctagtatctttgagacaacaaatattggaaattgtttttcttttcttttctttttttcccagcaagtgctgtgtttattttccaaacaattttattgaaatgtcccaggagtagatgggcagcacaaatgtatgaacaggaaaaaaaaatcacatgtacaataatttttttaaagtgaaggttaatcttgggagatatcagttcccctctccctccccctgcagacttccagcgtttccgttaaggttaagcctctacgaacctagcattaaaaaaaaaaaaaaaaaaaaaaggaatacaagatcttttgcaaataacaaaaacaaaaaccaaaaaatggcataaaggaaagagaaataccttcctgctcagatgggactcttcctaggcacctaattagaaggcgtgctgagcggtggagaaacacaacttcagagtgtaagggtatggaccattgggtttttcatcaggtaatggttcaggaagcccggagtctccagggcatcgctcttggattcccattccagcagtccagaggagctgcgctcgctttcgcctgagaatactttcacagaagatggccgcttcactcccagctcatcatagatctcaaagaagttctcctcggtcgcctccagcggggcgttgaagaagtgcagcacgttgctggggtgctggatgcggttcttggctgcctgctctggggtggagaaccgattgttccgggattcactgaagtctttgtaactgcaagacccatcttccaacccgtatgactgaccgggcatgatggctggctgcttggagacacagacattcagcttctgcccaaacatgaagttgttgttgaggtgggtaatgacccggtccacagcgtagccatcagccatctccaccatggcgcccccggcttgcttttcaggaatttcaccttctccacattgccatacaagcagaagacattgaagactaggtcacagttcatcttagattgatgcaagccttagaccacgagcacagggctgtcggcgtgagggccatactcgggtggtgggggagggggtggggggtgcccatactggggggccgtagcgacttgggccccgacagtgacccccgactggtggacccatccttctcccttcgtagtgaggtcgggggggcccgtggccctcatcatggtaatggctgtggtacccaccgtggggccctccatattctgcggggtgatctcccaggagagggggctgcctctggcgtttgttggggttgctgccagggtcaccttgtccactgagattggggtttgtgtagtcccaagtatcctgatcattcttgaacacattcaagcgtgtaggctttgcgtattccatcttcagagtgcaacagccagaatagataccagccccattgagagaggccttggcccgctgggcactttgaacagagtcaaattccaccatcgcctgaactccattcttcctgaaaatgataattctctggacagggccacaaggattacagatagtgtaaagaacatccgtggtgatcgaataaatggggttcaggatggtaaagagaagcacactgttcacgctccgggagtcatccgagtccccggggagggagatcttctggctggtagagtagttgacaaaagctgggtgaccggcaatgtatatttggttgtcggctgcgtagctcacggcgttgcaagcccccaacacatcttcaaactccaccagtgcttgtctctttttaggcattaccaccgcatagctgatgggtccaaactcctgcaaggcctccacaaggtcagcttccaccacatcgtcaatcaggcccctgctgtggacaactggggaggcaggggttttgtgcaggtcatggtagttctccccgccgccgcccccgccgccccgcctcctccaccgccaccgccgccgccgccgcctccgtgctggtcgccggcgttgccagtcttgagccgcttaggggcaccgccgccctcactgccgccgccttagtagccgccaccgccgcctctgccgccccccgccgccatcttcatcgctcccgaccgcctctgctgctcctcccgctgctgcctctgctccagccgccgacgccgcttctcccaggaaattacttttccaagttagtttggtaaagtttaaaaggttggtgctttatcctgtagacaattgagagtagtttctgtatttaagaaggataaataaaatgttctgtgtgcagggcggattagaaatggaagacattggaagcagagagaagttaaggaagaatgttgacattatcttaaagtgttaagaacctgaacgaaactccttgcaaaatcattgccagggaatacagtgtagggccattgactgactctagtagtggatgaggacaactcacagagagaaatctgacaatccatgtttagcagagggaaggaagccagaaatagttactaataagtgcaagacttcagttttgttggttttttgttttttactcccagcaagctaaatttgacaataatgtagctcaatttctccccatctcattttgttaatctctataatcttgccccagaaaagccatttgtaccccagctcagaaaattctgtattcatttgtcttcataagattgtaaaaatttcaaaactgtctgttcatgataattagagaaatacaaatcaagactacaatgagataccatcttacaccaaccagaatggctattactaaaaagtcaaaaaataacagatgctggtgaagttgtgaagaaaaaggaatgcttatacactgttagtgggagtgtaagttagttcatccattgtggaagacagtgtggcaattcctcaaaagcctaaagacagaaatagcattggaccctgcaatcccattactgggtatatacttaaaggaatataaatcattctgttataaagacacatgcatgcatatgtacactgcagcacaattcacaatagcaaagacatggaaccaaccaaaatggcaatcagtgacacactggatcaagaaaatgtggtacatatatgccatggaatactatgcagccataaaaaagaacagagaccatgtcttttgcagggacatggatggagctggaggctattatccttagcaaactaatataggaagagaaaaacaccacatgttctcacttgtaagtgggagctaaatgatgagaactcacatggacacacagaggggaacgacacacactggggactttcagagagaggaggcagagagatgggagatcatcagggaaaataactaatgggtgctaggctcaatacgtggatgatgaaataatctgtaccacaaacccccatgacaaaagtttacctatgtaacaaacctgcacttgtacccccgaacctaaaataaaagtttaaaaaggaagtgaaaaaaactttaaagtagctcaataagttttatattaatgtcaactttaaataatttttatgcataatacgttattaaaattcatttacctttttaaaaaaagaatgtgaaattttagcagagttttcaacaacaatgttgtagttaacaagagaaaagcatccctgatgctttacaaactggtgtttcaatgaattagtcttttttttctgagagggaatctcgctctgtcgcccaggctggagtgcagtggcatgatctcggctcactgcaacctccacctcccaggttcaagtgattctcctgcctcagccttccagtaccagaaggcgtgcaccatgacgcctggctacattttgtatttttagtagagacggggtttcaccaggttggccaggctggtctctaactcctgagctcccaaactgctggtagtacaggcatgagccaccggacctggccaaaatgaattactcttaattgtgttctattcatttgtttttcctgcattttcatttcatttcactttgatgaaccaaccgaaatacccgatggaatacagtgacagcttgaaaagcttcatgttaacaaagttatcattccacagtagataaaataatatgtgaaagtagtgagaacttaggaattcctctaaaatcagaatttaaagacataccacttaccctttgttaaaatagcttacagcacagaagtcttagaaaatgggcattagagtgtcagaaagctagtcatgttagaaaaaacctttcaaatcaaggctagccacctcattaaataataaaatgaagaaactagttataaaaccggtgttccattttcaattttaaaaaaatgctgatggtaaaataaccattaatttaaaatatttttctgctcacttctagaaggtggagcataaaccacttaagtgacctattttagccccactaaagcaaatggcaaatattgggattggattaccaaatgtatgccttccatttcattggccatatatcttattgtttcatgcatggataatggcttttctccttcttcagtaacccaaaggaaaagctgacattctaacctggagctgcacattcaagctttgacacatgcctctcactggtttcgtctaatgcttataataaacctgtagagtcagcaactttagaaagatgggttgaagaagtgtctttatcatagtttgaatttttctctggggcacttggcagagtcacctctggtgtttcaaatgtgcttgaaagttatctggctgccctctgagaagtctgcataaaaactgctttacttaaaagcaggcaaaattaaggtttctgtaacaaaaccataggcatcgcattgagataggacaaagaccaaatatcctgcttccatgtggcagagaaataatgaataacttggttcaagagctcatggagtggcatatcatcacaccattattaatagagaacattgctaatttctaaaagggcttcatgtcatgattattttatcctcttctttctgttaaatttttaacatgtatgtccactgcaaagtacgcaaaggaaataaattagcactaaaaaaagggcttcttcacaaccgcaaattatatatatatttctttcagaacatcactttagagagaaaatagcaaaaattcagcatcatcactttttgacagttcactagccaatcaaaatatagaaaaagaaggagaaattaagtacatttgtattcactgtacatttttagctatttgtgtagaagaaaaacaattagcttatttaaaaaccctaaggtgagtatgcagtttttaattattatctttgctgttgtgatttatatttgtattttatttatgtaaaaaccagtaaataaacctatgtcaaatacttctttatttttgatactagttcaaaatattggtgacttttttagatatgaatatctcatatgtatcttttagaaattatcagagagttataaaataatattggggaggtaaggaaggcactagacataagaaacttgtatagacaaatactttgtcaccaaagttgtatatttaaaagtccctattctttgtctcttatcgattcaaaattaattcattagaaaagaattttcctcaacatttaatccctagttgttcatctttttcactagtttgtattccattactcattgcttcatagctaaactctgtttaaatctgttaactgaaatgattttaaaacgttttggtggagcgctgcgggaggtgcgtgcgcgccccggccgccgaacaaaggagcaggggcgccgccgcggggacccgccacccacctcccggggccgcgccgcggcctcccgtccaccgccaccatgaccgccaacggcacagccgaggcggtgcagatccggttcggcctcatcaactgcggcaacaagtacctgagggcggaggcgttcgggttcaaggttaacgcgtcggccagcagcctgaagaagcagcagatctggacgctggagcagccccctgactaggcgggcagcgcggccgtgtgcctgcgcagccacctgggccgctacctggcggcggacaaggacggcaatgtgacctgcgagcgcgaggtgcccggtcccgactgccgcttcctcaccgtggcgcacgacgacggccgctggtcgctgcagtccgaggcgcaccggcgctccttcggcggcacggaggaccgcctgtcgtgcttcgcgcagacggtgtcccccgccgagaagtggagcgtgcacatcgccatgcaccctcaggtcaacatctaccgcgtcacccctaagcgctaggcgcacctgagcgcgccgccggccgacgagatcgcagtggaccgcgacgtgccctggggcgtcgactcgctcgtcaccctcgccttccaggagcagcgctacagcgtgcagaccgcggaccaccgcttcctgcgccatgacaggcgcctggtggcgcgccccgagccggccactggctacacgctgcagttccgctccggcaatgtggccttccgcgactgcgagggccgttacctggcgccgtcggggcccagcggcacgctcaaggcgggcaaggccaccaaggtgggcaaggacgagctctttgccctggagcagagctgcgcccaggtcgtgctgcaggcggccaacgggaggaatgtgtccacgcgccagggtatggacctgtctgccaatccggacgaggagaccgaccaggagaccttccagctggagatcgaccgcgacaacaacaagtgtgccttctgtacccacaggggcaagtactggacgctgacggccactgggggcgtgcagtccaccgcctccaccaagaatgccagctgctacttcgacattgagcggcgtgaccggcgcatcacactgcgggcgtccaatggcaagtttgtgacatctaagaagaatgggcagctggccgcctcggtggagacagcaggggactcagagctcttcctcatgaagttcatcaaccgcgccatcaccgtgttgcgcggggagcacggctttatcggctgccgcaaggtcggggcaccctggacgccaaccgctgcagctatgacgtcttccagctggagttcaacaatggtacctacaacatcaaagactccacaggcaaatactggacggtgggcagtgactccgcggtcaccagcagcggcgacactcctgtggacttcttcttcgagttctgcgactacaacaaggaggccatcaagatggacgggcgctacctgaagggcgaccacgcaggggtcctaagggcctccgcggagaccgtgcaccccgcctcgctctgggagtactagggcccgcccgcccttcccggttcctgcccacgtggcggctccttccaaccctccctgctaaccccttctcctccaggtgggctcccccgggcgggaggcaagcccccttgcctttcaaactggaaaccccagagaaaacggtgcccccacctgtcgcccctatggacttcccagtctcccctccgccctggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatctcttgcccctcccagccacctcctcccagccccccaggagctgggcacgtgtcccaagcctgtcagtggccctccctggtgcactgtcccgaaacccctgcttgggaagggaagccgtcaggtgggcgaggactgagcctcggtgtttttttgggtggtggctggaaacagcccctctcccacgtggcagaggctcagcctggctcccttccctggagcggcagggtgtgacggccacagggtctgcccgctgcatgttctgccagggtggtggtggcgggggggtaggggtgtgggggccgtcttcctcctctttcctttcaccctagcctgaccggaagcagaaaatgaccaaatcggtatttttttttaatgaaatattattgctggaggcgtcccaggcaagcctggctgtagtagtgagtgatgtgggtggggcgtctcagcaccctccccagggggtgcatctcagccccctctttccgtccttccggtccagccccagccctgggcctgggctgcggatgcctgggccagagcccccgctgtgattggtgcttcctgggcctcctgggtggatgaagccaggcgtcgccccctcggggagccctggggtgagccgccagggcccccctgctgccagtctcccccgtcccgtccccgacatgcatctcactctgggtgtcctggtcttttattttttgtaagtgtcatttgtataactccaaacgcccatgatagtagcttcaaactggaaatagtgaaataaaataactcagtctgcagctcccccccccaaaaaaactttttgtccattttttacctattccatttgacattggtctcatatgatatcatgatataaaggaaaatgaccccgcaatgatatgattcataattccactataaatttccttgatgctttgagagtgtgattgatttattttgcccccttccttttttttttttttttaactataaagcaggtacctgtacaataatgccatttttttaaactccaaataaatagaaacagctataggactaaagtttctaatatgaatcttatagtttacttagcacatgctttaataaagttacctcttcaggaaactagaatattgtgtctggtgtaagactagatgttttgtcaaaagcatatgtaatattcatatagcggagctttggctttatgccatgaacaagcaggaggtgtttttggaactgacctgttgattttcacacgttatttattagaaatgactgctgccattcccacatagtcctaagtgtaaacatttaccatatgtatgtggcttcaagattattttgttgttcacaaaatcacctatgtcctcccatcaaaacactatcctcatcttaaaagtaaatggcactattttattcaatgatttacattttggaatcctaaccagatatttttttccttaaatttcaagcactgcattacttccaaagacatgctatgggtatgtggaaattatatcaaacatgagtaaattttgttgaccaagactgcagaaataacaataccatcacataaatatatgaatacagatgttgatggttggtgaaaattacccccaaatagccaatgccacgagtatattttgaatagctagtttgatttttattaacattatactaaggttatttctaagcctgcagacaaaatttatagaatatactactcagatacttgagaatgtactacttaaatatttggatatttttattccaaatatatctccactgtgattttttaggagatacaattgccatcacagtaagatattgctgattccaatgaaatttttaattaactagaaaaatcaaagaatgcaattctttttcaagatttcttcaaataaagaaacaagcaaaattaggctgtggtgctgtgaataacaccaagaagtatggagtcaggcaagcctcaggttcagtcacagttctactgttaagtagataattctaagggtgcgtctctgtgtcttaggtttgtggagacctacagcagcgttccacagaccaacactgagcctaccccacgactattcaacctgaccattattgggtagctttcatctaaccagttagaaagaaaacatctatgaaaactatttactaaagaattatatattttaattaagggtactgagcacggtcaagttagagaacaatagagtagaaaacttctattcaaatataattgagaccagttttttgatagttaatctaaaaagtgagttaaggaggaggatcatggggttaaaaaaaaccagaaatgtaaattatttggccaatattttgatataagtccaggaccctttgattattactctactaactggagtttctatacattgtcttctttgtataaattaggatcataagaagtcaattataattctaaatttttacttgtttaaagtagaacaaaaaaagtaattgaagtgcaaaaaccttttagcttattaaatttttgctattctgattattctaattttataattttttcttaaaaatttacattgcttagccctcctagtaatcagcttagctttttctaatcttttcaagacccagatatttttacataaatagcaccactctattataatcacatccctgattttatttatgtcacaaaagaccaacttgaatacaacctaaataaactgtctggtagataagttaacaacataacgtcaatttgaggcaacagacttacataggcataatagaaaacacactgttattttacagggagaatgtacagtgtccgttcattcaacaagttagttaaacacaactcaactaaaacaatgtcattgaaaagtagcaaattctgtttttgctccatggacttacagccaatgagtcctgagaaagaagagagaatttaaagagcttcattggcaggtgaatctgtacttggccttttagcttagagactgaagctccatattcaaagcagaagaatagtgagacatcccatatgaagaaagaaatcagaacagacatgcaggggcaaaagtagccatggtctgcgtcctggctcaggaggacagtatgtgttgaagagcaaagcctagaatgggctgatgcctgtaacctcaccccatctcattgctttatctactcacactgcttgcccagaaaatctggtgccccacagtgagaacaggaactgggcatcccagctaatcttcagctgggtgggtctcatagggttgtcagatttgaaaaaaataacaataggctttgaagaaaaagacttggagatgaagcagaatgctcttgccaaagcttccctcaattgacataagaggaacaaatttatttcccaaattagttatagtataatttaccaggtatccaaataaatttgtttagacactaagagttttcccctcgaataatgcctgaccataattttacatataattcctttattcaacaaatgctcaaagtatgtttgttttataccaaacacttttaaggaattaggaataccattgtgaataaaatagacaatctctactaaatgcttagttatgatggaaggcaaacaaatacataaaataagtaagaaatacagttttatgcctcatgatgtcagatgatagtaagtgctgtgtccccaaaacacttactcattttctcaaactattataaaacagggacggtgcataaagagtgctggacatgggactgaagattctgttttaaatatggttgccagggaagtcctcactgtgtaagaacattccatcgaggacttgaaggagatgagggaagtcatcaagaggatgggaaaaagaacactcccagtaataggaccagcaaatgcaaagaccagaggagaaagacatctgctttgtttaagggacagcaaataggtctccctgctacagcagagtaaatagagtggaaatggtagaagagtttttagttgtaaggcaagaaggggaccaaccatggagagtcttagatgtcattgtggagatttctattttactggaggtgaaatggaagccactgaagacacttgaaatggaggctgatatggttcacagctttaatagtctgctgtctgctgagataagaattgactataggacaaagggtagatttaggtagtgagatgttattgcagtcacctaggaaagagataggatgatttgaactagagtggtactggtaagaggtggtcgtattttgaaaatatctttgaagtagagttgacaggatttggtgatgaatttgacatggaatgtgagtcaaatttcatagcctgagccaaacatccctatttaattaggttgaatataatggaaaaggtggggggaaatggattaagaaaagaaagaagtttgttgtgggaaacagtaaggtgaagaaaccagcagagatgttagatatctaaatctgagttcaggagttttgaatgcatagaaaatttgatcattagcatggggctggtatttgaagccatgagactggacaaggtcattttagtttagtgtatttccacagattatatttcaagcatcgtgctaggtactttaacgtttggccattttaaaagccccttggtaaatttcacaggaatcaggatttgactgacctgtttttctcagatgtctgacctcagtcggatgcatgattttattatatttaattccctataaaattccaaaatatcaaaataagacctatatttattagcaggatttttcaggtacaatattcctactcagatagaactatatcacttaatttcacagaaatatccttccctggggtgatgatactattatatcaccaatcatgaagtcatgctgacttgcaggcaacaatggagctcacatttagatctaagctaatttgcatgacttacttaaattatgaaaagacacacttttagagagcaggcagattttgttaattctgaattatgtcaaagtatcacttaataattctcaagggcccaactctggcgaaaccggatgctgcagcgtatgtgtttcctattcccttccaacttttttcatcatgattcatcagcgaatgctatgaagtctagaaatttaattaatggatatcagggccattggaccatgcatttacacaaattgctctgtgaagaaggaacattcactctctctctctctctctctctccccaatgttttgtccccctctttctctttcaagagcagaacattttagtgacctccagttaactgtctgaactaagcagccatctcttaggtaataatgcattgctaacaaacctcagcatagacagtaacgctaccactaaagcttctgttcatgttgttctagggctaataaaatggtacattgtattctagctctgaggaaatttgagattgtctcatattttctcagttaaaccagataataattaattatggggaagggagaggaattgctgtggcagagccagcgtgagacataatttctatttattctcaatgtattatctgttttctccctagaggcttccttttgttactcttatatcaaaatcccacttaattttcctgccatctcaactcaaaaatcatacctacaaaagagctaaagtgttcatctttttgcttttgcacaaactctgtgccagctatgagagtgtaagctttatagttatatatagatgtttttatttataatctttctcctgcaagaaaggattaaagtgaagcaaaaagaacatgtaataagatgaataatgaatagaaaaataatttgctcttaagacaaagtaaaggaaactataaaagggagatgactagaactatttagcaagaagagacctcgttctttccatcaaatagtgtggtgtaatttgcacaatgcacccaatggttaatgaatacatatttgttgaggatagcattaataaatagatgaccaaagaaaaactaatacaaaagatttttacccttcaggaagtaactattaggtaggtattgtaaattctaactttaaaagatagaggaaaagatatattgagctgacccataaatacaacaggaagacacagagtaacaattactgcaggtgaatttcagctctcagtctatctaccaaccagtgtcaccaggaaccttcttcagactcatgtatccaactgcttatttatcttttgcacctggatatccctcagctacctccatttaattcatcttcttcctccaaactggtcagcatccaagcagatccagagaactgtgaggagctattctagtctctgccctctcccccgttgctgatccagttaagagggccaaagaatatagttgagaggacaccagctctgtatctagtagcatttagttttaatctcatcccttaacttgaaattggcatggccttcagtaagtgatttaactcctctggatatcaattgataaaatgtgaaaaaatttccaaaattaattgcagtgagtattaaaatagcatgttttgtacatcatgatctctcaataaacaattgcagtattattcaaattggcacacaggcctatcactgctccttccttttagattttttttccttctgtttttgcctctgaatgccccaagccaatctcccttcctctatcacctttttaggaaatccatccccaccccactcaccccaccactcctcacactcctttctctcctaccctggcctccaccatagctcctccattcccacctgtaatccagcctctgcaccactatcagcgctgcgcttctgaaatgcaaatctcatcatgttgcaccttataacatctttgaatgactcctacttgtctcatgatgaattctaagctccttagttttaggttgaccatgaccttttttgatctgaccctgtccatctctccctcctaattctcatttctctccaccaaatactccacccttcgtactgaacaatgtggctctactgtcatctcttcatacttatattttttccttgatccttaactttgttcacaatgttcctgccatctggaatagcattttccctgttggcctggaaaatttgactattcctttgcgatggaattcagtcttcacttccccatgagtgaccttcttaggacaaattgacagtatcttatattgtagtcccacagtccattaggcagtcttcaagtgtccaataggagagtgcatgatattagttgtttatatgcctatttctcccactggctttgagaaacttcagggattgttgtaaccatttgtatccccagtgtctagcatagcgtgcatctatttgtgttttgaatgagtgagtgaattaacgagtgatgagaaagccatgacctatgtttgtctctaccaatcttaaatgagattataaacagactgattcaactgaagattgcaggtcctattccttttgcagttgttattgtacatgttagcaaaaagcttcagcctttccaaaaatttcttcagtggtagcaataaattcattgtcttctgggagcaacactgtgctccctctctctctgtctctctctccctgatttgcctattgctactttgaagagtatgtgtttatgactttataatttgctacagcgcatgtaataggagcccttctatttcttcagaagtggttataagaaatattcacacttgcttatgttttgtgaacatctatatctggtggagcacatgttattataatcttattttaagcggaaatatagattaaaggattttctcttactgttcttaatgtaatgcttctaaattagatacacgaaagtgctcatctaggagataatggaagcataagcaaaacacagaaaaagccttaccaagaatgaattataaccaacaaacaaatgttagttttattgcaatagaattactgaattagtacatgatggaacaaaaaatctataacaagtttagatgtcagtaatgtattcgacatggattgtatacactgtacccacaaaattctatcaaattgtttctatttcaagaaattttcagtttattcatgttcaacacaaaagttaattatacatgaaatataaactcaatgcagaacattggcattgtatttcctggctttctgggaagaatgtgggagcagggttaataatgaaatggaagagaaagctcttcactcctctccttgttcccaggataggacaaaatacacatggccaagaatgaggaaagtaggacaaaacccaatatagtcaagaaagttatgaacctgaggtatgaggtaagatctggccctgggaatgttgactgacactgcaatatttagtatctagactggaatgattagatatgaagtgggttaacctggagtccttagagatggcgctattcccagaaagataaatgagatccagtcctaggacaaaaggacaaacatcattggtcggaaaaagaaaaaatgatttagaaaaaaagagaaagagaaacaaaatgtagaggagaagaagaaatcccaaggatggagaccaaagggtttgccaacagtctgttccttgggaatgcgagttacaccgcagcctggaagatgatgctacttccaagcccatgattctgtctccatgacttaggacactagtcacaaagaaatagaacacatctttctccttctagatctcattgtccattgaagaactgctactcatggcctgcaagagtgaaactcattggttctaggaatgaatgaaattggacctgctggaggcctttaattattatgtgggcctcagaactgatgaggattgatgtgggtgttatttcaataaagagttataaacaattcatatatgaaaaatttattttcttaatttatagttaaatacactaatattgtatttcaatgttgttattcaaattcaagaccatgtcagttcttagacacaatctctcactgtgtattaatttcaaaaagacattgtagtaaccacagatatattttatatatagatataaattaatagacattactttttgagctgttttatgtttagaggcaaaaattagtgaaagttaaagtgcctgtctgtagactctctcactccacccccatttctcctatttttaacatcttgtggtatttttaacattagtgtgttacatttgttacaagtgatgagaaaacgttgataaattatttttatctaaagttcataattatattagggttcactctttgtggtgtccattttatggattttaacagagatgtacccaccatgacaatgttacacaggattatagtttcactgccctaaaaatcccctgtgctctacctagttattcctcctttctttcctccccaggaacccctggaaatgactgatctttttactgtctccacagttttgcctttttcaaaatgtcatatacttgcaaccacatagtgtgtaggctttcatattggcttctttcactcagtaatatgcatttaaagttcttccatgactttttgtggcttgatagctctttttttatatagaactggttaatattccattgtatggctacaccgtacagtgttagtccatttgcctattgaaaggtcctttggttgtttctgttttggtaattatgaataacactggtataaacatttgtgtgcacgttttgtgtgggcataagttttcaactcatttggcaaataccaatgagcacaattatggaatcataggctaagagtgtgcttagtgtcataagaaactgctaagctgtcttccaaagtggatgtaccattttgcatcccaactagcaatgaataagttatttctgctcattgttcttaccagcactcagttgtgttgctattttggattctggccattataagagctatgtagtagcatctcattgttttggtttgcaattttctaatgacatatgatattgagtatcttttcatgtgcttatttatcattagtaatatgttgccatcagtaacgttcctttccctttccattgccagtgagatccagcatttttttttttttttttgagacatagtcttgctctgtcgcccatgctggagggcagtggtgcaatctcactgcaacctccacctcccaggttcaagggattctccctgcctcagcctcctgagtagctaggattacaggcacctgccaccacacctggctaatttttttttttttttttactagagagggggtttcaccatgttggtagggctggtcttgaactcctgacctcagatgatctgccctcctcagcctaccaaagtgctggattacaggcatgagccaccgcacaaggccagatccagtatttcttaatggaaatgaaaaattcaccagttactgcatttttccccatatatttgtaataagttccgacgtctgataaggcaagtccaaccctccgcattttaaaaaattaatcaagttatttattaaaaattaatagtctacgcacattttaaaatcaatgaccatattagatttactggaaaaataatgtaatttaatattaatttatcacatccattaacatgataattctccacttatttggatttcctttaagatcaattcctaaaattttctatatagatggttttaggatttttttttgtagcttaactacaagatactttgtagtgtctcaatttttattacacttttacaccttcaattcaattattgctgatatggaaaaacttttttttcaacatctattttagatttagtgggtacatatgcagatttgttatatgggatactacttgatgctcaggtttggagtacaaatgtatccattaatcagatggtgagcatagtatgcaatagttactttttcaacccttgtccttcttccatcccccatctaatagtctgtgactttgtactgttttctattatgaattggggaaaagccattattatattagcttcagaacaactaggttcaagtcatggaaaacaatttcgcacaaacaactttaggaaacactgctttgaaaactgtaatctgaattatagctgaggccacagaaaccaaatatttactgaaggttcttttaagaaaaacaagttagccaggaatggtggctcacgcctgtaatctcagcactttgggaggccgaggtgggtggatcatgaggtcaggagattgagaccatcctggccaacatggtgaaaccctgtctctactaaaataagaaaaaattagccgggcatggtggcacatgcctgtagtctcagctactcaggaggctgatgcaggggaattgcttgaaccagggaggtggaggttgcagtgagctgagattgtgccactgcactccagcctggtgacagagcaagactctgtctcaaaaaaaaaaaaaagaagatgaagaagaaaagaaacaagttgtattgaaagaggacatcattaacagtatatctcttcaataatggtttattttactatattctcattcctctcttactgtgtcccaaatctctttacaggctaaaagaaactgttcagaattaatcctattcataaagaacagcacttactgagtattgcattttcctcttcaaattcttcagcatacattgggactacaccatatggaccatttttacatttttacttttgggtttttgttttttttttcctagagaaactgcaactagatttaggtcctcattctattaggtcagtatttgtctagtaaacttcagcttaagcaaaataaaatatgtgttgctttgaactgaaactcctcaaaaccgtattttaaaaattacagaaaaaattaaatgaaattattattttaaaaatcttgtagatgaaaagatatgatatatagtaagtttaagtacctatttcaatggttcccacagtggggccctcagacacccaggtccaaactattttaacaggaatactaacatggcgacatttggtgtaagggtgctaatacaataccgggtaaaaatgcgggcagtttagcacaaataaaggcagtaacaccaaactactagtaatcatagtattcttcactatgcacaggaaaggtttgaaaaagaagggcaggttgggcagtgtctcacgcctgtaatcccagcactttgggaggctgaggtgggaggatcaccagaggtcaggaatttgagaccagcctggccaacatggttaaaccccatctctacaaaaaatacaaaatttagctggacatggtggttgcatgcctgtagtccctgctacttggaaggctgagacaggaggattgagcccagaaggttgaggctacagtgagctgtgatcatcctactgcactctggcctgggtgacagaacaaggtcctgtctcaaaaataaaaagaatgtctatgatgaagcagtgaaaattttactacatcttaatccttgaatatgtctttttaatatttcaagtgatgaaattggaagcacacatgagcattcctacagactgcctgaggaaaaaccctcatgtgactaagtcttgaagtgaattaaccactttaatggagtatcatttttacttgaaaggagtactgacaaacaatgttatttcaactggggtttttgggagacattttctcaaaaaatgaggttctgtcatttcaagaaaaacaacagacaggccataataaaattcaataataaaactgctaataataaaattaaagcttctgaataaaaaattagaattttagaaaatatatccaccattgctttccaaaagtattctgctgagattgatggtgatattgatgaatgtattttgatactgtataatcaaatgtatcaacatgtagaagatctcggtgaaccattattttctaaatgaccaatgcatgatgttataatatcatgcaagggtaaaagatccaaagttcaagaaaaaccaagttttgatggagtatcaaaaaagaagcctaggcaacatggcaaaatcctgtccctacgaaaaaaaaaaatacaaaaaattagccaggtgtggtgatacacacctgtagtcccaactactctggaggctgaggtgggaggatcacctaagtccccagagactgaggctgcagtgagctgtgatcacaccactgcattccagtctgggcgacagagcaagaccccatctcaaaaaacaaaatttatatatatatataaatatataaatatatatatatccacaatgatctaaaatggctatctgtatgagattggacattgttcacatttcttcaaggaaatatcacacaataaattgaatgcagatgaaaatgacataccagacatcaaggaaatttgcaaaaaatataagattgtgctactttgggtttagaaattttttcataaaaacatttataacaatacgtggtgagcttttaaagaatagtttaaatatttctgatttaatttctaatgataaataccagtagatataacctacataaaccaaagctccttgggccctcaatatatttttaagaatgtaaaggagtcctgattccaaaactttgagaactgctgccttcccctccactttcctgccttccctagaatttcttccttggaaggaacatccctttgccattttaacttacagagttccattcaggccagttttgctacctccctcccatctttccacctccctgtcttgacacaaaatctgaccaaaggactctaccagcccaccccatttccagtgcttagctgtcaaggtgggctaagccaagaaaatctgggttttctctgagactagacctctttttctgggagatctggaatcacagggacaaggttggccaccttgggatagtcagaattcatcttgcctcaaaggggagaggttaggcaagtttctacaaagccaaactgcttcctagaaagtcaaagataattatactttgtgccacaactgtgagaatgcccattttattgcacactttctaacatttttaccaaactgataaataaaagctggtacctagaagaaaaaaaggccaggcatggtggctcatgcctgtaatcccagcactttgggaggccgaggcgggtggatcacctgacgtcaggagtttgagaccagcctggccaacatggtgaaaccccgtctctactaaaaatacaaaaattagccaggcgtggtggcaggcacgtgtaatcccagctacttgggaggctgaggcaggagaattgcttgaacccaggagggagaggttgcagtgagccaagatcatgccattgcactccagcctgagtgacaagagcaagacttcatctcaaaaacaaaaaaaggttccatacaatataatttgttccatctctagaaaccaattcagcaatgagaactgaaagccaccacttggaaggtttcaaggatttagctctacctaatgacgtctaaagcattagttaaggtagaaaaaaatacacacacacacacacccctatgtatttagtaccaggaaacatgatggactagatggtatagtcatccaacagaaaacacacaataactgaagccactgtagaggagtaagttatgatgtggatctacaatattgttgagtgaaaaagcagattacaaaaaaatctgatttttcaagggagagggaacacatacaagcacaggagaaaagagatgagcagatgactggaaaaatacaaaattctgatagtggtaccttctgagtgggagaattatcggtaacattttctagttttgcctaaacattttctaaatttcttaaaataaggctttgttatccatattataaaatatccacctcctcaggaaacttaaccttcagcacaaatgctacaacatgttcaaagtttgttcagtttaagagacaatctattttgaaagacatctaaaatgacgaccaatatttaaacctatgcattaatatttttcaatcatatgctttaaattttgtaattttgttaaggttaagctttatatccatctggaaaaaagttttctatttgtctttaaaatatgacctacaatataccagtttttaaacaatgaatggtgctcaaaaattgcaatataaattcaggcagtgttccttacatagaatgtttaaaggcttctaacactgctcttcttcaccggttatgaaaacacattaccattatctaagcatctaattattcaggtcctttgtttctcctctattctattaattttatagtaattttaaggcctgtgaggatgaagttgtctgtgacagctaccacaaaggttactataagtggacaaatttcaaacaagtttatcaccactaccatccccaccataaaactgtcttaatcaagggcaacacatttcaaggttaaccaagacaacctctttacctgtcactgcttaagaaaaggactttttggtcttatttagaaataactttctctatctatttttctccataaatccactgagatcaatgtatggctctatctcaagcaccagcaagcaaaactacctgccagaatgtgcagtttttgtatctttccaagtgtaggacacagctatcttttgacatcacaatttttaaaaaattgatgcacaaacttcttcttgaacgttcagccaggcatggtggctcatgcctgtaatcccagcattttaggaggctgaggcaggtggatcacgaggtcaggagttcgagatcagcctagccaagatggtgaaacctgtttctactaaaactgcaaaaattagccgggtggtgtggcaggtgtctataatcccagctactcaggaggctgaggcaggagaatcacttgaaccggagtggcggaggttgcagtgtgacgagatcacaccactgcactccagcctgggtgacagagtgagactccaactcaaaaaaaaaaaaaaaaaaaaaaaaaaggaaaagaaaataaagttcagacatacagcagttgtaattctaagttcagacatacagcagttgtaattctaagttcagacatacagcagttgtaattcctctgaaggctggttatgggacacatcactttcatactttgctgttcaataaatgtgggctggagaataaagtaaactgacagaattaccatataaaataaaattctaagtgctctgacaacaagagaaccttaaaatacacacacacacagacacacacacagttttccctgctaatcattttacaactaaacaaccaagtagctaacgcagagcccacaaaagcggagtaaaaattctaacacttcgtaaaataaaaatgcacatatacccctgtgatctaaaaaaaatgcttaagtattcaaagacagcaattacagctactgagaacatcgttgtgagcaaacagaggcagagaaaacaaaggtgctgatgaggatttgaagcacctaacctgcagaaacccactgggtgatttcctaggttccagggtggcattatctttcagaacgatcttcaagaagaggtcacatgacactgttacaaaggatctggagaaagagacccttgctttatctctccggctctccagtcatgcttcacattttcgcttcttacactctttcacatgaagtccatttacacacctccatcaagcccttagagacctttttgcactatccatgacaagttctggatgtcatctctgcacttttgacaaattcttagcagttaacttacagggcagttaagatttttgttcaagcacaatatagctagaatagggtcatatactcaataaaacaaatatttaccaagcacttattgagtggaagataaaaagcacaaagcataattacaaaatattctcccctgccaccataaaagaatttcttaaaggcttacagaatatagcataacgtgaccaaaacaaaaatagtaaggactgaagaggggaggaagggaaaatatcagcatgaactcaatatgacccagaagagccttgatggtcagacgtgtaaagacgagttgggtagggttaaagggtggaggtcaggggcacaggtcaggggcacattctacaagggaaaaacagctgatacagaagcctgaaaggaaaagcgggcagagcacctgtacaggactcttacctgcggcatctaccatacaatgcgcctttccagaacacagcagtgcgcagccagcccctggggagagggatcactcaaacagcaccagaggctgcattccaacttttcttccatcaacgactccgttttcattgttagtttctccttcaacacaaacttgaaaccaattggctgaacacgcgggagcaaggaaaacctgactgaagaatgaggcgttaaaacttaagggccttgggtcctggcgcggtggctcacacctggaatcccagcactttgggaggcagaggtgggtcatttgaggtcaggagtttgagaccagcctggccaacacggtgaaaccccgtctctactaaaaacacaagttagccaggcgtggtggcgggcgcctgtaatcacagctactcgggaggctgaggcagcagaatcgctttaaccagtggactgtcaagagagataggctgcaatgagccgagatcgcgccactgcactccagcctgggtgacagagtgagactccctcaaaagaaaaaagaatttttttttttttgagagaagtctccctcttatcccccaagtttgagtgcaacggctggatctcagctcactgcaacctccgcctcccgggttcaaacgattctcctgcctctgcctcccaagtagccgcgattaaatctcctgccaacacgcctggataagttttgtatattttagtagagacggagtttcaccatgttggccaggctggtctctaactcctgacctcaggtgatcgcccgcctctgcctcccaaagggattacaggcgtgagccactgcgcccagccaaaataccgaaaatcttaaaggtctttccccttccccgcctgggctcaaaaaacgccggagccgccctgcaccgccctgtcgcggtctccggagcaggctggccgactgagggcgaccatgggtcccaagaaggctccggcagtcgcgggctcccacctcggggcgcggcgacgggggcctagaggggccaacagcccccaagcttacgccacgcgaggagtcggagagacgcgccctcccctctcctcccacccaagcctccggcagtcccgggccggggctgggccagttgcgggagaaaggggcggggaactggggcctctctggggaaggctcccctttgtcctgggactccgggcgccccctctctgccctcgccctgccccgcgaggccgccgccgggcgcctcacagtcatgttgcagtggagcgtgagcgggggctgcggctcctggttcttgtggaagatagtcccagaaacttccctttggccttgaaccctgacacggacatcttccactcatctacggcgggaggggcgcggaaggggagcctgtccggagccgctgtcacggccgcgactacccagcggggccgcccagccgagctttcgcgactctgcctctgcctgccgcctggacccttgtgggagcgcggctggaaaatggcaagggcacggaggccttggcgggagctgtgtggcggcctggggggctgctccctttgtaaccgactccacccacaggaggcgcggctcctgtcaagccgcagcttcaaagggcaacataaccactgcccccactaccgcctgggaaagggctgcccctaccctgcccccgtcaccctcacccctcacccctcaaccaggcgggccctgcgcgcaccagtttcggcgggtgcacgagtccagagcgtgcgcgcgctcccggctgccccctcctcccttgacccagcacctttctgcccgacccatctggttccttcctcacactcgccgactggaagctcagggcggcacagccactaactctctctctctctctctctctctctctctctctctctctctctctctctctgtgtgtgtgtgtgtgtgtgtgtgtgtgtgtgtgtgtgtgtgtcccaagggaacagagcactgctgagttcaggcagatgataactcgttcctggacggtcagcaaaatacagtcccaagaaggctctgtgctgatttgtcttttgcggtgacatcatgttgctcatgttttatgtttttcggagttcattagtttctttttgttctcagttaatatccagctcaatagattgtgtaagtagaatacccccaaactgaaagtcacctacataaaatatagtgaaaaatatgtcacccacttaaactgtagttgaaaacatgtacactttagttttgcgtagtcaacactggatcccagggctagactgcctgggttcaagttccaacgtagccacttgctggctgtgaaatacttgacagctttaagccccagtttctttttttgttttaacttcatcccgaatgtgatagtaagtctcagtttcttgatctgaaaaagagaaatgattcaatgagagtctagtgaaaactttaaagtttttaaagcgactacctggctaaggaaagtcctcagccttagccgttattagctatgattattattgtgttggctacacgtgcactaatgaggcaggaaaatgctcaaggataacaaccaagtatgcaaattatctcatcagaccgagagggaggcatatgtgtgcatgctcacgtttcagctcagagccctttgtctagaaggctcttgaactcagaggtccaggcactatcagctttgcagtggagccatcacttttgttgatcaatgaaattgacataatgcttttttttttaaagcaccaaccgtgtgcctcaagctaactgtcaagaaaagcatgcgtcagttggctggagtgagcaattcaactcgtggaggaatgagaaatgttagcgttgagacgagaaacataaaaccccaggttaaggtaggaatcactgaaagtcaggcaaaggaactgacatccagtaatgagttaggctttgccgggctctggccctacagatggctctttggagaggaaaaaattaagccaggcctgagggcacagatcctaagggaatgctggcagctctgggctgtctatggaagagaagcagagggtagcgcctggttgaaagagggtgctgggggacatagcttgagcctgtgtttacagatggagtcccctgattcctgagactgggaaaagagatcgtgcccggatcaggggacctcaaatcacaactcttcccacccacaccccttcttttcagggcgtctgtcgctgcaaactacaggtaaactagttggaaagctccgcagattctcacggtggtgcccagcaggccagccctagctgccctttaacctgtgactgaggatgatgccactggcctgtaagcacacattggaaaatctttacacccatagacacgccatgccccacagagacagctgtgcagggttctttaggtttggggtgctgtgctggcagttgccttataaatatgtaggattaaaatgggatgccctggagcttagctaacctttatcctccccccactccccacccccaaaatgaaggggctgctagttttgtttgctttatgaaagatggatctgtcattgtttttagaacctttggagaaagatttcttgggaggaagcgatcctgaacccccagagatttttctcatttactggcgcaccagctttagagtcctaggtcttcatcttggcccagccaccctccaactgtgtgacctttgagaagctgtttgactaaactgaatctcgttgtcacctatgagtggaggttgctacgttgttactgtgtggagcacctacccccaggcactcttatagggtgatggtgaagattcaatgcaacaataaggcggaaggaggaggctggcttgaagccgggagttcaagactagcctgggcaacaaagccaaacctcatttatttaaaatgtttatttaaagatgtttatttaaaaattagctggacttggtggcttatgcctgtagtcccagctactcgggaggctgaggtgagaccaattgagcccaggagtttgaggatgcagtgagccgtgatcgcaccactgcactccagcccaggcaacagaaagagaccctatctcaaagaaatgaataagtaaataaataaataaacaaacaaataaaataatgcatgcaatcggtacactagtacatgctcaggcacatgataaatgctcgataaatggtagccccagtaaactttgtaatgttttgggagaggatgtcctttggactcagcccggtgacaaaagcatttgaaaagactgatgtgtatgatggctatttcctacaggtacaagtctgtacctccagggacccaaggcattggctcgactgggtaacttgttctgtttactcttgttttgggcagcaccgattgccctagggctaagcaggactgccaccccagactcgattgccaacagtatccccctccccaagctagccatgggaaagccacttgcatcgtaagactacagaaaatcaaagggaagaaaaagcacaatttagtcagctactctccagttgatgggcaataagtttttgctattttgaacagagctgcatgccttgtccacatcccctgttttatatagtcaagaatttgtcttggatgtagagtagagttgctgggcggggaggagtgtgaatattcaaccttatgagatggagccaaactgttttccaaggtggtcataccagtgtatgctcccagcagcaggcagcagttcttttttttttttttttgagacagggtccgcccaggctagagtgccgtggcacgatcttggctcattgcaagctctgccacctgggttcaccccattctcttgcctcaacctcctgagtagctgggactacaggtgcccgccgccatgcgtggctaattttttcttatttttttagtagagacggggtttcactgtgttagccaggatggtctcgacctcctgaccttgtgatccacctgcctcggcctcccaaagtgctgggattacaggtgtgagtcactgcgcccggcccaacagcagttcttaagagatctccaggatctctatcttctggtgatgtcacaagcagtcaaaagaataaaagccagctataagcaacaataagaatctgaacaatatactattaaggggaaaaaaacaaattccagaaggatgcatacagcatactttatataacttggaaaaggaaatgtatatataggccgggcatggtggctcatgcctgtaatctcagcactttgggaggctgaggcaggaggattgcttgaggccaggaattcaagaccagcctggacaacacagcaaaaccctgtctctacagaaactagaaaaattagctgggtgtggttgtgcaggctcctagtcccagctactcataaggctgaggtgggaggatgtcttgagtttaggtgttcaaggtaacagtgagccatggttgcaccactgcactccagcctgggcaacagaatgagaccctgtctctaaagaaaaaaaaaaaggaaataagtaaaatttaacaacaaactgtgggccgggtgcgatgtctcgcacccataatcccagcactttgcggggccgagatgggcagttcaggacgtcaggagttgaagaccagcctgattaacatggtgaaatgacgtctctactaaaaatacaaaacttagccaggcgtggtggagcatgcctgtaattccagctactcaggaggctgaggtaggagaatcgtttgaacctgggaggcagaggttgcagtgagctgagattgcacgactgcactccagcctgggtgacagagcaagactctgtctgcaaataaaataaaataaaataaagtaatataaaataatttttttaaaagttgggtttttgaaaagacacacaaccttgacaaacaaaaggaaacatgacaactgatactacagaaactcaggccaggcgcggtggctcacgcctgtaatcgcagcactttgggaggctgagacaggtggatcatgaggtcaggagatcgagaccatcctggctaacacagtgaaatcccgtctctactaaaaataacaaaaattaaccgggcgtggtggcagatgcttatagtcccagctactcaggaggctgaggcaggagaatgccgtgaaccccggaggcagagcttgcagtgagccaagatcacgccactgcactccagcctgggagacagagcgagactccacctcaaaaaacacacaaacaaacaaacaaaacctcaaaggatcactagtggctattatcagcaactataggcaaagaaataggaaaacctattaaaaatggataaatttccagacacaaccagactacccagattgaaccatgacgaaagccaaaacctgaacagaccaataacaaataatgggatgaaagtggtagtaaaaatctcccagcaaagaaaagcctgggacctgatgattcactgctgaattctagcaaacatttaaagaagaactaatacccaccttacccaaacgattccaaaaacagagaagaagggaatacttccaaactctttctacaaggctagtgtcaccctgataccaaaaccaaagatatatccaaaaaagaaaactacaggccaatatcactgatgaatattgatgcaaaaatcctcaacaaaatatgagctaactgaattccacaacgcattaaagttggggtgcagtgttgcaggttcactcaacccttcccgttttcctctctgtgtgtgtctcctttgccgtgttccatggtggcagcggcggtggcagtgttggtgcatgggcctcccagggcaaggggaaagtgagtatgcccttttcttgcctcctgccaggcgtctgcagcctggcacaagctctggccaggtctccaagcaagggagctggagatgttcttttccaatttctggattggtaacttgaggcaaattctgggcactagagtcagaacttagacgagactgaatcaggggagtctggggtcctgagaggcagaggcctgaaaccgtctagagccatgtggggagctgggtgtgtattcaggccagttgcttttctctgtgcctcaatgttccaggtacaccttggaggggctgagatcctagggattcctggagcctggctgcatggcctggccaccctgatgcccttgtgttctccatgacaggacagcaaggccgaggagaatggctccgacagcttcatgcactccatggacccacagctggagcggcaaatggaaaccacgcagaacctggtggactcctacgcggccattgtcaacaagaccgtgtgggacctcatggttggtgtcacgcccaagaccatcatgcacgtcatgatcaacaacaggcatgcaccgcctcatgggagcagggggctcctgtggcattggggatgcaggtggccatgttggccagggggagatgctggccagccctatgggaccaggtccagggagggaggcacggtccagaccagatctgtctcatagaaatataacatggtactgaggacagtggcccatgcctgtaatcccagcactttgggtggccaaggcaggaggatagcttgagcccaggagttcgagaccagccttggcaacatagtgagacctggtctctacacaaatattttaaaaatagctgggcttggtgatggcacgtgcctatagtcctaactactcgacaggctgacatttgagggtcactttgagcccaagaggttgaggctgcagtgagcggtgatctcacccactgtactccagcctagcaacacagtgagatcctctctccaaaaattttatttaaaaaaactgagtagacaggtgtcctggtggcatgataggtcctgtgtcccctcccagatctgtgaccttggacaggtgacttttcctctggacctcagtgtccctatctgagtgagaaaagggcggtggggcggcagatctttgagtctaagcggtgtagaagccgcgtgtgcaaagccatactcagggctccaagtccagcacactgtcccagcacaggcatcaggccagcacatgcatcaggtcccaacctccttccctctttgccccctctcagaccaaggagttcatattatcagagttgctgtccaacctgtacttgcatgggaaccagaacacgctgatggaggagttggcagagcaggcacagtggcgagatgagatgctgcgcatgtaccacgtgctgaaggaggtgctcagcatcatcggtgacatcaacacaaccaccatcagcacgcacatgggggcccatggacaactcctggctgcaggtgcagagcgtccttgccagacgcaggtaccagggctggcccccatggccccaaggctccccagcccccatggctgagcctgggggctcttggaacaggctccgtgcccaagctggcagatgtgggtggtctctggagccgtcagggagctcgtggtttatggtgtaagggctgagagcttggagggggttgtgtgtggggctgtactctgaggtggccagaggcccaggaatgtcatcctgggcacgccatgccttttgtgctgtctgagccatgctgccagggtggggcatccagctcccagcctggatgccttggagtgctgacagccaaatccactgcagagcaggggtgatagggtcccacctcctctatctgtcggcaaaacagtggtgatctaggataaaacctcgagagtcccatacacacggtcaacccaaaacacacctcacaggtcaggtaggggcacacagcccccttccctccctcccaggtaccatcatagctgctagcatgtgactgaaggcagggtccctgggctccgctgaagcactaccaccagccagcaggctcacgcaccttggcttgttgctcctagaggttggccctgctattcagccgaggggagcacagtgcctgctggcccagctgagctctgcccagcaagcccacccacctcccttgccatggtctccctcttctttccctgggaggaaggacccagcctcacctatgggacctgcaatctccaacaagctgaggctcccctcttagacttataagtttatagccagtggcatccggctgcctgcccaccctgcctcccccagggtcccttcagagggtcctgagcttcctgaccacccagagggggctccggcgatcactccaaccatccatcccatttagcttcatcatccttgttcgagcgatgttccttctgtcaggcctggtggctgttacgttgggctccccaaggtgagaggtggccctggaccagttggttggaagacaggttggaagacgacttggaagacaagttggttggtgaccagagaagagggaagcccaaaggggccgagcgttggtctgacctgtgggtacactgcctgggtgcaatggaagaggccagcatgtgtggggtggggagggccgccacagtccccaggcactacctgtgaagctccggctcctccctccatcttcctcccctttcccttccagcccctcttttccaggaaccttgccacagccgcacctgcgccctcccctccctggccctcccacagctgctgtggcacacctgtgctccgcactggcctcaccagctctctgctcccttttgtctctcctcttttctctctgctttctctccaactgccagccgatcgggtcacgcaagtccatcccatcctgagagccccacgccccccttcgacctctaaacagatccctcctcttctcggaggcctccctttccaagcctgcctgggcggctgttctgtgacttggcagtggctcccccagccccaaagccagcccccttcatctgtgacttagtctgttgtagtggtgagctgacacgtccaggtgtgactgttgtgaaacttgtgcccccctctgtggtatgccctcgcattgttctataaatatctataaatacccatacacacacacacacacacacacacacacacacccctacacctacatgtggccaacggcctcgcctctagtgctgggaatcagtcaccgtgctgtcctcttggagtcttgtggcccaacaagagaaagctgtcccgacattgcccctccaaagtgcaagacctccggtgagtctccctgtcacgcctggcctatggagagtcagcccccgccatccctcccgccccccaccaagcatgggagtgctgtgcaggcagctgtgtggcctgacactctctaccagtcctgctgtcccttggctgagaatcaaacccatttctggatgacggggaagtgtgtcctctgctggctgtgttctctgtggagctcaggggaggggaaaggccaagccatttctagggtgctgtttggaggggtgaaaaggccataccctttccaagggacacttttcctggaaagcccctggaacttagctggctcttgtcctgtgaagccggctctggccaccagggggcagggccacgaactcagcctgaagggagcctgccgggcagccggcactctggagggacagagagaacaggccaccaggtgcagacaggggagggaggaaggggacagaagggaagacgcctggggtgggtggaagtcagtgcccttaggtgctggtacctgtcttcccggccaccgctacaacaggcttccgagcctgttggctgtcagggctggactgcgccccataggcaccatggcagtccccgtggaatcccccaggcgccactaggcagcatacaggtaacacgcctggaaggtccctaacagcctagctggacacactcaagacactctggggctcctcatttggtggcacaaactccaggacccagtgagtgaaatgggaacacaccaggtcgggcagtatggctaaatccatatattccaaaataaaaagcaaaataaacaggagtcgcatcaccagggagccacaaccccatccccgcctccttcctctgtcttatgctagcaataaataagtttcgcagccacaaataattattacaacctcctccccatgtgccggctccaacctcagctaggtatgatacaggggcggccctaccctctggaatatacaaaaccttacacagacacaatatgtacaccggggaacgggggccaccccagcagcccgtgccctcgcctggtccacagttagccccactgtcctgcctctctgaataagaaggtgggagcccccctgagggaaaagttgctatggtgagagtaaggggggcatcaggcctcctccaaacaaaccaactccaccagcctctggctcttaaataacaatcatcatcatccagaaatttagggactcagccctgatcgagggggcaaagggtctgtttgtctttccccattagacagaggtcttgtcctgctaccctaattgtaaaggggtgcctgggaaggggtggtagggacatggtggcggtggagactccggccccacttctccaggctttgctgacaggggcctgcttttaatttttatttttattccatgacttttttaaatcccataacttctttttcataactttgttttggtaacttttcagaaaacgtttttctacttttttgccacaacagttttacattttttatccaataactttttcaccccataacttttttaatcccataccttttttattttgtgttcttttaataaacacttgcatagttatactacaattttgtgaaaatgaaacagattatctcatgccaagcatgcccagtatttgcacagtatcaatacctttaatactataattttcaagatgcgcaaaataaaattttaaggcaaaaacagcactttgcaacaatttaataatttatcacattacagtagcatcacaccagcagtcaataatgccactttaggcaaaagtctttcagtatttctgttacacattctgttaacaagaacccatacattggtaaaattcattctaagaaaacttggcaaacaaagctttggactggaattggcatttctttctctacttttccttcccaccatttctttcttttaaactacagtattcatattttaaaatgttttaacttatttcagaacataaagatagcagttacacttttaaatatttatattattttaaaatgactctttaggatacagttttaaacccacgggctagaaatcataccactattagccacattatttggtctaatattttttctttattattctgaaactgggtttatctaatacattgataaattcatacaattcggaagagtcagttgaagtcacaaggacccaatatctgccctctttcagtgaatgccggcaaatctgttattccattggcaaaatcgtattgctgctctcctgttaatctcctatttataaaaggatcatgaggctgccaagtgctaaaaatggagatggtctagtaactagaaaactccccaccccagggagcacacatacatatctccctacaacctaataatgtgatgtgttttggaacacagacattagaacttcatgaagttttaactgttgattctttcccaagcatcatcaagttatgatttaggcaatgtatgattgaaatgcattcactcatcacgcataggcacaatcacagaaatattgcacaaaatatgtccctgactgaaactgagaggtacaaaaacatatttcactcttcgtaaagaagtttgtgaggaaatacaactctgcgatcgtatagacatgtttcctgataatacattgacattcacaaacagtagattgcagcacagtgtgtaaacattttcagttgcataaacttctccttgattttcaaagataatataatactgtctactaaaattcctttttgtttcaactaagtactctcacatatattagtttataataatgtttgttattattttctaaagtgttttccactcaaggaaaagaagtaaattcctatgtcagagtaaccgaggtggttgaagaataggtattagccagagaggtctagatagtaaaatcaaacttcaagcctcaaagaagctccatgaacagagaggaatgccaggtgtcacacagctttccttcactctaattcattcttgactagagcctgtatgcctgtttcagagacatttaaactcttaaaggatgtcttatgatctttactaaatacattaagaagaatgccaaccagcgccctttcgtgtactgggacaggtagtcatgtgattaaaacagggaacacgaactctgactttaaaatgtattgtagatacaaatgctctaagctaggaaaggttttccacatccacagccaacgatggcagcctttcattcctcggaaataagccatttttaggtcactgaaaaagagtgcaactgctgcagctcacgatgcaatatcttcatgagcccagagcacatacaaatccaaagggaactgccacagtacagtgctcattcttggcaccggaacagatgaaacacactgtatcctgcacatacctgccagagcaggccactttcctcttctgcgagatttagaaagctcccccaaaaggttatcactcccatcaccaatacacagaaaatggaggaaaggctgtttccagttctcggcctttaaacagctctaagtgtcagtactcatagtggcatattacaaagtaataaacagtgcacacttgagggcaaaccgcatattgagctatggaagagctcactgtgattaagatgagatcaaacatcatagcagaacattagcaaattttatctgaattctgtaatgaacatccatgctgcaataacattaaaaaagcacgggagcctattccaaaccagcgagaacagttttgtgcaaagagtgggtctttgtgtgtttgaactcccaccacgtaagggcaaactcgatatgcatgctaatgacctacaattatgaaatgaaaaaagaaaaatgctaaaggatgccagagtgaacatcagtgagaggcacagagacccactctcttttaactttttacaaataaacttaaactataaattagaaacacaaataatcatgagtagctctaacattcaaatgaagtaaatgaattgtgtaggagattaaccccataactttgtttcgtttttaaaaatttcttgagcagctctttgatgatggtggtgtttatctccttcttctcggcagccaagcccagcaaaagcatggcacacagcagttgctgcccaagcctgggtgctcctggtggtcctgcatctcaccaaggagctgcaggactggctgtgcagtagggttgtcctgggaagaaccctccctggcttctccttgtgcaggctccacgctgttggtgaggctcgcctcacaaagatctttggagagagagaggcggggatctgagtggagtgctagccgccccccgctcctgcctgctcaccccgcctgggggctctactcaccaccatgcttgtcggcagccccgagctcctggggggctggggctcctggactgggttcagcagcagggttccgggcagcggccaggaatttgccgtgcccctcgctgtagctgccacaagccgcaacaccatctcctgcagctccagcagcttcacctgaagggacgggtgctcagctgtcaggccgctgctggcgcccaccctcatgcccaccccacccacacccccaccccacccccacccccacagggatgttgcacaccctaccttcctctcctccttgtcctgggccagcctgatgatggcctcctcccggtgacgcatctttggcactgtcccctggctctgttagaaggcgatgtactttcctgcgggaggacagggctcagacgctggggcccctcccatagccctgcagctccccctgccgtgccctggcctcccactcac

SEQ ID NO: 1152 - DNA, 146303 bp, Homo sapiens; identical to SEQ ID NO: 1151

SEQ ID NO: 1153 - DNA, 112501 bp, Homo sapiens
aaggagtacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttcatctcatccccctattctacaacatcacagattcaaaatggctcattagtgtctagaaaacaactggttcagtcgtcaactgaaaagtgctctttccccattattaaaccattttctccttagaggagatctttttgattgcccttagcttcaaatatcttttgctagtgtcccatcaaaagtggagatataaaagagagcaccaaagggtgtgtggtggttcatgtatgggacctgtagttgacttacagtcagcatcagcaaaaataatattaggacttttgcctccaagttccagagttactctcttcaaattacttcttccagctgcttcttggataagctttccaacctgaaagaagggaaatggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcgtgatggaaggactaaggaaaagggagttaaatctggaatcttaatcactgaaagatttctctaaagacaactggcaagaaaaatgtaactggagatttcaatcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccagacagttgagaatctctctttttgtgcaatcttgtaaatgccgtttatcttgaatccaagtaaacaagaggctgagttaggagaaagcacttgccaatgagtagactcacattggcaatgaaaatgaaagtgtcataatggaagcaaagatccaccacttagagcccctgctcaaggcagaactctacctcagtgatggggaatgctgttgggagacagcctgcagctgtcacctccttcagggtccacctcagctgaaaagagctcccttgcccaaggagaagccctcttccaagtggcccatatccacccactggtggtggcagggtttgtataaaggtcctaccctttcagcccagcacaggactgggctctgagggacggtatatactccatgatgacccaagtgactggcagaggctgtgtcaggcctgtgttgcagttccacttccccagggccactccccttcagcagggatccctagtaaaatcctgcaagctaaactccaactccgtgaatgctccctgggaacctaacctacaacaggatgcgactccactggagagcacatatcactttatggaaaatgcagagcagagccgccatatagtccatagaggcaatttggtcttgttgagatgaaaaaatgttatttgttcctgaaattttcctgaaaattaaatattttaaaagcgggggaagagaaacgctacattcactttcaactcctgcagtcccttgttgagatcctccagtgggactaacgacttcgcaggcagcggagaaccccagctaggagaaaaggctctggagccagactgcctggattttttttttttttttttaaccagttctgtcacttcgtaactgtttgagcctaggaaatttatttactatctgagccttggatcctcctctgtagggggggataaaaatactatgtacttcagaattatattttgaggattaagtggtgtaccatatatgacacttagaacccagcctggcacacagtaagtgtgcagacatgctaaccatgagcaagtgtgagaagctggggcctcccttttcttccacgttcaatggacagaaatgggggtgatgtaaaggagacagctggaccttccaaagcaggtctcccgtagatctcccaaactgcctgtgctgttaactccttcagaaaaacaccggggaaactccaacttcccctcagtctccaatatcactcattaactgtaactctgcctcctcctaaaaaagattttgaaaatgtatccccatcctgagaaaagctaaccttagggggaaaaagtgatgtctctcaaagatgcagaactagagtttcttgatttgctgaaaacatgacttaccaaggtgttggaaaatgctaacacctggccctgaagtttgatgggtgagctgtggccaacctgccagactgcccttcccccgcccttgccattttgtgtctcttccacttccacgcaaaggcctcaggaagacctggtctcagtaaaggccctgttctcacacagacatggtcctctgagaagaaaacaggcaaacacaaagggaaggagaatctggccctctcttctgggaatgctgaaaattatgactggtaagggggaactcacaccgaagggcaactggggaaacagcaatcctctgacttactgccagcactcagggaggggtgttccctgaggatgctgtcatctgtgactgtctgctcttctgagaatgtcattgtgcttgctcgctccactctgggggaatccaaattaactgatgtggactcattttaaagtcaaggaagataaacaggtaactgctttctcaacaagacaattactggaattcacaaacatattattcattaaattaaaccagtatttattgagtagtctatgttagatacttacaagcattatgtcatttaagcctctcaaaaaaccctacacagtaggttttatctcattttagagatgagctaaatgagttagaagttagtgaatgtcaccaggctccccagctggttcatgacagaacctgttggactatctgcaggctgatgccagagcccaggcctgggattactccctctccttctcccttccttcctcccagcattctgtcatttttctgttctcttttctacatttactgagcactaatgtgtgccacataccatcaaaatcttatccctgcactccaagctgatttcaaagtaggtaggaatatcacctcttctagacaaaaataatgttcataaatcatcagttacaaaacttagattctgccttcaggattatattcaagaaacaagcaaaagccaggaaaaatcatgagttttacacatagtaagatgctgagtaaatatttggggttggcagacactgctggcccagctggcattacatttctgttagccctactccctgatattcatcagaccattctagaggttgatatttttttgccactagaaatgtcggccagtgattattttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaacgggatgtgttaggctatgggagaaccacttccatctggagtggcctcaggacaggacactcctaaacagccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtactttgttataacccacaggtttccgaagtcaaagcctgtgggattagaaagtataagaatgaacgaattacgcatacaacaaaggcctaggattgaccaatctttctaaaatggaaaagtttaagtgtggttcctcagggatactgtccctcctgacatgaccagaaggtgggagtgcacggcaagataaaggaggctgcaagggtgcacacgttttccaagtggttaaaagtcaagttaatagagctgtacttgatgataccaagtcctattctgatgaaattggtaatttgtaagataaaacaggtaaacatacagtttgagaaattaaatcctgtatatgatgtaatatagattaaataggataaaggcacagagatcaaatttttagttcgccatcaccttttcttccaagcagaaaagattttacaacgtactcgtgtgatacctcctgccccattgctgacaacctggctaattataaccatatttaggcttatggacgacagtttggcccacaggagtcagaagacctggtactacaaactctggcttctaatgaatcttcaatttgggaaagccacttctcctcctgggtctcagcttctgcatctgtagaatgaaggcacaggccaagcaacaaatctctcccttagtactccagttaattgaaggagttaaaaaagacagacaggactcctggggaccctgctcattctgagagtctgttcacaattcttgtgtttttcttgccttatgaagcagaagtagcttgttacaagtagaacaccacagctgcactgaatgatggaaaaacctcatctttttttagtttccctgcccagagctccttatgaaagagtaagtgatagtgttcctatcatgcagttccttaactttgcactccctgcagagcctctcagctctgtgtaccccaaacatgcaagggcagtgaactgggggctcctccacacataatgaaactgggctaattctcagcaggaatgctggcacagttcaactctgactcccatcctcgtttgaataggcctcaagattgatatcaggagtatccctggaagagccacagtgtactggaatcatgttcacagcaatgcggcaatgtaggggaaagcaatttggggctttgcaagaaaaataatttgttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagttaaagatgcctgtgtcttgtaatatcttttcataaatcccaaacagatttactctctgcttcttccctcttctcctttcttaattttcattgttatgcttcctggttccaactgtgttgggaatagaaatgccaaaaatatggggattgggtgtttgtctttctgaagtacccagaaataacaggccaaattaatctgtccagatttgcaccagaaacaaacaggaccaaggcatctaagcagttcctttaagtggtaacagcagtttaaacctttatctgtgaaattcagattatgaaggccagtataaccactatgtttccagccttctgtcccaccattcccaccaccactcacccacgactctaggcacacaaaaccacttgccctttctggaacatgcctgtgtgtctttgcataagctgctccatctacctgcagtgccttttcaccccttgcttacttgataaactcatttttacagagataactctttcacctcctctgagaaggtagctttccttccctaccctccctacagggtttggtgttccttctctgatctcacagtgctatgtacgtaactctcacattgtgcttgtttaatagctgtctccccgactacaatgactgacttttaaaaaaatatgcatatgtacacagattttaagacagggtctcactctcttgccaaggttgaactgtagtagtatgattatggctcactgcatccttgaaattctgagttcaagcaatcctcccaactcagcctgagtagctgggactacaggcacttgccatcatgcctggctaattaaaaaaaaaaattggtacagacagggtctcactatgttgaccaggtggtctcaaactcttggcctcaaggggtcctcctgcctaggccttgaaagcactgggatgacaggcctgagccaccagggcccagacaaactttcaataatttgttaagtcaataagccagaatacgaaaattgcttgagagcagtggtgtgatcacggctcactgcatccttcaactccttggcccaagcaatcccgccattcagccccttgaataactggggctacaggtgcacactaccaagcctggctaatttattttttatttttttttgcaaagactggggcttgccatcttgcccaggctggttttgaactcctgggctcacacgatcttctggtcttgatctcccaaagtgctagaattatgggcgtgagccatcgtgtccagctaatgttattgttgattgagcacctattctgtctacttgttttcacaaacattattttatttaatcttcatgacaaaactgggaggcaggaattattattctattttataattggaaaaaaagacaagacaagactcacagaggtcaagaaatgacttgcaaacaggcacccactgagtggcagagccaggactggtctcagaatgtgcacaccaagcctcaggctcttctccctcctcttctccagaccttctcctgggaattggttcccctttgctgtgagtagcattttgacagttaaatgcatcatctaccactaacatgttcaactgccttgtacacttagccatccttttgttacataagactctatttcaggtaagctttaaaaatcaaggttttgattgtcttggtctgctttgataggaaaaagcatggagtagtcaagccaaaagtactctatgtcccattaactaggtgagctaaagggatcaacaccttaggacctgctcaaactcagcctgagttttggggagaaagctaactgcagaatctttgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacctcccctaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagcaaaatgcatattgttttcctgtactttattgaagttgtttattgacttgtgtttataagagctcttttatatttattaaatatttacatgcactgcttatgtatttagctgcataaggagaaattaatcccatctttaatctgagtaaagttgttggctttctaaaggccttttgctttagtaaaatggaaagcagccacctcaaataagcttcttcttgttaactgttccagacactttgtaatgtaccaataggtcccatctccctaaggtaatcacagcagaagccatgttctaatccatatttaagtgacatgttcactctggaagaatctatacaacttctcaggtagcctgcaaagttagaataaatggataaagaagtaaataactacagctgaaaaggggtttggggattatgtgatcgtttgatttgcctgtgaaaattctccatccaccactactaatatggaaattacaaattggcttttatattctagacaaatgccgctctcccttaagtcctttagtgtctgccaataatgtcattccagagaagaaactaagagataacctagaagtcacgggattagttcccctccaaatgaatgtaagcctctctacagagagagaagaatcaaatgtagattctgttagaaagtttagctgaaaacttgctctattcacactgtaataggctacttaatattttaactattcctaaaagcaaaacaattcaaagacccaccttccaccctattctctttcccaaattctcccttctctctctctctctcagttccctattgaatatctcagtattggaagattgcataggtagttgttaatgttttatttgtgaagataaaaaaattcctgttgttataaagctataatagtcaaaataatgtgatacttgcgatgcaacagtcacacagattactgaaacagaacagagagtacagaaatagacccatatagggccgggcgcagtggctcatgcctgtaactttgggaggccaaggctggtggatcacgtggtcaggagatcaagaccatcctggctaacatggtgaaaccccatctctactaaaaatacaaaacattagctgggcaaggtggcgggcgcctgtagttccagctacttgggaggctgaggcaggagaatggcataaacccgggaggcagagcttgcagtgagccaagatcgcgccactgcactccagcctgggtgacagagcgagactccatctcaaaaaaaaaaaaaaaaaaaaagaaagaaatagacccatataaatatggaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcataggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacatcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcaccagagaagatatgctgtggcaaatacacaaatgaaaagacactcaatggtagagaattggaaattaaaaccacattgagacaatgctatatacctatttgaatggctaaaatgtaaaagactaaccacatcaaatgttggtggggatgtaaaggagttcaaagtcttaaacattgctggtaggaatgtaagatggtataaccgatttggaaaacagtttggcagtttcctgccctaccacacaatccagccattccattcctaggtatttacctaagagaaaaggacatacatgtccatacaaatatttgtacatgaatgttcatagaagcttttattagtcccaaactgaaaacaatccaaatgttcatcagtggctgaatggataaacaaacatacaacaaatggataaatccaaatgttcatcattggctgaatggctattaaacctgatacaggttgaacatcccttatcaaaatgtgtagaaccagaagtgttttggatttgggatattttttcagattttggaatatttgcattatacttaccagttgagcaccccgatctggaaatccaaaatccaaaatgctccaatgagcctttcctttgagcatgatgttggtgctcaaaatgtttcaagttttgggggcattccagatttcagattttttgaattcagaatagttaaactatatacccataaatggactactacttggcaataaaaaagaacgaattgatatgcacgacatagacagatctcaaaataactgtgctgagtaaaaacagctagacaaaagagtatatactatatgttgccatttatataaaattctagaaaatgcagataatctatagtgccagaaagcctgggaatgtgggggtgggggtggagagagagataagacagagagattacaaaggggcactaggaaacatgtgagggtgagggacatattcattgtgaactctactgatggtttcacaggtagatggatacacatggccaagacttatcaaattgtacactttaaataagtgaaatctattgtatatcaattatactacaataaagctgttaataaaggtacattaaacaaaaatattacttcattacagaaattatgccatatatctctttgttgtcctttgcagactactggcagtagttggtctttgcacaactactgaaaaacaaaggaaactacgtaacatttttctgcaaagaaatttctccctacaccagaattccattctggcaaactcagtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcatcctcattgttcaactctcacttatgaatgagaacatatggtgtttggttttctgtttgtgttagtttgctgagaatgatggtttccagcttcatccaggtccctgtaaaggacatgaactcatccttttttatggctgcatggtattccatggtgtatatgtgccacattttctttatccagtctatcatcgatgggcatctgggttggttccaagtccttgctattgtgaatagtgctgcaataaacatacaagtgcatgtgtctttatggaagaatgacttataatcctttgggtatatacccagtaatgcgattgttgggtcaaatggtatttctagttctagatccttgaggaattgccaccatcttccacaatggttgaactaatttatactcccatcaacagtgtaaaagcattcctatttctccaaatcctctccagcatctgttgtttcctgactttttaatgatcgccattctaactggtgtgagatggtatctcactgtggttttgatttgcatttctctagtgaccagtaatgatgagctttttttcatgtttaacggccacgtcttcttttgcgaagtgtgtgttcatatcctttgcccacttttcgatgtttttttttttttcttgtaaacttgtttaagttccttgtagagtctggatattagccctttgtcagatgagtagattgcaaaaactttgtcccactctgtaggttgcctgttcactctgatgatagtttcttttgctgtgcacaagcggtttagtttaattagatcccgtttgtcaattttggccattgcctttggtgttctagtcatgaagtccttgcccatgcctatgtcctgaatggtattgcctaggtttttgtctaggatttttatggttttagttcttacgtttaagtctttaatccatctttagttaatttttgtataaggtgtaagtaaggggtccagttactgttttctggatatggctagccagttttcccaattgcttggattttgttaggtttgtcaaagatcagatggttgtagatgtatggtgttatttctgaggcctctgttctgttccattggtctatgtatatctgtgtttgtaccagtaccatgctgtttttgttactgtaaccttgtagtaaagtttgaagttgggtagcatgatgcctccagctttgttctttttgcttaggactgtcttggctatacagggtcttttttgattccatatgaaatttaaagtcgttttttctaattctatgaagaaagtcaatggtagcttgatcgggatagcattgaatttataaattactttgggcagtatggccatttttgtgataccatgagtatggaatgtttttccatttattgtgtcctctcatttccttgaggagtggtttatagttctccttgaagaggtccttccaatctcttctaagttttattcctgagtattttattctctttatagtcattgtgaatgggagttcactcatgacttggttgtttgtctattattggtgtataggaatacttgtgatttttgcaattgattgtgtatcctgagactttactcaagttgcttatcagcttaaggagattttgggctgagactatggggttttctaaatatacaatcatgtcatctgcaaacagagacaatttgacttcctctcttcctaattgaataccctttatttctttcttttgcctgattgccctgaccagaacttccaatactatgctgaataggagtggtgagagagggcatccttttcttgtgccagttttcaaagggaatgcttccagcttttgtccattcagtacgatgttgcctgtgggtttgtcttaaatagctctaattgagatatggtccatcaatacctagtttattggatttttagcatgaaggggtattgaattttattgaaggacttttctgtatctgctgagataatcatgtggtttttgtcattggttccgtttgtgatatattacatttattgatctgcatatgttgaaccagccttgcatagcagggataaagccgactggattgtggtggataagattttttttttccttacagacagaggttttattgtgtttggtccacagtcatatttcacattatctcatggagcagggcccctgggtggggggtccctgtgcagtacttggaggggcatgtggccgggggagatggagcagtatagctggtcaggcccagaaggggagaagggctggggctccttaagacctactaaggggccgggcacggtggctcacgcctgtaatctcagcacttagggaggccaaggtgcgtggattacctgaggccaggagtttgagaccagcctggctaacatggtgaaacctcgtctctactaaaaatacaaaagtagccaagcatggtggcacatgtctgtaatcccagatacttggggggctgaggcaggagaatcccttgagctcaggaggtggaggtgcagtgagccaagatcatgccactgcactccagactgggcaacaactactaagaaaaaaaccctactgaggccacggtggtggtgtggggagttggggggattaggcccaaccactcagcatccacttccttgtacaggcctcactttccccactgggccctgaggcaggtctgaggtctgttggcctgagggtcctagggaaatccagccacttgggagcctgagatatttagcatcatagacaggccccctttcccaggggactcatttcccagcaccctctccactgtccccaccccattcctcaggaaaaaaaaatgtatttttcttttgttaatgcatcctgaaacttttgcgggtatagaaaccacaaactgatcggctgacaaaagtgggaagaggcaaggcaactggaaacctccgggtactggttccctccaagcccaggtctcttctccccggcacagctctgctggcagcctggacgtgccagcagggaccctcaccatacacatattgggatatggccttgaccccttctcctccacagcctggtggctcattcctgcgaaggaccaaggcaagggggaagaaagccctgctgcctgattccacgttgccactcacagaccctcggttgattggcagcactgaacaggttaagaaaaaaaagatgaaaacacagaaaaacccaaaaacccagaaagggagataatgtggggagagagtgtgctgggagcctcagtagccagcctcctcctggtagtaagggggatattcagggacctctcctgggcccaggcagttgccagcacccaagggagccccgtcagccactgtgcctggcaggcagtacttggggtcacatatatgctggcccaggccaaagacctggctactatggttggtaccctgggtgtagcccatctgcagggacatggaggaattaccacacttgtcggttcccagcttggtgtcacagatgtgctgccgcgtcccaggagctgtcatgctcacctggctggcacagttatttgtacccatctggaggccaatgatcgagtggtccatgggggggcaggatgtgattcttggggtcacacagatgcctcttcacgccatacacggtcatgcccaactggctggtacatttgttggtgcccatttgcagcccgatgacgcactggccagccttcatggcggcgtcactgaagttctgctcctgcttctctgagtatttgatgccaatgtccaccccgctctgcggcctcttagtcttgaccttccctgctagggcaaaaagagacacctgcatgtgcctcatgttcccactctcaaacaggttgttggccttgaacaggtccatggggttcatgtcatagctgactacagccttgatgaagttggagaggttttccagctggtgccacttctgcatggagtggttgatcttggggaatgaggccggctgcagcttgttcatgagtatgcataagataatcccgtccttcaggctcttctggaagtcaggctcaatggagatgcaggtgagtcccttgatccagctgtgaagctctgcctccttctgggggtcatatttgggcaggagccagttcttgacctcggctgacagcccatactagacgcctttgttgaactgcgtggaactcatggctggcaggctgcgggatggggccacacgggacaggggtggataagctttttgatgtgctgctggattgttcatcagggatattggcctgaaattttctgtttttgttgtgtctctgccaggttttggtatcaggatgatgctggcctcataaaatgagttagggaggagtccctctttttctattgtttggaattgtttcagaaggaatggtaccacctcttctttgtacctctgatagaattcagctgtgaatccgtctggtcctgggcttttctttttggtgggtaggctattaattattgcctcaatttcagagcctattgttggtctgttcagggattcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaatggaagaagacatgaaataacagactaaacaattcgccaaaagtcacacagcaggaaagctggaatttgatccatgatttgtggatcaaatccagtgcctcatctattataccacacttccccaagcattaattgtcccataaacttcattttaaaaataaatagaaaacaatgacagttaatatttactgacactttactaagaattagatccagtgctaaacactctagatatactagcttttcttagtccattcagtttagctataatgtcccagactggatacctaatagagaaaggaaattcatttcttacagttcgagaggctgggaagtccaaggttgagagacccacatgtggtgaacgacttcctgtggtgtcatcccatggtgaaagatggaagagcaagagacgacaagacagcacgagattcaatgtgcaatctcaagcccttttataatggcattaatctattaatgtgggttaacagattagtacccacctgaacacccctcactagtgcccatctctcaacactattgcattgtagattaaataacaaacacactctttctggggaacacattcaaatcatctttcatcctcacaatccatgaggtaggtacaatcatctctaatctacagctgggatatctgaggcctggaaagattaaataataacatgtaatgtgaatgaatccactcaagtataatagatgtttaagttgtctagttttctgatatgactgacatatttaatcttgattcctttagtatgatttgaagactatgttcaaaacttactgaaaaagtgatgatttcctttagttggtttagagagacgcaaactatagagttgtgatatactattctgtcaaactttcattttaagaaagcactgaggagtactttgttttcttttaagagactctaagtaaaggatgaagagaaattaactcaggctgaactacattaatgctgtaaaaatcctaaagtaacgttaaactttatgggttggtctttgttgataattagcttaatcagattgatcatttactgttcagcttgggaattatctttgcttatgacaagccatctgcatagttttgtagatggacattacttgccctcaatgtggttaagaataatataatctgaagtgtaaaaagatgattcatgggaaatcactgttgaggaaagcctagtattttctccagcttttacacactttggtaccccctgactattaactactctcactagaacactgaggctacatgtttagcagtcactgagcatgtcatgttcagtgttggctcacctaccaagagttaacgaccctaggaaatcagacacacactacccttctcaacatgtcccatctggtatgatttaggttcttagggatgtgttgtttgtttttattttcccatctctataaggtttttcacatcctattaaagagacttctaaggatagacactgaattcaaaaaaaatctgcagctctggtgtttaaatgactgttaaaagtacaactgcaggaatgacaacaaaactgcattcgctattgaaaggaaacagtgaaacctaatatcccatcctaccttccagcaaaatatgtatcgagcttttacaaagtgctgattctttaatatctggcataggaaatgatgttgagaataaatgataccactatttgttgattatctgccaatatcaaataacacattgtgagtccctgaggactcacgagggtcctcacagctagcattcctttcctcgaatttctttttgtattttggttcccataaaactacagttccattttctccaaagagattaatgttaagagaaaaggaagacagccttaaattcttgccagttgtgactattaacaactgtggaattaagatggagaattatctttttcttaaaatacttttatctttgaataaagtagcttttcattcaaatgtaaatatcttcaactgatgacacttctcctagatacagatacatttgaaaattatattaaatgacagaactttagttttgtccttgatcttatcatcttgaaaatcatgacatttttaggtaatgatgcagagaattctcttctctccatgctcccataacacaccacactctaatagttacatattcacagattatctcttgggctagactgaatcacataaaacaccacctttgcctctccaagatctataagtgcttgataaatgtttgtggaattgactggaaacaacttaagttttaaattttcatgtcctatatcagacagtgtcaaatggaaaccctgtattgtaacaaatggaatttaaagaggctaaagatgcaattttgaagtgaattttaggaaaaaacggagttacaatgtgtctatgacctaagcatgctgcactgagaaattatccttcctaagtacctccattaatatgtcattccgaattttaatggctctcccctatgggagggtgtatagtcccttagcctgggaggcagtgtaccactgtaatatggaatataggccctgggtgtgactctcagccctacaactaactagcatgtaaccctgggcaggtaatgtaacccctcttagccacactttgctcaatgctgtagggttgctgtaataatgtattcaaagcatttagcaggtacttgacacaaagtaagtgctaaatcaatgttggctattaatatccaaaatgtaaagcctttaatactttgtaaaattaattgatttttcacagcttgagatataactcatataccataaaatccactcttttgatgtgtacaattcagtggattttagtatattaacagagttgtgcatccatcacaaccattacttctatctgaggacataaataccccaaaaagatacttcatattccatcagcagtcactttccattctcccagtcctttgcaaccactaatcaactttctgtttatagatttgcctattctggatatttcatacagtcacatgatacagtcttttgtaactggattctttcatttggtatagtgttttcaaggctcattcaggctgcagcatgtataaatacctcactcctttttatgggtgaacagtattccattgtatggatagaccactttttgttaatccgcttatcatttaatggacatttgagttgtttccactttttggcaattaggaataatactgctgtgaacatttttgtacatgtttctgtgtggtattagattttgtcacgtttcttctgtgatgatcacctggtttttgtcctttattccattactatggagtattacattgatttttttacatatataaaaccaatcttgcattcctgggataaatcccacttggtcatggtatataatcatttttatatatttctggattttgtttgctactattttgtcgaggatttttccatctatactcataagatgttggtatatagttttcttgtgatatctttgtctgtggtatcttctacatgttggccacaattttttgacccagaattatttccaatgccttgatgtgcatattatttcccagttcatctgactcccaacgtttctccccagtcccttcccaattccgttattccactaagactttgtgttctcctgcttcgagttgttgactaacactgccctttcttcccaattcactctacttatctatatcctacagaccctcaaatccctctttctcttgaaaccttgatagaccacccaacccctagagctctctcccttcttgagatgctgatgtcatattacaaactaacatttgcttactgcttaaaatttcccaaactcatattgcatttaattcccatgaccctgagaaacaggtatgtatgctattattaaaccaattttgtacaaaaccaagtggctggtccataattatatagctatgaagtaaaaaatagtaaaccctatgcttatggtggcattttaaagcaggggagggttctactgatacctcaccttctagctctgagattaagtttttatttaccaaattcagtctttcctccttcatgtagcaacaaatatttactatgtatgtttactatacataagatactatttgaggtactgagaaggcctaagggatagactccaaagagaatgtcctccccacaaatcttcatatatgaccagaaactgccatcttttgaaagtaaaacttataaaaatcaagactaaactgataagcaaatcagctcaaagatgaaaaaggagttacttatgagagtaaagtactgcttaaatattcaatattaattaattaaatcaagggcttttccaaatccagtatgtccttatggttgtattcctaatactttggtttgaccaactgaagtaaataaaatagtaacctcattaactgtaaaggtgatctgcatgaaacctaaagaaaatcaaacaatatcaaaattaatcaaaaggtgccagagagacttctgcttctaattgtaatggagtaaccgacactggacttgttttaccattataaacaactagaaaagtatatgaaattgttttattcaaacattggatatcaggcagtatgggactatgaatctagagaaaaggaaatccttttgtgcctaaactttctagattgcagtatggtatgaggagaccaaagcagaatatgatggtctgaattctgaccagacagataagaaagatcttgttgaacactggggacattcaacagaaacctcagaaggatttcagcttattaataagaataaactagtcttaacaaagcttaaaggtaagttccaaaagagacaagctgaacctcaagtaacttaactaccttttaggaaaaaaaaagtttgacattctttaaagaaaaacaacaaaatctctaagttcagcaatataatggtcacaatgtccagtatcctttcaaaattaacagaaaagccaaaaaaaaaaaaaaaaaaaaaaggacccataaacaggaaaaactccagtcaaattcagagacgacagagaagttaaaagtaacagacaaggatttcattattatattattattattattagatggagtctcactcccgtcgcccaggctggagtgcggtggtgtgatcttggctcactgcaacctctgcctcctgggttcaaggaattctcctgcctcaacctcctgagtagctgagactacaggtgtgcaacaccacgcctggctagagatagagtttcactatgttggccgggttggtctcggattcctgacctcaggtgatccacctgcctcagcctcccagagtactaggattccaggtgtgggccaccacgcccggccacagacaaggattgtaaaatagatgtctacacaaatttaaaggaataaaggggtgtagcgaggaagaaaatataagatatttaaaaaatcatggaatttctagaacttaacaaaatctctgaagcagattaagcattacagaagaatatacgaacgtcaaagatgacaatgaaagttacctagccggaagcacaaaggaaaaaaatgctggaaataaaagagtcccagtgacccatgggataatgacaaatgacctaacatatctgtaaacagaaggcggaagtagaaagcaaaaaaaaaagatttgaaaaaataatggtcaaaatgtttcccagtttgatgaaaactataaactcacagatatacagaaattttaacgaaccaacaaaatacacaaaagtacatcacaatcaaattgctgaaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaacacaaactgtcacattagaattttatatccagaaaaaaaagttagttattaaaaagtgaagacaggccgggtacagtggctcatgcctgtaatcccagcactttgggaggccgaggcgggcggatcacgaggtcacgagatccagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacgctacaagaaacgttaaagatcgttacagataaggaaaattatgccagaaggaaatgggcctacaacacaaacaaggaaggaggccaggaatagcaagtatgtgagtaaacagacaataattttgtattcttattcaaaaaacaaattttaaaacaaaaacagcagcaatgtattgtggggcatataacctatgtctaagtaaattatagggcaacaataacacaaaggatgagattggaacaatgctgctgtatggttaccacactgtatatgaagtaacataaagtatttaatggtagactgtgattgaggtgcatattgtacacactaaagcaaacactttaaaaagaggtacagctaataatgcaaaatagaataaaaagagtggtaaaattatctaactcaaccaaaagaaggcagacaaagagggaaaatatggacaaagagaaaacaaatcaaaatgggggattttagacccgaccatatcattaatacattgaatgttgaacaacaaaaatgaaaacacgaagagtagatattattccatttatatgaaattctagaataggcaaaaataattaaaaagaatcagtggttgccagaagccaagggtgttacctgcaaagaggcatgagaaatctttctaaggcatggaaacaatctacatcttgattcggatggttacacaggtgtatatacatggtacttaaatgggtgcattttattgtatgtaaattatacttcagtaaagtcatttaaaacgttaaaagatcttcagtggcaaaacagatttgaacccaagctgccttgcaataagcacttatggttttatggactcactatgtggcttcttgtctggcctgaaagaggagattccatttattcaatttaacttccactacctgatattgttatgtgccgggcgcagtggctcacacctgtaatcccagcattttgggaggctgaggctggtggatcatgaggtcaggagttcaagaccagcctagccaacatggtgaaaccccatctctacttaagataaaaaaaattagccaggcatggtggtgcgtgcctgtagtcccagctacgaatcacttgaacccgggaggcagcggtttcagggagccgagatcacgccattgcgctccagcctgggtgacagggcaagactccatctcaaaaatgttactcgtttttagactgaaatatcttggaagaaaacattaaatgctagaagttaatttatcaagaaattcctaacacctatatgatgacatcagtgatgaacattacaacaaataattgaagggatttttatcatattatatcatattcctagatgaggagtcaatatggtaaagatagcatttttcctcattttaatatggacatgtaatgttatgccaatcaaaattccaatcaaagttttttagagtaacataaggtacttagaaaatcggtttgaaatttcttctaaaagaataaatgggctttgaaaaaccaaataagagggtatgttgcctatattatagtaacacatcttataaaacctagtaattaaggcagtctggtactagtgaaagaacagaaaaaattatgagctctaaaacagaaatttcctgtatagtttggtgcaaaagtcattgcagtttttgccattaatcaaattacttttgctccaacctgtatatatggaaatgcatcatgtaatgttatattcaggcatcatgtaatgttatattcagatgagttgcaaaggggtagactgtttaataaattgttttgaagtaactaaacattcatttataaacaaacaaccctcacctttcattatacatgaaaataaattccaaccagattaaagatttaaacaacaaaaccataaaagtactgaaagaaaatattaagggccgtttgtataatcttaaaggggtttgttcaaaaatgacaggacggagcttgcagtgagccgagattgcgtcactgcagtccgcagtccagcctgggcgacagagcgagactccgtctcaaaaaaaaaaaaaaaaaaaaaatgacaggaaatccagaagctgtcagaaaaagactaaaggagaagactacatgagaatttaaaatctgcacatggcaaacaactgttttaaaaaaattaaaaagcaaagaacaaacatattttcaaattctacaacaaacaaaagattaacatacctaacctcttataaatgaaaccaatactctaaggccttcttggtaagcaagttgtaaatatgtttttattttgcaattccacttctagaaccatatccaactgagcatctaatatgtacacatatacgtgtgtgtatacgtatatacatatgtgtatacagttacagatttacaagtaaaatttttcttgggtctccaaaggtttttatttcagcagtctgtttaataggaaaaattagtggaaaaaccaccctcaagtgtacattaatacaggattaaatgatgatatactgatgcaagagtattctatgcagctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacgaaaattagccgggcatggtggtaggtgcctataatcccagctacttgggaggctgaggcaggagaatcgcttgaacctggggggcggaggttgctgtgagacaagattgtgccacttcaatccagcctgggcaaaagagtgaaactccatctcaaaaaaaaaaaaaaaaaaattacacaatagaagcctcttgactgactcaatcaggaccattggttggtcaacagaaaaaggttaaagcagaaaaagatactttaaatatttcatttctccagtcttttgatatagaaccaagaactttacttaatcatgggtccacctgtctcttctgattaaatcacacccctaaattattatttatgatttctggtttcaatttccttaaagtgaagtaaggacttaagaacatttgcaaagcaattccaggtgcccattctatctaggtttatatttttccccagtcttttacagttgtcttaaattgattgcatctttagtttttcttagcatctagcctttagcaaatattttcaaagcattaaacttcagaataattaataattccctttcatactcacattttggtttaaatatttcattaaactgcaaaattacaataacaaatacaactagaataaaatatttggaaacaaacaaggttaactcgacaaacacaaaactcagtaatctaactgaattaatattcaagtttattaataaatcttttattaaatttactactgtgagtcagtttaaccaagtataattaactctgtatcaactgataaaatgtttctagatctgtgctgtccaatacggtagcacgcatggcaatggagaacgtgaaatgtggctagtctgaagagatgtgctgtcaatgtaaaacacataccatatttcaaagaatgcatatgaaaaagaatgcaaaatattgtattaataacttatagtgattatatgttgcaatattttgaaaatactggattaaagttattaacattaatttcacgtattttttaatgtggctactagcttattttaaatgacaaatgttgctctcattctattagatagcactgttctagacctgcggacatcctttgttcaatgatgatatcatctgtgaggttctacttgaaacaatgaatcagactttcctatcatctgttacctggatcagagatatttgagtaacatttataaatcttcttaagctgacttgtgactctgtaacagggatctgtaaactatggcccatgggtcaaatataccctgctgttttggtatggcctacaagctaaaaccagtttttgcatgtttaaatgtctagaaacaataaaaagattagcatttgtaatccatacaaattatgtaaaaattccaatttccatgtctataaataaactttaattggcacatagccacactcaatattatctatgactgtttggtgatactatggcatggctgagtagttgcaacagagaccacgttgcctccaaaatttacatttactatctagccctatacagaaaaaaaatgtgctgagccctgctctatatcatctcttaaggttcatggggtatagtgagttgccaattgcacctaccggacctgtccaaacaatgagaagggaaagcttgtgtctccattcttatccttaccagagactagtttagatttccagcttcttaacttgcttctgccgctattcaacaaagtgtctagaaccccaccttctgggatagttcttacacagatggtatcacaaaaatgctcagatatctgtggggtcaaatggtccctgtgtgcctttgctttcacatccaccagtgttctatgacaccaatgttatcctttgtgggcttgggtactcactgcccttttggtgtctagcctatgggtactagttttattgtttttgtaacccctcaactcatttgcaagactgttcctcaagccctggtttttcagatacctacctcagtagaccctgtgaatgcaatcttgtctatgccaatgtgagaagctattgctgccccagccgttggcccatatcctggcaaaatattgatgaccccgggaggaaagccagcctaagaaaacagaacaggaggaaacgtggctgatgaaagctgatgcatcatgttaaatgagatatgctctagtaggctccagctgtaaggggagtcagaagcactcccgaagtccgtttctcttacctccttgatgagggctcccatgtagagtgcactgagtggtgtttgctctgctggcttaataactactgtattgccacagcacaaagctggagctattttccaggcaaacatcagcagggggaagttccactgaaaggaaaaaactcaaagttgatagatggaaaaacattcttccactactttgttttcaagctgtgacttctcatatttctcaaactagtcctcgacataaatcttgtccactacaaagtacagatgtttggattttcaattacttcattaagaatagaatagcactgaccttggaaatctctccttttctctctgaccaaccaattactatactccaactacccaccaaaagaaatcccactgtgaaaagggagttttgttacttctttgttttgttttgtcactgtttttatgttttttttaattaggctttggttccaataagttctcgtgtatgaaaacttttcttgcatctgagatttttacatcacaattttcacactggtatgaaagctcttcaacatggaaaaactagaaaattctaactgagttgtagttaagtcaatgtgtatttcaaggtagtactttttctttagatacatgcattgtcacaaacatatatgattacaaaaaataaactgcatatactgatgagtatgcaaaaattttcatttgtctcttttccactgtaaaagaagctattggagactacagtaacatttacatgagtagatgaggttggggtctaaaatggtttaaactgattttaaaaagatattaagcttgtattgtcataagctcaggcatgagcctcagtactatcaggtgtcattgataatttcattaagaaagaaaacagaaatcctcatcccctggcttcagcccttgaccacaatgtgtttctgcctgaagcatctcagctgccatccttcaaggcttctcactggctctggcaagcttgcaaaaatatacaagtgtcttgccttcaccaaacacccaatttcttttccccttagttgtttataaacttgggagtccaccgtaatgttttaattccatctacagtgtataaatcttaaagtgcagtaattgagccagagctggctgacaagcagctcttgtcctgtcagtgaagctgcagcgttgagagtctgggcaagggcaagaaaagtaagtttgaatcctacgaggaaggtgacagacctcatcccagagctggtccaagtaggatttccccagggcctttaagagcaagagaacttaaatcaaacctctcattttcccttggcattctctaataaatttcacagtaacctgggattcatcaattattcaaataaatattatatcttccccacatctttggttcccaatgccaaagattatcttgagttatactactgtactttgaaaaaagaaaacttcttgtctatactgtaagagtttactttgagcatccccttgaaatccctgccagaactattagctagtactgttaaaagctatggtcatgttttgtattgtaccaagggtgtgtatgagagacagacaggaacaaagggacaatgtttaatgttccaatccaaacactaagcactacatctatttctctttacaagacacataacagctcggcatggtttcaattatgactgtgacgttaactgtagtgctgtgtcttctgtagcatcttctatctagattcttgagaaaagaaacagtgggaaagaatgggattaaaagatcatataaaataatatgcctggaaggatggtgagtcacagttctaaaaaataaacaactataacaaagcattaattttccataagcagaatggacataataaccaagggcaggttattaatacactgtgctttgcttattttaatcatgagaattccatgacttgagaattcaactcctggtaacagagctgaaaccctattaacctgttcaaataagcatttgcagggaggctgttaaagatatgtcaacaacatgagctcagttttttttcctccagtaatggaaaacacacatcgctgaggaccatgttttatgtgtctttaagagaactgggtcaaatgaaaataaatacgaggtgcgaggaaatacactcactgggatgatctgtccacacactccaatgggttcatgtcttgtaaaggtaaaatagtctccatctgaaagaaaaaagcatggtcactcccagaaagtttagattaggaaaaaaaatgcaaagggagaactttggtggctgcaaaaaaaaaaaaaaaaaaacaaacagaaataaacttgaaaaaacatcctactcaaccgtgcatgaaagctggtagaagcctaacactggacatagcatatttctggatatatctctcagacacccaaatgcagtattgaggaaaggatctctaaggcaaaatgaatgacaaatttatgatacaagaagtcctcagggtggcagaggggacagctgaaaaatatgtaaaaattgaattttatgttaaatattaaaataacatgtagaacagttgtttgatttaaaaactgagtcaacaaacctttaaataactttctgaagtattaaaataaactaagtaaaatgctattgggcaaatttaaaatgctcggcaactggaaaaagtgaggagtaaaagatatatttcataactcaatccaggtgtcaaaatgtacttcctgggtagtgatgagacataggcatgtccagggctatttaaagaaggtaaaagtccatttctaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccctccactgccggcccttaggccacttcactgatacttgttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctctggatctctgatctctaccccctcttgccataattatctgtttcctcttttcaaggaacttttattcacatacaagtatttataggatccttttatcctctttttttttatacaaacgggatattattcagtcttttatattttgtttttccctcttttttttttttttcctgtaaagctaggacgtctttttagtggctgcaggttattccatgggctcaataaacaatgttactactgtaaaccctcctactaagggacatagaagtcactttcagtttaggctattataaataatgctgcaaagactatcattacaaacatatcttttcatatctgtggaatttcttgatctaagtgtatgtacatttcagattttcaaaaatattgccaaatcacccttcagaaaagtttaacaattcataatttcaacaacacgctatttttcctactctttaacactgaggtttttccaacattttcatttcagctaatctgatagctggaaaactgcaacttgttttgatttatgtttaatgatagagtgaacatcttttcatgcttatattgtttgctatttttctattgggttattctttttagccatttgaagagctctatggatattaaggaaattaggcctctgtcataatattgcaaagatttttccccaatctgctacttatctcttgactttgttttatgtatattttaaatggaagaaattcagaagtaggctggattctgcaactgtatgaaattaatttaaaatatctattacgagaaaaaatagcgaagatgttgcaactgtccataggatgacagtatgaagtctgagtaatactttaaacatcaaattaactatttagctttgtatgcagataactaaagaatcttctggatatcattctttacaagactacaaattaccatgcttcttcaatttgtaaatctctgaaaaggtttttcatgaggagcaacaccactgatcaataagctagagtttcatttacaagaaaatcttctgcaactgaactctctaagttggttaaggtgatgggttcaggtggatagtcacagaccacagaatcagagagtaatgtcaagaaagagtgcaaatggggctgaggaaaaaaattggaagatgaacagaagagtacacgtgtttattttagcagcacatgtaggaacctggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaagcatttagctacaggctaacacagggaaagagacagaatcttctagtccctacagttagtctaagtagcaaattaaaaaataaacgctatttttgtgcttgaactcttcccaaaagagcactgagttgaagggacaaagaaaggaggctactttcaataaaattcaacattccttcaggttaaaaactctcaataaagtagaggcattgatggaacatacctcaaaataattaagagtcatttatggcaaactcacagccaatatcatactgaacaggcaaaagatggaagcattccccttgaaaactagcacaagacaaggatgccctctttcaccactcctattcaacatagtattggaagttctggccagttctttctcaggcaagagaaagaaataaagggcattcaaataggaagagagaaagtaaaactgtctctttttgcagatgacatggtcctatatctagaaaaccccattgtctcagcacaaaagcttcttaagctgataagcaacttcaactaagtctcaggatacagaatcaatgtgcaaaaatcacaaccattcctatacaccaacaatagacaagcagagagctaaatcatgaataaactcccattcataattgatacaaacagaataaagtacctaagaaatacagctaataaaggaagtgaaggacctcttcaaggagaactaaaaaccactaatcagggaaatcagagaggatacaaacaaatggaaaaacattccatgctcatggataggaagaatcaataccatgaaaatggctataatgcccaaagtaatttaaaaattcaatgctattgtcattaaactaccactgacattcttcacagaattagaaaaaataactttaaatttcatatggaacctaaagagcccatatagccaagacaatcctaagcaaaaagaacaaagctggaggcatcatgctacctgacttcaaactatactacaaggctacagtaaccaaaacaacatggtactggtacaaaaacagacacacagaccaatggaacagaatagagaaatcagagataagaccacacatctacaaccatctgatcttcgacaaacctgacaaaaacaaacaatggggaaaggattccccatataataaatggtgctgggaaaactagctagcaatatgcagaaaattaaaactggaccccttctttacatcttatacaaaaattacctcaagatgaattaaagacttaagtgcaaaacccaaaactatgaaaactctacaagaaaatctaggcaataccattcaggacatgggcataggcaagattgcatgatgaaaacgtcaaaagcaatcgcaacaaaagcaaaaattgacaatttggatctaattaaacaaaagagcttctgcacagcaaaaggaactatcagagtgaacagcctacagaatgggagaaattttttgcaatctatgcatctgacaaaggtctactatccagaatctacaaggaatttaaacaaatttagaagaaaaaaataaccccattaaaaagtgggcaaaaggacatgaacagacacttctcaaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcagtcccattactgagtatatacccaaaggaatataaatcattctgttataaagatacatgcatgtgtatgttcattgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattgggggagctgaacacacatggacacaggaaggggaacaacagacattggcacctttctggggaggggtgggggaaggcagaatatcaagataaatagctaatgcatgctgggcttaatacctaggtgatgggttgacaggtgcagcaaaccaccatggcacacgtttacctgtgtaacaaacctgcacaggtaatccagaactaaaataaaataaagggccctagaccttgtaatctcactttgcattttcacgtggatggtgaaaggtgacacccctagtctgatctggggtgcctgacaaacacaagagctaagccttctgtgggcaccttcagctagggctaacagcaccccagaagtcattcacagctactaagaccctactatgaattccactgaacttctaaatcagggttaccgtaagaccagttataaaagccatcttcataatttttgccatttccaagtatcatttgctctgtcatttacttaatttctgttaaattaactcacctgttagaaatatgtaaatagctacctgttagccttaaggaaaatctaaaatctaaaataacaggtttcatgggctggtaatattttcttctaatattcttcaaaccaaggaattaaaattaaaaaagtttacttgcttactgtatagaatcatcttgaatgctaccagtgctacacgggatgctatatggtgattctcaaacttgaatgtacacactaagcaactggagatctcgtgaatatacagattctgaatcaacaggtctaggatgggaccagagagtctgcatttctacatgctctcagctgaggctcatgcttctgatccacagaccacactctgagtagcaagatcaggagtgtaaaggggagtccacgtgtattatgatgccctatggttgcttcacagttgtctgccttcatttttatttattttttgtctctctaataactctactaattttcctgaaaggagtatatagtgtaggagaatctgatctgtatttttaatacttcaaaattgttaaaaaaaaaaaaaaaaaaagaatgaaaacactattagaatttctgtagagccttataattttcacatccttatctcattttacactcaaaactctctgaaaaaaatagagcaactatcattatcagcatcttataaacagagaaaatatggcacagagaggttaagtccaaagtggcaccactggttgaggctcctggacttggatctgggtcttcagacttcaagttctttacccataaaaacatattaatgactcttgtgaggaaggtgttggatttaggtggataatcacaaatcacagaattagagtataatgtcaagaacaatcacaaatggggtaaaaataaacaaagaaaaaacctcaatgacaactcttttgtaatatgaacacagaacacatggaaacttgttataaagggaacactacagagaaacattccctggaataggtgagcccaggactaagcgcctctctccctttcatctaggcagagccaactcgaaatggagacagtgttaattctccctctcatctatacctcagatgatacataatgagtactcttctctgcctagaaaaaattaaagccaattttccatcttttatgctaacaatggtctctcagtatggcaggatgacttagaaggttgtttccttcatttctctagctttgtgctgtaagctcaacagcctgatataaaaacagtctccacccaaattcagatactccattgtagggtatgaatggttttggatcttcttagcaaatatgagggattacagagagtgctcagacttagcataaaaaaggactgcatttgatggggacaccagaaaatgttctggataccacattgtaggtcaataggtgagaacacaactatgatggagaaaactaaagaaaagatgagagatcaaaacaaatactaagtcacacgtgtaggacttttgatctctgtctcttttccctttcactcagaaggtaaaacgcagactaacagatattgctcttaaaggggggttattttaagacccagtcagaggtaacttttctgatgagttttgatacctgggtgcttttaatgaccaaatagtagtttacaacttatggaaaatataaaaatcttacaattaaatacttcattatgctatgaatttggctgagctgtgaattaaattttactgagtatgtgtgcattgagccatttctataattatattaagaacagcccttgctgctagagatcaacagtacaataagcctctactatatttgcgaactactgagccactgttctatgttttttgatggggccttatcaaactacacagaagagagagaaatatttaattagaaaaatttaattatttggataattcattcaaggcaaacattacttcttaaatcagatcttacagttgcctgaaagaaactgatggaatttttagtctcataaaaatatctcgcattggcacatcctatatattaatataaactagagtgagtatgactaagcaatctgtaaacagtgataaaatcagaagaatctgaaatgtgccagaaattgagaaatttgtcaaatatggaagtcaaatagcttccaattataacactaagaacactacaagaactgtagcaaattttatatacctagtaacaataaaaacgattttattcaatagcataaaaatctgtaacacaattcagtgaatgaaggtcatcttccaatccctaatttgtagacagaattacctttcaaggagctggcaattctttgatgaccacagtattaaaaaatgagatgattacattgaactattccattatgtatgtactgtagcagattcccatcatgttgacgttgaacagacctcacccaacattttataactatgatgataaactctataaatgcctatacaaacgctgaaactgtatgttagtatgaagtgtactgatgcttttcttcccagaagtctgctggtagtttctaagaagttagattatgttcctgagtctgtcatgaagatagcttagctctacgactattccactacatgatcgtaacaaaagttagtttacttctctggaccttctctgtaaaatcaggagatcagccttagggatccctgaggcccttttcagcttcaacctcttaaaaaggttccttgtgaagctgacttcatgacctcctgtcacaatcaattcaggtcccactaacaagcaagccctggttgttgttaggtgggcagagcaaatcacccctcactcttattctgatggaacaagaatacttcagatttcaccctatgcatttgttaatgacagtaaaccagatcaagctgattcaaggcaaaatcttaggatctgaatcactatctttgtgtatttgtatcctattctttaacaggttaaactggaagagggtgaaatggaaagttatatatgacctgggtagtttttaaccttttctatatgctaacatatcgtaagtccattttaatatcagaattcagcttaaaacatggacatttttttctgcttacataaaatcagtaaaatcaacacttgctacagagaaaaatctaaggcaatacaaattaacttccatttctccctaagtaaatgaaaaccaagcgttgatccttccttcatcacaaagaggttgtagacgtgagagaagaggatttgaatacaggttaaaaatactcaaaatggagaaaacaatacttttctttagggctgctataacattagcgataatgtaacaggtaaaaaagtgttccataggtcatagtaatgattattatttatcatcataattaggcactgccatcgtaaaagggtcaaagcttaggatttatggtcagagacaatggctccattgggtaccatggcaggaaataatggatagtgttgtaaaggaaacaacatcaagactcttgtgaatcaaactagtattgcataattgtgcaataacatccagctgtgggccttgagcgaaacagaatgaagagtggtgggagaaatttccaattcagagagagaagcagccacccactttttcattgctcaaaagtggtcatgagataacccttttgtctccttcccaagtattctagttgaaggctaccctttacggggagaaattaagcaggtatttgctctctctaactgattatccatctgtagtcaaagtgaaatctatcctttatggggagaaataaaacaagtacttgctgtctctaactgattatccatttgtagtcaaagtgctctttctaaaatgcaatttttcaaatagattcaacgggtttatgtgcagatttgttacatggatatattgcataactatgagccttgggcttctagtgcgcccatcaccagaatagtcaacgtggtacccaacaggtagttttcaatcctcagccccctctcactctccctccttttgaaggctcccaatgtgtattaggtctctccgtatgtccatgtttacctaccgcttagctctcacttataagtgaaagcatgtggtattagtttctgtttctgggttatttcacttatttcagtataatggcctccaaccccatccatgttgctgcaaaagaaatgatttcataatttttatggctgtgtagtatcccatgatttgtgtgtgtgcgtgtgtgtgtgtgtgtatatatatacatatatatatatattttatccagtcatccattgaacagcacttaggttcattttatttacaatagcccctccaaaatacctaacaatatttaattaaggaggtgaaagatctctacaagcagaagtacaaaatactaatgaaaaaaatcaccgatgacacaaatggaaaaacaccccatgttcatggattagaagactcaatattgttaaaatgaccatactttccaaagcaatatacagatttgatgcaattcctaaaatgtaattttgatcaaggcactcacctatttaatttggtgactcactattgcctacagaataaaacttgcagcatggctgacccagacttggggctctactgtctttcatatctgcttatacttttagatccactaactcatggtactctcctccctcatactttgtgccagctactcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaacccaatgcctaatacaggagctgaaacatagcagatgctaaaaaaaatctgctgaataaatgaatgtatgaagaaatgggtgaaggaataagagatcaaagttgatgccacagaaaggaggtaaaagaaaatcccttccaattacatgatacctttccctagccttcccaaatgggaatgagtgaaagacataatggcttatttcttcccattctttttggttgtttagtgttagagatgttatgctggatgaaccatggagtataattcaatgttgtaaagcagtcttacatctaaaaatttaacaacaaaaaaccctatttcaggttctttttttatgggtgaccaaacagaactgtgttactatctctgacactcactatgaaagccccctttacccatatgattaggatctaggcagggagatccccacctcaagtgttccagaacatttaagcttcataaatgctatcttgagaaaagtaggctctagatacagtcgattttcattatttgtggattccatatttaaggacttgcctactacctaaaatttatttgtaacccaaaaataagtacagagtgttctcagagtcatttacgggcatgtatatccaaagcagggatttttttttttttatttcaatagttttgggagtacaggtggtgtttggttacatgaataagttctttagcagtggtttccaagattttggtgcatctgtcacctgggtagtgtacactgtacccaatatgtagtcttttatcactcaccccactcccatccttccccaaagtccattataacagtcttacgcctttgcatcctcatagcttagcacttacttagaagtgagaatataagatatttggttttccattcctgagttacttcacttagaataatggcctccagctccattcaagatgttgcaaagaccattatttcattctgttttatgtcagagtagtattccatggtgcatatttaccacaccttctttatccactcgttggctgacgtgcagttaggttggtaccatatttttgcagtttcaaattgtactgctatagacatgcatgtgcatgtgtctttttcatataatgaattattttccctgggtaggtacacccattagtgggattgctggaccaaatggtagtgccacttttagttctttaaggaatctccatactgttttctgtagtgattgtactagtttacattcccaaccagcagtgtgtaaaagtgttccctctcaccacatccacgccaacatctattttttttatttttaaattatggactttttttttttttgcagtagtgaggtggttcagctgtggttttaatttgcatttccccaaagcagggaaaattttgagtcacctgatgcacaaattctcagctggggttgagcaaggtgacactctgccttcttgcttcagctctcatattgttaaaaaaaaaaaaaaaaagtgtccttttttgtggtctgtttagtgccacatttttcatatttttgtgccttttgttcacaattttgctgtttaaaatggcccctaagcatagtgttgagtgctgtctagtgttcctaagtgcaagaatgctgtaatgtgccttacagagaaaatacatgtgtcacacaagcttcattcaggcatcagttatagtacttctgtctggttggccatgagttcagtgttcataaatcaacaatatatattaaacaaagaatctttcaacagaaacacataaatcaaggccattctctgatcagcagacaagaatgttgtgatcagaagctcacaggaacctaatcttttatttcccctaggagcaatagttccatatttgctaattcagtgttcgtgacaactttataaaacataactactatgaatgatgagaataaaccatatattagtataaaaatctgcactggggtaaagacttcatcatattagtataaaaatctgcactggggtaaagacttcatcagggccaccttcctgccttgctgaaccaatctccataagaagagaatttatcatggcttaggcagaacaacacttaagtttgaatctcacgtctcccacttactagccatgtgaccttctacaagacactaaacccttgcagtcttattttcttagatgtaaaatgggtaaaataccatttaaaatccagactatctcatcagatcacacacagaatcacatagatattgtacataaaagaatattttatacttttaaattctatgcaaatataaagtacattatttctttataattcccaacataaaattaggttgttttgtaggaaaatgcatttagcacaataaagatctcatggttaaagactaacggactttctatattccagacttcactgtgaaaaaaaaaaaagccaagtatgcagagacaaaatgaagctgatgttaaattatggagttacaaaagacaaatacaaatggattaatttactgaacaaatttgagaacaagtgaataattatgattacgatacccctttctgtgatcttcccctatgactcccctgatttagtccagctacattcactaagcactagactagctaaagacattgttggctgaattctaagtggcctctaggcaagcccaaatgtatctaaaactggaaaagagaggacagctgccaagttaacctctacctccatccttccctcatctgtttgagacaccatggagagagctcttatgacccaaacttcagcctcctgagaattctgtcaacaggcctgatggcagggagggtacctcatcctagtatgactctaaatgcactttcagaaaaactttttggggaaaaacagttacttagagtttaagagaattcatcgttttttttccttcattgactgaacaacagttaatgagtaaagtggggaaagactactgtgagagccctatgagagccttttctatgccctgtatttataactcgtagataagcatccacaggatctccaaaacgcatcagatgaaaacagtgaggcttatgggccaaccacctctattgccagatcaagttacattaaagcttcaaacattatcagggatgtcaatcaatatttagctttatctaatcaggatcttccctcctgaggaagtaaaagaaaaccaaggtaccgttaggccaaatagagatctatgtgcattgccttctgtttcacaatcttcctcagagctttgtaaatagtttgaaaagatatttaaacacctgaaacatatttgttgttttaataatgaaatgacaggtggagtggggaccaaaaaaaccaacaactagggactttgatcttgtaaatttacctttctgtactgatacaggacaggcccacctaaaaagactgacatgtgtcccactgttgacaaaggttttaattctcaggccctctaataggtatgctcataacgaatagtgactttctacctcacttaggccatccccacatcttgcaagtgatgctggaaaacagctgttctgtaatatccttagagtcagaactgaactaagattctgactttccccaagggcaatcttctccacccttctcagtcagttgaacaagggaaaaacctctagatggaagggaagagcccctacaatcagaaacccattttctaaaaactaacattccacatgtcatcatcatttgtaggggcaatttaaaaaataatccttggaagtcttgtctctaaatcatctccattctcactgtaaattattcttacccttgtcataccacacctacatgaggcatcacaacagccacctaacttggttctgctgcatcctctccttgctactcaatgcagaggaccagaagctggttagacatgcagagtctcaggccccaccccagacttattcagtcaaaaactgcacttgaaaaagaccctcagtgattcatgagcacattaaattggagaagaactattcccagccatccacactatcagccaaaccactcccttttttagtaaatcagtactgctcagcctggctaagaaggcccaaaagagacacttcgaagtcctgagcattactttccaatcctgctactatgcactctccatggaaagcagactgccttctggagaacacaggtagaacacctggcacagtgctaagtggcatctagtatccactcaataaatgtgcatttcctttccttatgtctattcaccacttactatctctttcagtccatccctttcctataaggatatctcttcctcctaggatctattttgaattctctaatgaagtggttacaagcctaggttctaacgtcaaagttttagctctaaaacttatttactctgtgaattaggaaaactaattttacttcgccagacctctttccacttttgtaaactgaagatgtttgtaacagtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcacggccgttcgagaaatatagaaagtagagaaaaatattaaaaagacactgaaaatcagccataatctcaccactcagagacaactgttaacacttagaatatttccttccaaagagtagatcttatatgtttcaggagggcaaggagcaagtcttaacctcgttggaattttccatgacttccctccacccaataatgccccttcatacctaccccagcacctaatctagcacaatgctgaccacttaccagctgacaaatacatacctcttccttagatgaatgatgtattaagtggcatgcccctgtacttatatatttctatctatagaaaaagggatgttgtcagagtcagtgacataatttggttggttcttcactcagttctaactgctgtaagtgtgctcatatctgtattctgtgtgactgctgtttgtgtttggtggccaaagcgcatttctggtggtttcacgttttccttttcaacgtactcagatttcacatacctacaggaatggtcatcccatgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgccagtttggtctagttcctagtaaaaaccacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaatatccatggtgcacagcaagtttatttattaccaccaaataaacaagatctcctctagggaagcccagatgttaacaacttaaaggctggttttttgtaaacatttacattaacaaccattacctattaagagtgaaatatctgctccatttaataaaaatagcaatattgaactgctttacattataaacattgttattttaacgacatgttcctgaactggctaagtccgtaacaaaaacaatgaacacgctgaaatgagaagagtattttgacttgagaaatattaaaggtgttacaagttcgacaaatgaaattaacaaacatgtttgtaattttctttttttcctacaagtgtattttataagacatactggtgtgaaaattatttgatctctgacaaagctaaaattaaaatattctccaatcaatgagatgaaaatactatgacttccagtgtaatttatctacttagtatgtgtataaaatgaagcttatttaaaaatatcatgttacttatcactgtatattggctcacccttaaaaaagggaatcaaactatttcctagtactttttagaacatgtatatgtttacaagataggcattacattctctatacagctagcatagcaccaaaatctgcacagcttagagtgaatagtgtcaataaccagaatttgggctgcctaaatggtccctgtgagctgccgacaccagtcaaatccactgacaattgccagctctaggactattttcaattgtgtttactttggatgcaggattagcttcagttttccagtcaggagctcccctttcttccacaggctacctcttactaaaactcacttttctcatagcttgagagtgtttaaaacaggaatctcatttaggtgtggtaggaaaagagacctgatcagtgagacacagagaagaaaaagaaaggcatttgagttttattatatgaaaatataactggagaaattaattaatcatcttctagcacagtgttaatccaatgctatagatatcatatatctttagctcaattaaacagtcatttattgacaacctatgtgccctcatttgccatttatgtgctaagaaccatgctaggattaccaaaaaaaggtaaaatacaagtttaattctcaagaaaatgataatccagtgaaaagacaagtaatgtgtcccaaaaaacttggttttgcatgatattggtatgttagccagaaaaatggtgatgagactcaaataagcttgagaagcatttagtaggcttttcctgagcctttaatatgcccagtgtcttgtgaatctgcaaggaggaatttcttcaccatgaaacacctttttcacagtatgaataaacacctcattggaagagtattccctagagtgccagattagaaaatatttttatatacacataaatgttatatatagctagaatcccaaaccatttccataaaggaatcattttgttcccatactatgaacagattcctgagggggatggtagaagggaagaactatggtaggagggacactgagaaagggaaaaaatgattccttccccagaagcaagcccaatagtgacctattttcccaagtaggggaaaggatatagtactcatggcttgaatgccctgactgaacaaggaaaccctaaatattcattgataccaggtggagatcccaaatgtatagtgcatacattcctaaatgctttcagtttccaaaaagtttatattctctaagaaattgacttttattttaaaaacagcaacaacaacaaaacccattagggcaggagaagttcgttatgtgaggaaaatcattgttttagtgaaaggaagttgctatctcctgctgtctctcctttctactggctcacagaatgacagggcaaacggagcagaagtgtatgagaggtccgtaccatcccctctggttctgaaggattccttttactcaagagaggttaactctggggaggtaaaaacttgttctatttcattctcataagaatcatttgatactcgttttctgcaagcagcatggtgactctcttgttgcttgactgtttttaatttgtcatggggagggggagttttagaaaagaaggtacttaccagtcatggcaagctccagttttctcttcaaaattcagtgagaaaagatattcagctgatcctccatttctccttctccatctgatccccaaatccaaacatgtctcatttttcatatgtattacctattcctttgctttttccccaggtctgcttcaaagtatccttttaggagctcaagaccagcctgaccaacatagtgaaaccccgtctctactaaaaatacaaaaattagccaggtgtggtggcacgtgcacgtaatcccagctactcaggaggctgaggcaggagaatcgcttgtacctgggaggcagaggttgcagtgagctgaaatcgtgccactgcgctccagcctgggcgacagagctagactccgtctcaaaaaataaaataaataaaaataaaataaaatacagccgaagaatgtaaatttcagcagaatggcaaatgtgggttaaagacttaatgttttcttaggttacttactgcaagaactgccctgtcccgttccaccaagtctgcaagcttatccaacagacgtcccctttctgaagcatccatccttctccacactgaaccaagagagaaagccaggcgggctgcctgcactgctttgtctatatctgcctgttagagaggaagaggcacaactgaagaaaaacactccaaataaaggaagaaccatccactgtcatgaaaaaagtgaagcatgagcatgtagtggtgtactgagagcatatgtttgctgctctgctgtttgaaggcagttatttcataggaaatcttttatctacaaaagacataccttgtctgcttcttgaacttcacacacctgttctcctgtggctggattatagacagggaacactctcccactctctgagttctgccactcgttgtttataaagatctaagggagtagataacagaatgggatctgtgacacaggtgataagcagccagtcaacggccaagtgttacggaactactatggtaataacacttgttgtataataaaagtatacaatttgaagtgttttaagagacccttctagactcaacgccaatttaggaatttcctctatatttttgctttaacatcatccaaaggctaactacagttcttacctttcatgaacctgtcaactaactaaagatacaaataaggatagagtgtctcacatacatacaatcatacactgatgctaaggcaagagttatcgatagcccaagctctggctagtatccatgagggttaaatagcagatcaaacttacagtcatcaagccttagatcctactttctctgccacaggcctaagtgacttctcaaggaaacttgaatggtgctgcaataagcattcacctaatttatactcaggtcctgaacaatgactctaaccaaactaactagttagttcaacaagttatatgtgtaaatccaagttagatttatttccctttgctgaataggctatcttgcagagccaaaaaagatggggatggggagttagcaagtggggtgtaattttcaaatgatcaccccaggatttcttaaaaggcttggtctccctatgtatgaaattgagattaaaatggcaaagagactgaagatttgggaaattattcaagtcaatttctcacaagatttgtaataaatgagttaaaggacaagggaaaagaaaaggccagaaaaattttaaattcttattgagtgagaaacctaaactaatatttttagaccatgtaatcttagaggacatacgaagatgttttactctataaaatttacagcaccacagtgaaatttctgaacttatgaaccagtcagtcatctaatttaggacaaaaacaatgataattatttagtgcctgccatttaaaaaataatcagagatgaggcttaataaatataaatctacacttggtaaatatcaaattctagaaaatgtcccaaagctttccttttacatgttttccttgatttgataaaaactatgagcccatgtagaaggaggcactgattaaactataactttcttttcccaaaggatttttaagataaaggaaaataccttaaatttgtagagcacttaacacagctgtattgatacaaacaaaatgaccttgtaattgtacattttacagtttataatacacagttcataaacacatgtaacaaaatttacccaataaatactcagataacttctagtcacaggaaaaataaagatggttaagagagttccagccctccagagtctgacagtctctagtagtttatttagtacttacaataaccccgtgaagcagggttttctctctattacacatgagaaaattgagaggcagggagcttgagtccaaagaagcaggttcttgttgtggctgactcaacaatgtgttctttccaatacacataatttccaggattagtcagcccaaagaaacagaactagttaatgtccaagcctgagctagttagaattcttaaattattggtctggttctcttttcattcactctatttaataaatttgctcacagctgatagctcattacattttcatgctcctttgaacacagtataaagtccaggtaacaaaaggagaaaattaaaaagttagtttcattaaggatccacttcttgggtattatcaggtttagggaaaaagtggtcttacccatgtccctatccttttattcaccatgtgactgaatcaaactttttaacctttgcagtatcaccaaggcccactgatcctaatttttttttttttttttttttaagacagagccttgatctgtcacccaggctagagtgcagtggcactcaatctcagctcaatgcaacctctgccgcccggggttcaagtgattctgctgcctcagcctcccgagtagcagggattacaggcacccaccaccatgcccagctaatttttgtatttttagtagagacggggtttcaccttgttggccaggctggtcatgaacccctgacctcaggtgatctgcctgcctcccaaagtgctgggattacaggcgtgagccactgcacccggccccaagttcagtttttaggtttctctgtgcagcagttttaattatttgtaaagactgatatttcatgacttttgtttcttacaggttttccaaaaatcaaaaggaaaaaatacttatttttagtaagttaaactcattttcttcatcacttagtctattgatcattttataaatctaagatgcattataggatctaagatacattatgatattttagtgatcttatatttcctgtattttaaagtattttgctacttcatcatgctagaaattacttcatcatcactcatcaattatttctaattgtgctaaaaaactaaaataaggaaaaaaaaattacgaaattgcctagaaatgaatgtcaccactgtatcatccttccgttttctaattgtgttgtgtaatacatctttcaaaaagttataaaagaagtctagagatgccatctttgccatattcttttcagcttccattaaacaaagttaagaatttggaattcttaattttctgcccataatgggataaagaataaaattaagagaaagatatttcacaataattagatgaatgagaaaatgaaggcagagacagagcacttgagattctaatgatgaggtaaaactgaccatagaagcaaaatcttgggctatgagtccttcagataaattctgtcagacttgagaatcagagtaaacaatatatttacaaagacaaaaaggaaacatgatattctaacccattaattatttaataggaaggacttcatcatttagtattttgcacaagaacctggaccatcctgctctgataaaaggacatatgacaattattttatcttttatagtatttgttgataaaatttacttgatattcataaatggacaaatgctgaaggtaggtatatatgtaaaggtgactggaacagacagacattatgtagaaattttaaaagttcattgggttgctcaatctgattgacatttataaaagtaaaaatgaaaatatttttgtaattgtgaaacaaaaacatggccaccttcttttctacaaaatcatgaaccctcaaatttctccatagcattacactgtgataataatgcatatgcaggaagaaccagagataatgatgagctataacctactagagatctgtttaaaatctggagccagtatttacgagatgataatgttctaggttcatatacgacagctcatgaccagttatttgcattcaaaggcattgccaatttcaggttacattacctccaaaatcaggaaaatatgaaataaaaacgtggtttgctatgtttaaattcttattttgctgttttttttaccatctctttattcttacttctgtaaattattcataaaaataaaaataaaaataaaatgaatacattgaaaccagatggtaaatgtgatggctatttttcctggtgtgccaaaattaaaattttaattttactacattattatttttgtagacctagtcttataaaatgacacttaaaaaattatatggacaactttgttggtacatggaataacaaatatcttcatggtcagtacttgaatgtttgcagctctctaggcaatgtcgaaagttttgaatcctgtccatagcattattccctgaccagggctccttggagaaatggtttatttcagaactgtatcagggaaagtacaagatgagcctggaacattgtggtgcctgaaatcaagtaaatacttaaaaatggataggaagataataaaaagatacagaagtcaccatgaagaggctaccaatggacaatactggaataatttaaacaaaaaataaataatgctggtaatagattatgacccatagaatgaaaaagacatccaaaagttcataatgatatacatttttaaatgaataaataaataaatgtgggataaggaggcgctcttcttcacagtagaattccaactactagatgtgaagagatgatgggattagatgattattatttgtaaaataccatagtaataactgcttcaggtaaaaatcatcactagatagtaaaattggtgggcaaatatgcaatgaaaaatgtatgatgtatattcatgtagtttcaaaatatctcccctcaagatacttaattacaaaagaaaaaatagtaactttatgttggagaaacttggcagacaccaccttaatcaaatgattaaagctgatgtcaccagcaatgggacaaattgatatcatgtgcagctgatatgatatgctgagaaagacaagatcagttctgtggtaatcttacccaaaaggcataacctaaattcaaacatgaggatacaacaggcaaatccaaactaaagcatattccacaaaataattgtcctatacttacttaaagtgccaaggtcatgagaggctagtaaaatgaaaacaactgttccaaattaaaggtcactaataagacataaaaattaaatgcatcatgtaaccatggattctctgatgggccaggaaaaaaaatacatattattgggacaattggtgaaatttgaataagatttttaggttagatgataatattttgtcaatgttaatttcctgatttttataacttttataattgtaagatcatttggggaatctgcatgaagtgtacacagaaatttttgcactatttttgaactttatttttgtaaatctgaaattatttcaaaatggaaagcaaaaaaaaaagtttaaaagtcagtgtcatctttcagtgcctacctttcatattttaaatgccccaaacaaatttgttaaacgaagaaacgaggattcaacatcttcacaagagtttctttaaatgtgactttgtggaaaataaaataagccactcaagctctgtcttgaaacatggcccaatgatgccaaatcattttaagttaaagccatgttaatctcagtataagaaaccagaatattttgctttgtagtttactgaatttcagaattagtatgaggaaaaatgtgggctttactacagaggtctttgaaagtagaaagtgtatctgaccctaagttactggactgttgctcagtttcttcatttggaaaatatagaaatgctgacttactaaaatcatgtaattctgtgatgctgtaaccgaaggtaaaaagaacagatggtccataaaagaaggcacctatctaatctaggtttctcagaggttggagggattagttcatatccctttctttccattgtggttgtgaaggactaactgtccactgacatattataggttgttgttggttttaaaaagacagaatgataggcacttagctaacattaaccaaaatggaatgtctgctgagagaggaaatgaatcactttcttttttattattattttttaaatgttatttaagttctgggatacatgtgcaggacatgcaggtttgttatgcatgtaaacatgtgccacggtggtttgctgcacctatcatcacatcacctaggtttaagccccccatgcattagcttttttatcctgatgctctccctccgcccaccccctccaacaggccccagcatgtgttattcccttccttgaatccaagtgttctcattgtgcaactcccacttataagtgagaacatgtggtgtttggttttctgttcctgtgttagtttgctgaggataatggcttccagctccatccaagtacctgtaaaggatatgatctcattcctttgtatggctgcatagtattccacggtgtatatgtaccacattttctttatccattgatgggtatttgggttgattccacacctttgctattgtgaatagtgctgcaatgaacatacgtgtgcatgtatctttataatatgatttatattcctttgggtgtatacccagtaatgggattgctaggtcaaatggtattgacatgaatcactttctaacatctttcctgatatggtcagaaatacagtacctcccacaccaagaacaaatctgaaacacactgaagaacgaggagaatatgtgaggaacaaaattttcttatatttaatagatgtggtaaaaacatatgtaatataaatgcaagctaagatctaccatattaaaatataccatgaacacatcattcaagcactggaacattattagtattactgaagctacctgtgtgtttcttcctaatcccgtcctccagcttgacccaccctgccactagaggtaaccactaacctgtatttttaatttatttattcttagatattttctttcattttcttgatcaaatgtagtatttatttgatgcaggtttctgtgtttattgtatcaattttgtaaaatgcattaggatcatcttgattgtcattaacgttttatgtttgtactatgatcactgagaaagccatgctgaaatttcccatggtggtggatttatcaacatattccttaactctaaatttctacctttataattttcggggtattttattagtgaatataagttcataaccattagatctctctggtaaaccatttatcaatatgaagtgatgctctttattactaataaagcttccaattttagagcctattttgtttaatagtagcatagctacccaagcctttctccagtatttgtctcatttatcttttcctgtctttctgctctcaactatatctttattattttgatgtgtctctgtaagtgacatatggttagattttatttaatatgaaaatctgcattttaactagcaagtttaatatatttctattaactttttgagttggggagggttcactagaagcagtttatatgactgactcctccacttagaaaaaccagaacagtatatagacagtcacacttcaaatatattatccaagagaacaccggaattcaacaaagaagggacaggaagcaccaaaagtaagaaaagaggttgcctcttgcatcctccctgactgggatcagctgggagccaggagtgatttcccaaagtgggaaatgggtgagtgggagacttccagcagccaacatccccaccgtggaattgtgcaattctggccacttgaaaagccctcaatcctcccaagccccgaaactaacacagggagctgccaagagaccatgaaatggaactgctcctaggagagaacttaacactgggccccacatcctttctgagacctaagcagctacagcaaggcatcatttccaaacctagcctttgacaaacgtcgtgctgtcctggggcccagcagttccaggactgaggcattaaggaaactcaggctattactgctgggacagcagggcaagctgggagtgctcctgtagccaaggctaagaagccagtgagacatgagctgaagcacccagtgctggtagacatgtgttgctgagatctaagatggagacacaagttgctgctggaattggtggtgagctgggcaggggttgctgcagctggtgcaggcggatgagttaggtgcaggctaccgccaccagggtaggggatcaagcctcactaaaactggggcatgaaagaggcacaattccccacctgccggtccaggctgtggccactgatgatggccaaatcctctccagtggcagggcctcaatgcagctgctactgcccctcactcaagcactctgcctagggcctaagaattgccctgcccctgcccatcacagctagtgcctcctctcaccactgtgggggctgaacaaaagcccatctggcctcactttgttccccattcccgagacagagcacatagattgaggtcctggagattgcccaacccaatctaccaccttgggtacctgaacattccgtacagggtactgaggttgggcctaacttcccagccactaccacataagctgaaatctacctgcaagtgcaacctcgggcctggagacttgcctgtccagcacatcacagccactcccaatatccatgcacactactcaggatgcagaggatcatcctactactgctactgccattgccatgccatacaagctgcctagggacctgagaacacatccaaccacctggtccactgctgccactacctccggggggaaagccacctcaaggccaagaatcagcctgctccaacacaggtgccagggtattccacactgaggcacaaagacaggcacactcaacccaccactgcaaccactagggcctaaagactggcctacctggcatcccagtcctcagcacaacttcaccacagcctctgctaataaccacactataacttaccaaggaaatcacagatatcactgatgttgtttactgccaaagaaatcatatagagactacaccactgcatccacccagaatcaaagccaaaatgccccatccaaccaacaccatatatacaccttcaggaaaaattcctcccctatgaaagtaaattcaaaaataggaagaaccaactgttataccagatgtgcagatatcaacataaggacaacatgaaaaagcgaagaaatatgacacctccaaaggaacaccatactccatcaacagatcttaatcagaaaatttcaaaatcccagataaagaattcaaaatattgactttcaagaatcttagtgagatacaagtgaattctgaacataaaaaatcagaaaaataattcaggaaataaatgagaaacttaccaaagagataaatttttttttaaagaaacaaatagaaatctggaacagaataattcattgaagggaaaaaaatgcatttaaaatcttagaaccaggcaaaataatttctaatcttcaagacaggtcttttgaaataatccagtaaaacaaaacaaagaacagagaatttaaagaatataagcaaagcctttgtgacacttgggacaattttaaagtgaccaaatttacaaattattagtataatcaagaaacaagaaacaaagatgaaaacttgccaagcctagcaatatttaacacatgcagatacaggatgcttaatgattctcaggcagatacaatatgaaaaggttttctacatagcatattgttatcagactgtctgaagtcaatgataaagagaaaatcctaacaacagcaacagaaaagcatctagtcacctataaaggaaaccccatcaaactaacagcagatttctcagcagaaaccttacaggccagaagagaatgagatggtatattcaaagtgctgggaaaaaaaaaaaaggaactgccaacccagaatattatctctagcaaaattatccttcacaaatgagggcgaaatagactgattcccagataagcaaagactgaaggaattcattaccactaggactgaccctacaagaaatgctcaaaatagggctgggcagggtggtgcatgcttgtaatcccagcattttgggaggccgaggtgggtggagcacctgaggttgggagctcaagaccagcctgaccaaatcatggagaaacctcctctccactgaaaatacaaaattagccaggcgtggtggcacatgcctgtaatctcagctactgggaaggctgaggcaggagaatcgcttgaacctgggaggtggaggttgcagtgagctgagattgcaccattgcactccagcctgggcaacaaaagcaaaattccatctcaaaaaaaatgctcaaaatattaactctgaaatatggaagtataaaactcatttgtaaagtaatcacacaaaggaggaagagaaaagactcaaatggtaccactacaggaatccaaactacagtgtaaacaataagaaaaaaaaagaggcaaagaatatataaaacaaccagaaaagagatataatggctgaatggatttttaaaaaatgatccaattttatactgcctagaagaaactcactttaccagtaaagacaaatgtagactgaaagttaagagatgaaaaaaagtgaaaaaagatattccactcacatggaaaccaaatgtgagcaggagtagctgtatttatatcagataaaaacagattttaagccaagaagttcattatataatatgagggaatcaattcaacaagagaatataaaatctaaatatatatgtatcaaacactggagcacccagattcatagagcaaatattactagatctaaatagacagactacaatacaatagtgggggacttcaacaccctcactgtcagcactagacagatcatctaggcagaaaatcaaccaaaaagcactggatttaaactagactttacaccaaatagacctaacattctatccaactactgcagactatacatccttttcatcagcacatgcaatattctccagaacagaccatatgttggaccacaaaataaatctcagcaatttttaaaaaatcatatcaagtatctcctcagacaacaaaggaataaaactagaaatcaatgccaagaacaactctggaaacgatacaaatacatggaaattaaacaacatgctcctgaatgaccactgtgtcaacaaataaaaatagaaatttaaaaacttcttgaaacaaatgaaaagagaaacaacataccaaaactcttgggaataacaaaagcagtgctaagaggaaattttatagcaattaatgcctacatctaaaaaaagtagaaagattataaattaataatctttatcaatgtaccttgagaaactagaaaaacgcgaagaaaccaaaccccaaattagcagaagaaaataaataataaagatcagatgtaactaaatgaaacagagactaaaaagaatacaacaggatcaacaaaacaaaaagctggttctttgaagagataaacaaaatcgataaactgctacctagactaacctaaaaaggagaagaatcaaacaaaatcagaattgaaaattgaaaacagagacattacaatggataccacagtaatctctgaagaactacacattgacaaactgaaaaacctaggggagatggatacattcctggaaacatataagctaccaagattgaatcaggaagaaacagaaaacctgaacagctcaataacaagcagcaatattgaatcagtaataacaaggttctcaataaagaaaagcccaagacaagaatccagccaaattctaccaaacatacaaagaataactaacatcaatcctcctgaaactattcaaaaaaatcaaacaggaggaatgtgttagtctgttttgtattgccgtaaaggaatacctgaggatagataatttaaaaagaatttatcttggcttatgattctgcaggccatatgagaagtagggtgccagcatctgctcttagtgaggccacaggaagcttacaatcacggcagaatgtgaaggggaagcaggtgtgttacatggtgacagagagagcaagagagaaaagaggaaatgccagacttctttaaacaactagctctcatgtgaactcacagagcaagaactcactcattacctcagagagtgcaccaagccactactgacagatccagtcccatgaaacaaacacctcccaccaggctccacctccaacattggggatcacattgccacatgagatttggaggggacatacatccaaaccatatcaagggaattctctctaaatcattctataaggctagcatcaccctaataccaaaatcagacaaggatacaacaacaaaataagaaaactacaagccaatatccctgatgaaatagacacaaaaatcttcaacaaaatactaacaaacctaaatcaacagcacattgaaaagataacacactatgataaagtaggatttttaccaggaatgcaaggatggttcaacatacacaaatcagcaaacatgatacactgaaaatctacagaatgaaggaccaaaaccatataatcatctcaatagatgcagaaaaagcatttgataaaatcaacatcccactcctatcggtatgcttccaagatggccaaatagtaagagctctggtctgcagctcccagcaaggtgaacacagaagacaggtgatttctgcatttccaactaaggtacccggttcatttcactgggactggttcgacagtgggtgcagcccacagagggtgagccaacgcagggtgggacatcacctcacccaggaagcacaaggggtcaggggatttccctttcctagccaagggaagccatgacagattgtacgtggaggaacagtacactcttgcccaaatactgtgctattcccacagtcttagcaagcagcagaccaacgtattccctcccatgccaggttcggcgggtcccatgcccacggagccttgctcactgctagtgcagcagtctgagattgacctccaaggctgcagcctggtcggaggaggggtgtctgccattgctgaggcttgagtagcaggtaaacaaagtggccagaagattgaactgggtggagcccactacagctcagcaagccctactgcctctctagactccacctctgtgggcagggcatagctgaacaaaaggcagcagacaacttctgcagacttaaacgtccctgaagacagggacagctctgaagacagcagtggttttcccagcacggtgtttgagctatgagaatggacaaactgcctcctcaagtgggtccctgacacccactgtaggctgactgggagaccctcccagtaggggcctaaagacacctcatacaggcaggtgcccctctgagatgaagcttccagaggaaggattaggcagcaatatttgctgttctgcattatttgctcttctgcagtctctgctggtgatacccaggcaaacagtggacctacagcaaactccaacagacctgcagctgaggggcctgactgttagaaggaaaactaacaaacagaaaggaatagcatcaacatcaacaaaaacgacatccacaccaaaaccccatttgtaggtcaccaatatcaaagaccaaaggtagataaaaccacaaagatggggagaagagaaacctgagcagaaaaggtgaaaattctaaaaaccagagcacctcttcttctccaaaggatcacagctcctcaccagcaatggaacaaaactgcactgtgaatgagtttgatgagttgacagaagtaggcttcagaaggtcggtaataacaaacttctctgagctaaaggagcatgttctaacccatcacaagaaatctaaaaaccttgaaaaaggttagatgaatggctaactagaataaacagtgtagagaagaccttaaatgacctgatggagctgaaaaccatggcaccagaacttcgtaatgcacatacaagcttcaatagctgattcaatcaagtagaagaaaggctatcagtgattgaagatcaaattaatgaaataaagcgagaaaataagattagagaaaaaagagtgaaaagaaagaaacaaagcctccaagaaatatgggactatgtgaaaagaccaactctatgtttgattggtgtacctgaaagtgacggggacaatggaaccaagttagaaaacactcttcaggacattatccaggagaacttccccaacctagcaaggcaggccagcattcaaatttaggaaatacagagaccaccacaaagatattcctcaagaagagcaaccccaagacacataaatcgccagattcaccaaggttgaaatgaaggaaaaaatgttaagggcagccagagagaaaggtaaggttacccacaaatggaagcccatcagactaacagcagatcccttggcagaagctctaaaagccagaagagagtgggggccaatattcaacattcttaaagaaaagaattttcaacccagaatttcccatccagccaaactaagcttcataagtgaaggagaaataaaatccttcacaaacaagcaaatgctgagagattttgtcaccaccagtcctgccttacaagagctcctgaaagaagcactaaacatggaaaggaacaactggtaccagccactgcaaaaaacatgcaaaattgtaaagaccatccatgctatgaagaaactgcatcaattaacgggcaaaataaccaactaacatcataatgacaggatcaaattcacacataacaatattaaccttaaatgtaaatgggctaaatgccctaattaaaagacacagactgctaaattggatagagtcaagacccataagtatgctgtattcaagatactgatctcaactgcagagacacacacaggctcaaaataaagggatggaggaatatctaccaagcaaatggaaagcaaaaacaaaagcaggggttgcaatcccagtctgatgaaacagactttaaaccaacaaagatcaaaagagacaaaaaaggccattacataatggtatagggatcaattcaacaagaagagctaactatcctaaacacatatgcacccaatacaggagcacccagactcatgaagcaagtccttagagacctacaaagagacttagactcccacacaataataatgggagactttaacaccccactgtcaatattagatacatctacaagaaagaaggttaacaaggatatccaggacttgaactcagcactgaaccaagtggaccaagtctattaagactctctaccccaaatcaacacaatatacattcttctcagcaccacatcgcacttactctaaaactgaccacataatttgaagtaaaacactcctcagcaaatgtaaaagaacagaaatcacaacaaactgtctctcagaccacagtgcaatcaaattagaactcagggtaagaaactcactcaaaaccgcataactacatggaaactgaacaacctgctcctgaatgactactgggtaaataacgaaatgaaggcagaaataaagatgttctttgaaaccaatgagaacaaagacacaacgtaccagaatctctgggacacatttaaagcagtgtgtagagggaaatttatagcagtaaatgcccacaagagaaagcaggaaagatctaaactcaaccccctaacatcacaattaaaagaactagagaagcaacagcaaacaaattcaaaagctagcagaaggcaagaaataactaagatgagagcagaactgaaggagatagagacataaaaatcccctaaaaaaaaaaaaaaatcgatgaatccaggagctggttttttgaaaagatcaacaaaacagatatactgctagcaagactaataaaaaagagagaaaaatcaaataaaaatgataaagggaatatcaccaccgattccacagaaatacaaactaccatcagagaatactataaacacctctatgcaaataaactagaaaatctagaagaaatggataaattcctggacacatacaccctcccaagaataaaccaggaagaagctgaatctctgaatagaccaataatcagttctgaaattgaggcaataatagcctaccaaccaaaaagtccaggaccagatggaatcacagtgcaattctaacagaggtacaaacagcaaagacgatctggtaccattccttctgaaactattccaatcaatagaaaaagagggaatcctccctaactcattttatgaggccagcatcatcctgataccaaagtctggcagagacacaacaaaaaaagacaattttagaccaatatccctgatggacactgctatgaaaatcctcaataaaatactggcaaaccaaatccagcagcacatcaaaaagcttatccaacacaatcaagttggcttcatccctgggatgcaaggctggttcaacatatgcaaactgataaatataatccatcgcataaacagaaccaaggacaaaaaccacatgattatctcaatagatgcagaaaaggccttcaacaaaattcaacagctcttcatgttaaaaactctcaataaactaggtattgatagaatgtatctcaaaataataagagctatttatgacaaactcacagccaatatcatactgaatgggcaaaaactagaagcattccctttgaaaactggcacaagacaaggatgccctccctcaccactcctcttcagcatagtattggaagttctggtcagggcaatcagagaagagaaagaaataaagggtatctaattaggaaaagaggaagtcaaattgtcccggtttgcaggtgacatgattgtatatttcgaaaaccccattgtgtcagcccaaaatctccttaataggcaacttcagcatagtctcaggatacaaaatcaatgtgcaaaaatcacaaacattcctatacaccaataacggacagagagccaaatcattagtgaacttccattcataattgctagaaaaaaaataaaatacctaggaatccaatttacaagggatgtgaaggacctcttcaaggagaactacaaaccactgctcaacaaaataaaagaggagacaaacagacggaagaacattccatgctcatggataggaagaatcaatattgtaaaaatggccatactgcccaaggtaatttatagattcaatgccatccccatcaagctaccaatgactttcttcaaagaactggaaaaaactaaagttcacatagaaccaaaaaagagcccgcaaagccactacgatcctaagcaaaaagaacaaagctagaggcatcatgctacctgacttcaaggctacagtaaccaaaacagcctggtactagtaccagcacagatacacagaccaatggaacacaacagaggcctcagaaataacaccacacatctacaaccatctgatctttgacaaacctgacaaaaacaagaaatggtgaaaggattccctatttaataaacagtgctgggaaaactggctagtcacatgcagaaagctgacactggatcccttccttacaccttgtacaaaaattaactcaagatggattaaagacttaaatgttagacctaaaaccgtcaaaaccctagaagaaaacctaggcaataccattcaggacataggcatgggaaaagacttcatgactaaaacaccaaagcaatggcaacaaaagccaacatagacaaatgggatttaattagactaaagagcttctgcacagcaaaagaaactatcatcagagtgaacaggcaacctacagaatgggagaaaattttttcaatctacccatctgacacagggctaatatccagaatctacaaagaacttaaatttacaagaaaaaaacaaccccaacaaaaagtgggcaaagaatgaacagacacttctcaaaagaagacatttatgcagccaacagacacctgaaaaaatgctcatcaccaccggtcatcagagaaatccaaatcaaaaccacaatgagataccatctcacaccagttagaatggcgatgattaaaaagtcaggaaacaacaggtgctggagaggatgtggagaaataggaacacttttacactgttggtgggactgtaaactagttcaaccattgtggaagtcagcgtggcgattcctcagggatctagaactagaaataccatttgacccagccaccccattactgggtatatacccaaaggattataaaacatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacgaaaaaccaaacaccacatgttctcactcataggtgggaattgaacaatgagaacacatggacacaggaaggggaacatcacacaccggggcctggtgtggggtgggggaagggggtagggatagcattaggagatatacctaatgttaaatgagtagttaatgggtgcagcacaccaacatggcacatgtatacatatgtaacaaacctgcacgttgtgcacatgtaccctaaaacttaaagtataattttaaaaaagacaaaaataacaaatgccagcaaggatgtggagaaaaggaaagtcttgtatatggctggtgggaatgtaaactaatacaaccactatggaaaacagtgtatgtggatttctcaaaaaactgaaaatagaactaccatttgatcaagcaatcccactattggttatctatccaaagcaaaagaaatcaatatatcaaagggatacctgcactagcatatttattgtagcactattcacaatagcaaagatacagaatcaaccaaagtgcccctcaacacacacacacacacacacacacacgtgcgtacccaacggaatattatttagccatagaaaagaaatgaatcatgtcatttgcagcaacgtagatgggactggaagtcattacaagtaaaataagccaggcataagaagacaaatattgcatgttctcatatgtgggatctaaaaaatatgaacacatagcggtaatgtaaaatagatcagagacactgggacaggtgagtgggggtgaagggagaggatgaagagaggtaggttaaaggatacctatagtaagatagaaggaataaattcattgtttgatagtagcttcggatgactatacttaacaaaaatgtactgtacttaagtgatggacacctttaatatccagacttgattaccacattatattcatgtaacacaacatctcatttacccccataaatatgtgcaaataaaaaatgcatttgtatgtattgggattatatttagtgttatatattctgttatatcaggacttgatgctttctatttgacatgctttattttaccttctattttctcctttcttgcctcttagttctagttgattaaagtatgttgttattgttgctcattttataatgcagttactgccttctattggtttggaagttgcacactgtatttttttgtttattcatggtattttatcatgcatatttaacaacttcacctttaaaattaatcaatatcttaaacctcccccaaaacaatacaatgaccttacaacactaaatctaatcactcttctccagaagtttgtcataaattattttataccaaaaaaatgatttctcaattaactcaatattaaattgtgagttaatttttgtggaagttgtaagttcagtgttaggactctttttttttttttttttacatgtgaatatctagtttttccagcatgatttgttgaaaagacaatcctttctccactatgtgcttttgctcctttatcagggatcagttgactacatttgtgtgaatgtatttcttggttctcttctctatttcacttatttttctgtattttttttttgccagtaccatactatcttaattactgtagctttacagtaactcttcaaattggatagtatcagtcctcctcttttgttcttttccttcaatattgtgttggctattctaggtcttttgcctttccatataaactttataattagtttgttaatatctacaaaataacttactaggattttgattgggattgcattgaatctacatattaacttgggaagaaatgacatcttaataattgaggcttcctatcgatagtgtatctctccatttatttacatctcctttgatttctttcatcgaagttttgtggtttcccttataaatgtacatattttattatatttattcctaagcatttcagtggtaatgtaaatgataccgtgtttttaatttcaaattccaaatgttcatcaccagtatataagaaatcaaatgacttttgtagattaacatagaatcctgcaaatttatagtaatcccgtcagttctagatgtttttttcttttttggagggggattgattcttaaggattttctacatagaaaattatgttatctgtgaaaaaagacatttttccttcccagtctgtatacattttcttttcttactgcattaactagaacttctagtataatcttgaatagcagcagcaagagggggtagcctgtcttgatcccagtcatagtgggaaagcatctagtttctcaccattaaatattatgttagctataggttttatgtagatgtttttcatcaggttgaggagattctcctctattcataatttttgagagtcttccttctttatatgatgaatgggtgctgaattttgtcaaatactctttctgcatgtacagacatgatctcctgattttttctttgtcagcccattgataagacagactacattaattgaattttgaatgccaaatcagccttgtatgcctgaaataaatcctgcttggttatggtgtataattctttttatacattggtggactcaatttgctaatattttgttgtggatttttgcatctatgttcatgagaggtaatagtttgtagtattccattctcgtaatctctttatctggttttgatattagggtaacgatggcctcataaaatgagttagtgctccctctgcttcaactttctggaagagactgtagataattggtatgtttgtttggtagaagtcaccagtgaaaccatctggacttagtgctttcttttttgaaaggttattaattattgattcaatttcttgaacagatacaggcctattcatacatatttctctttgagttttggtagaatgcatctttcaatgaattggcccatttcacctaaattatcaaatttgtgggcaaagagttgtgtataatatttctgtattattcttctactgtccgtggcagtagtagcaatagtccctctttcatttctgatattagtaatttgtgtcttctctttttcttttagttagccaggctacatgtttagcaattttattaatttttttcaaagaaccagtctacagttttattgtctttattgttttcattttcaatttaatcgatctgtgctataatttttgttatttttttgtttctgtttacattactcttctttttctagtttcctaaaaaagcttagactatttcttatttttaaatatatgcattcagtgtgatacatttctatctaaatactgctttagcagcatcccacaaattttttaagttgtattttcatttagttcaaaatatttcttaatttctcttgagacttactctttaactcatgtgttattcagaagtgtgttctttaatttccaaatatttttggtttttccagctatctttctgttttagtttaattccactgtaatctgagaatatcttttttgcataatttctacttttttaaacttgttaaagtgtgatttataccccagaatgtggtctatcttgctgaatgctttgtgagagcttgagaaaaatgtgcattttgctgatgctggacatagatttattttactagtcccagaactggtattggcattcacctctagagtaaacccagcttttgcattttcctttagctccctatcaatttccagatcactgttcttttaattaatcaatacattaaaaaataatgtatgcaaggatagctcttactacttctatttaatagtgtaataacatttgctattataatatgaaataaataggaggccaaagttttaaaataaaagaagtaatagtatatttttagatgacattattgtctatgtagaaattccttaaaaaatctacaaaaattgctagaagtacaaatttagcacaaagtcccaggatacaagatcaatatataatcaatacactatcaacaaatcactggaaaataaaatttaattatgcacacacatatacacacaaacacatattcatgttcatacacatatttatccaagatctagatgcataatgacagaaagacactgggcagcaacttttggcagcaactattaaccttttaaaatacataaatttaaaaaataatagtctaaagaaatgtctaaagaagagttatggctcttagttgaaatgcaaccactttttaacattaagggacctgcgcaactccctcccacatcctcccgtcaaacaggttgatataacatgaacagcaccagttggaactaagaaggaaaagaatacctgagcagaaatttgacttcacagaagacactgcaaaatatatactaaaggcctcttctgagcatgaaattgtaagtacgactgaaaatccacagaagacgtgtactctggagcttataataatgcttcaatgacaagattactctaaggaaagttaaataacgtaagacactgtgatttagtgccaagatggatagtatagataagcagtgaaggagtttgcttcagagaaaagagaaatctgtgtggctgacatgttagaataacactttggggaaataagaaataattaggaagtatgacctggagtagggaatggggaagtacaagaaagaaactctatcctcagtagaattattcagccggcctgatcagcccttctttaactttagctcctctcagaagattatctgataccccgatttaagaagtgtaacaaagaagaaagaaatggacatttagcttttctccccttctaccaaaagctcaaatgatgaaggtgccccttggattcttaacaacagcctctaccacagcactgtcctcaaagtaagtagaatatgtatttaagcagcaaggcccccaaatcacaaagaatgagagtaaataaatcagaaaactcatataggtagtagacagagtcatagaaagaagacctcagaaaagagaaaaaaagaattatgagaaaagagaaagaatttttaaggtatgttataaattaaccacacatttaggaaggacagttaaaaaatggagtgaaaaatactgtagaggaaacaggaagaagagacttttaaaagccaaggaaaataaatactgacagggctaagagaaagaagtggaactcatctcccatgaaacttcaaaatttaggcattcaatacttaaactattcaatgttgaataactagctttattttttttcatcatgaaagtattgttagaaaaaccattaaagcaagaccagcctgaaaacatggacagcccatgacatgaagaaataaatgtgatattcacattcttgtgcatcataattctatttgcagacctagattatgcttttggttttggtcaatttctgcatttagctagtatcccacataattcagaagaaattgtactgtctggaagtgtgcaattccttgggtagcatcatccctatatgtgtacttaagccaaaaggttctaagaagccatgcaaattaaagcagaaataaagataagaggtccctggcaaccagcagtctttgatccacctagacaatgtataaaaaggactttgatatcagttgaactcaaaaagacacactttgtgttttttttagtaacacacatcgtaatctatctcccttgagattaatgtgtctctgtccaagtttgctaacatctgttaaactcagttttcccccgtggggccttccccttctttttttctctatcttcctgcctcttgaaatctacatctctgaaatcatgggatatgtctcttaagctatgggtttccctggtctcttcctactaacaccctcttcccctccctccctacttccttcccttcctttcttatctctttcaacagtatttactcagtgtcttctctattctaggcattgtatttgctggagtctccttaaatttctgtattttctttcttctccaggccaagtaaattatgtctttcagtctaagtatcttcctatctctaggagatgatccaaggagtcaaatagccttatcccagggataaggatatttctgtgccagtcatcccaagagacagaggccactgctttcatgtacagcataaaaacacacccaaataatttttaagggaaaataaatggctcccatgagtgatccatttgtagaaaacagacttggctaaaacagacccagttacgtgtaatcagggtacctacctattctactgtcccagaattcccatatctgtctcttgacatctgttttaggaaaaacagtaagaaacaactaactggtctgatcagccttgacagaggcaagctgaatcacagcatgtgttcctctgctgaagcaacatgacattaaagccaaatacacaccaatgtcagttgtgacacagtcccaaattggaagaaattaaacttgccatcaatattgtggtagaaggcaatgggaattgctactggtaatggttaatgttcatttcttcctgttccactttctataaacaaggtaatgcctatacaagctcattactgtaaactgagcacatttaaattggcagtaaaaccagagtatttactctagtgcacatataaagtgcctcatccaatgttttggaaacgtttcaagttttgaaaccaagcagctggcagctttacaagccaaaccttacacttaaatcattcactctggaaagttttttggtgtcctgtgtcaggtagtaccattcagcagacattcattcccccaccccttgaattcttttgcaataagtttgcattcatggggctcttataactcttccagcaccacagactccaatggctgttgattaaatgtatatatcctgtgcatttaatctgactttcattatggccacttcataaaaccgccacagactggacaagcgatgacacatagcaagaacctggaatccctgcaaagtctcagattagttttttttttctccttctttattaatagtgaccattctgtggcctagctctaaatcagcaaaagtatttgacagcaaatgttcctatctatggattatatataacccgtcctaaacaccagatgaaaaagggataaccccgggaaaggaagggcttgcttccatgtaaatcatgttacaaattggacaacacccagagagttcattgttcaacctcaattgtgaaggccattcccatttactatccccctggaatcgatgttaattaaggcaggctgagaccataaatcagcttgggagttttacaatgtaattcagcattaagcatatatatttaaataaaaagtaactgattaaccactagagtttttccagaagttgctgaggccatttctttataatagagacatgtcacctttcatttttgtgaagagaggaaagaaatattgtcttctaaaaaggtgagttagggctagttaagtgactcacaacattgattattaagaggaagggaggagctgaaaagagaaaagaagagaacaaaaagggaggggagtcacatgcaaaaggagaggaagttggcatgtttgtcctagctccctagaagtcattaattcttcctttatttgcaatcatttcttagtcacctattatatggtaggcactgtgctaggcattggaagatataaaaaagtaaatgataatcagccccctgcccttgaaataagtgttcagtactgtggtgggggaaatcaacagtcacggttctaataataaaatttgggaacaacattcacaagcacttattgaatacctactatgaatatgctccaaagataatatattttatattctaattgtataaaatatcagagaggcaatttgtgtgtcttaaagaattccagccaaagcaaccacacctgcctgacagaagccaacagaacacctctctgcatattctgacgaagtggccttcatcaaagaaagcactggctctctgaatccacagctgaagaggcagaattgtttgataagtacattctttctcaagagctgtgctaatagaacacgtttactcaggtccaactatacgatgaatcataaaacaacctgcagacagataatctagggagcagaatttcctctaacccaaagtacatggataacacacattcagtaagtaattcagatacaacgaacgttatgaggggcccactatgtactgtgaactttcaccatttcatttcatctagataacaaatctacgatgtaggcattatttcctgtctaaaggaataagctaaagtttatgatgtaaatccaagttcacaccacaaataattgacagggcaaaaaacttgaacctttcctctcaacatctatggctgttccccgtctcctctgctaagatgtaactttaaattaaagatctatattctattaggccaaaggtagtagaaataatataaataagaaacttactataaagtcagaattgaaaaccaaattgagcaagagaataataataaatgttaacatttgcgtgcttactatttacaggctctagacactttttacacatattaactcatttaatcttcacatccaccatatgaagtaggcagtcatgtttgtcctgtttatagattaggaaagtcaggcacaaaaactaaaatgaacttccccccagttaggaacacagtagaggagggttcaaaatctaaatagtctagcaccttaacctcagtcctagatactagtatgtgaaacagggtggtgccctggagcaacttccttcatgccgcatgaccttcaagtggccatctgtaccatttcaaaataaattaatcaaatgtgtttctttccaaagggttagattcctttataatctgatcccaaacaatctctccagtctcatctctggacactcatcaccaagtatctatgcctgcataacatttatacaacaccaccatttatgtaaataaaacatatagagaaaaaataacactgtgttttccatcaataatatgtccatatctaaatatagattggagtgaaaacctgtgggggaaaccagagaatttgcacagaccagtgtgttacatgcgccataaaatgaggagcatgataacttaaaatctgtggatctaagtctctccctcgcttagttcattcaagcttctataacaaaataccatcaactttgtggcttacaaacaacagaaacttatttctcatagtcctggaagccgggaatttctagatcaaggcactggcagattcagtgtctggtgagggcccactttttggttcatagatggtgcattcttgccatttcctcacatggtagaatggacaagctagctctctcaggcctcttttacaaggacactaatcccactcatgagggctctgccctcatgacctaatcaattcccaaagttctcatctcctaatactatcacctttgtataggagtcctcctttatccatgggggatatgttccaaaactcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactccaacaccatatcgtagtaagttatgtaaacgtgatgtctctcaaaatatcttaccatactgtactcacctgactgtggaaagcaaaaccatgaatggggtggagggactactgtattaggatttgaacatatgatttttggcgagacacaaacattcagactgtagaagtcccaaccccctctcaaatcctatattaaaactaccaatttctaaacatgacatgaacttttgtgagtcaggatatttgaacatactgtttcctgccttctttaattgacaggacagtaaaatcttagtcatctttcaaaactgagttcatatacgacctcttgataaagccttcctaaatcccttcatacagagctaactgcaggtcctctgacatatacctacctatcatactgtcctgtaatactttacctaaaccctccactgtattgcttgctccttaagaacaaatactatgccactacgtcatctttacttttgtataaccaacatctacataaggaacagtaaaatagtagatgcccaataaatgtttcctaagtattgatattacataagaagcaagtatgaattaaaaacgtacattgtttcttccagctaaaagcaaaacaatgtatgttttggattccaggagtcaagtttcttgaaatcctagaatcactttcatctcatgtcccagaaaagctgtctctcaatctacagtgaataccatctcatttatattgtaggcttcctacatttttcttgtctgaattgaagttaagacaaatagttttcatccagaacatgattctagataaagacactgtggtcaccaagactatggacgtatttactaaaataccagtgccactggtatcctgctaaagcccttgcaaatgaaggtggttcacaaggaactgcttttctctggggcactggatcataacactggagttctcctgagtgacttgaagtctgaaaggccaaattgaattgcagtcttctcacctggccactatcaatgatgtcattttatagtttgttatttaaactgactgtgcattaggggcttatttataaggggatacccttataaaagtcttattttcttctacagcacaggaggaggaggaaaaggaagaggtgaagttgcttgtgttttagtcctggtttcatgctaagtatgtggcaagtcactcagcttctctagccctcaatttctttgtctatgagggtaccagacctggtgactgaaggaaggctaaccatggcacttatgatacaaatcttgtttccaggctcttgacaaacattaataatgaatcatgacactttccagctagacttttctgaatacttttcaatacggcacttcagaaagctactatcaatctaatggaagatgtcatttgttattaaatctattgccatcccttacaacccttgagttctaatattctgtacatctgggttagtggatatagaacacatgtggccaccagtgggcgctcaataagaaagtgtatcagaagttctgtgataacataggtttgatttgttccttctctaaagagtgtatgttaacatttcatagccatttgaataacagaatctccatgactgctgcagagtatgccctctgtgttctcaaatgtgactgccttcttttccaattatgtctaatattttaacacacaatgaatatactacaaagacatcatttgaaacggtgagattcaggtggaaaagagtcctacaacagacatttttaaacctatgccaagtcatcaccaagaacagctggaaaccctccctccctgccaaaaaacggtttttgtttcctgttgtgaaattattcagtacaccaagatcatactttaacagccaagtcctattaaagcactattttaaaatgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtccaatggcttgaccaaggccacataccccggatttgtggcagaataaagaacgaaccccccatatcctgattcccacctcagtgctttttctaaacttaatttttgctgatgtctatttgaaaagaggacttgatggctgaccagatccgagtgatctttgctgcatctctatcatgatgcttcttttttatttaagttctgggatacatgtatagaatgtgtgcgtttgttacctaggtatacatgtgccatggtggtttgctgcacctatcaacctgtcatctaggttttaaaccctgtgcacattaggtatttgtcctaatgctctccctctcctgcccccacccaccgacatgccccagtgtgtgatgttcccctccctgtgtccacgggttctcattgttcaactcccatttatgagtgagaacatccagtgtgtggttttctattcctgtatcatgatgcttcttagacactgttcagcacaaggaattctgtttgagtccttttacttcagcacaatcaacacaggtgccagtaaaataatttttcattttctttcccgaaagcaaaatatgttagggaaactgttgatttatattcctaatgaaacactacttagagatgaggtcctgggacactgtctgcagtcttcccaggtgcagaagcagaaacttctgccagaggacagtcaacaaccagactattacaatcctcaaatagaaaattattttcctaggcatattaaggaatagctttgtgctcttccaaccaacaggactaaatttgaggattcaggaagaggacctcaaaaccaatccttatcataattacttcccagaggagggccggttttggatgagcagagggaaaagggaatggccaagctaactgatttaggagctggttacaatttcatggcaacaaagtgagtcctttttcatatgttcccttctctgtagaatctcggtatcccagactgaaaaagaaaagcatatcaaatgccaaagtctttataaaatggtcactgctcaaagggctaatatccagaatctacaaacaacttcaacaaatctacaagaaaaaaacaaacaaccccattaaaaagtgggcaaagcatatgaacagagacttctcgaaagaagacatttatgcagccaacaaacatatgaaaaaatgctcatcattggtcattagagaaatgcaaatcaaagccacagagagatactatctcacaccagttagaacggcaatcattaaaaagtcaggaaacaatagatgctggagaggaggtggagaaacaggagcacttttacactgttggttggagtgtaaattagttcaaccactgtgggagacagtgtgtcgactcctcaaggatctagaactagaaataccgtttcacccagtgatcccattactgggtatatacccaaaggattataaatcatgctactataaagacacacgcacacgtatgtttattgcggcactattcacaatagcaaagacttggaaccaacccaaatgtccatcaatgatagactggataaagaaaatgtgaaacatatacaccatggaatactatgcagccataaaaaaggatgagttcatgtcctttgcagggacatggatgaagctggaaaccatcaatctcagcaaactaacacaagaacagaaaaccaaacaccgcatattctcactcataagcaggaactgaacaatgagaacacgtggacacaggatggggaacaccacacacccggacctgtcaggggatggggggctaagtatggtacgtgtatacctatgtaacaaaaatgcatgttctgcacgtgtaccctagaacttaaagtataattaaaaaagaatatggtcactgctgtttggcccacaatttcttcttccacctaagggaattaaaataaaaattcataatggtactttattagagacactccacacatgcatttgaaaaaaatctgttaagtacaatttccttttgtcaatatttcaaagcgtcttagattctgggcaccatggcaggaaatgtcatatattttcttatctcagcaatttcaccttcctagtagaatgcttttaagaactctaataaggacaatactccctgcaacaaaggctttctgccaataagaaatgtcccttcccaaaccacaaaggaatagatatctcacggtctccaaggaaggtagtctgacatgtgaatggtgcagatggttgtattcctgtgttaaaacagtaaagatcataaagtttggctttttgaaagccaattaaaagtgactacgctggtttatacaattttacttttcaaaagagagcatcaggatagcaaggtaacaagcaagtctgttcccccaagacaggtgtagagttgcttaatttattcatgcttgatggttgaatgttacaagggtcatatctatgtatgtaaaacaaagtaaagaaaaatcaagaaattcgttaaagattgaggtgattaatcttgtatgtattccttcatcttcctcatagaacaacctagaatgggggaggtagagttgaaagatctccattttaatgccagtctgccttttgccacttgtgtaaatcctgagcaagctattaaactctctgagctttgtttcctcctccgtaaaaacagaaataagacctgtctgccttacagagctattgcacaattagtgagataaaatgtgaaatgtgcctgaagtatagctggttaaaatgggagtttctctcttccctaagttcttgaagaaaggtctgctggcttcatttggtttcccccacatcttaacagcacttaaaatgcagtaggtgctcaaaggatatagtaaatcatgtttctagaaaaagtagtggggctgggataaggaattaagattggctgtcaacagcatcggattcttctaaaagttgctttaagttgctgtatacatctcaacagttagctggataaagattcaaaacagtgaaacttactagccatacagcctgccttgcttggccacttttgcaacaggaaaacaagagaggacaaactaggcttatcgcacttgtcagcccacagcaaaatggccataactatataggcaggctgccatggattttctaattggggaatctaaagcctgaggaattctcaaagcagcaggtattgataggagttaggtgtaaataatttcctatcctcagtgaatctttgacataaagctgccatgttttatttcagtaataaaacgttttgtttttttaatagtaaatgcttcaaatgatttgtattaaactctgcagtagattgtaccttggagagttaaattttactcaacttgccattaaactgttttcattcctcataagagagtaccagacagcaaatcaatatccagattgatttatatgaaaaagtttagttaaacaatataaggaagtagtttgaggacttaatggtagttatctccttttacatgattgtcccactgtttctactttaaagagatttaagaacaaccaaaaaaatggcagcgctatcatttacctataaaaaactgtattgatgatcatctcagtatggcactctgtaaggctggtgtcctttaaacattataatcaaaggtaatatttttaactttgaaaaaaattagccccaactttttttacttctaattaagagtctacctatacagagtaaaacaataaggcaagtgctcagatcatttagagagggggaaaaaacttcttcctgaaatggttatatagttagaacaagagtggttctgttgacttccattattcattcgctttgcttcacgccaaaacatctggctaaaaagtgaaaaaaacacccaaatggcattgtatagaaaaaacacctagatgattgattgcatttttcactttaaagtcaatgttttgatattatagggacatgggctttgttcagtaagtgtaatattttactagcaaaaagcatggttttagaaagcttgctttgagaaggactaatttatcaattataattttaaatcaattaacagttttaaataatggacccaatattgcaggccctgaaccccacttatgctgagtcctaagctgaaagtcaggaaaaaggaaaagtcttcactagaaaaggctgctaactagactgctcaagtattcagacagtacaaggtcaaaaaaaatgtaaaactaaaggtaacattttaaaacagctttaaaatactaatagaaagtgattgtgccagagtaagcagctgggtattttaaattaagtgttgtatgcccaacacattgtactgatgttcaatgattacacaaactgtgttaatgctgtaaatggaaataacttaggacattaacagttaggtagccaagatccacctagcttctcacatatccatctaacctcaaggtctgcttctgaaagtgaaaggacacagatgagactacagagacaaaaggtcactagtcgtgttccccagaggacagtttggtcagcctttgatggacaaggccggatccaaatgaattgagaagggaagtatggatgggggatctgcccctttcccagaatgatgctgcttgagatattcagtgttattttgggtcattcagattaaagggtccaggggaattacggtgacctatgatgcagacctagtgttccatttgactcaggattccatgggttacagcaggatactcccacaacagatctaaaatgtccaattttcccagtctcccttaatcaaatgacaggtatgactaacacctgagctgagtctcatggaggtcttcttggactctattttttaaatgtttaaaatcttaatactctgttaaggtataataataagctgtatgtatctgatgagttttagcatatgtacacccatccccacagtcaagataatgaatatatccattccccaccccaccccacaaatttccttgtttccctttgtaatccctccctcttacccaccctgaccctcacattccaaacaaccactgatctgctttctggcactatagattattttgccttttctagaatttcatatgaatggaatcacatagtaagtacccttttctgttctttcactcagcgtattttacaatttatccatgttgttgaatgtatcttgtggtttggttcttttcactgctgaagagtattccatgttaggaatataccaaatcttctttaaccacagaaatttgatgaaggtgtcctaagatccagttgtgcctctattcctctcgcatgatttctttatgggtcatattcctacgtgtacaaagattgctagatggtgtgacttagatgtgtcatttaaactttctgtggctcaattttctcatttgtacaataagataataaaaaccatttattgagtggttgtaaggattaaataagatattggattactgaaaagcctaacatagtatgcactgagactttttattcattctgattctgaatataagcaatcaattcaaggcaatttatgagtactcttaaaaagctagtcactccttgttctgtctgagtattcgttcacttactctctgttgctactaagaccactttgctaaaccagcagagacagatagggtggggaaagaggtaaagatggtgaaggccatccaacacattaactggtctccccaaatgtctgatcactacccacttctgacactgccatagagacaggctaatgcaggctggttcaaacatggtaaggctacctggcctgtagagggtctgaacagcggtgtgggaaatgtactttgagagaagaaaactcaagagaaatggcttttatgtacccccctgtcttgaaaactgagaatgtaacatgatttctttttgtcttctgtttggaaacaaatgttcctctgcctatcttccctaggttcaattagtcttctgtctttctcagaattcagcctgttcatttgcaaatggaagacttcagaaaggctagtgggtgtgagtgtgggtcttgagggggaagggggctgaagtgtttattttcaaagccacgggggtccccatttgaaaaagcacccagcttatctcaatgtttttgtttgtatgattttgaattagaaggttggagcaattcatttaggagattaagctgtttttacaatgggcttagttgccctatttattcaatagtattgctagggttaaaaaaaaaaagtctttctactgtgctcttcattattccagtgtaccagttttaaagaattccttggtttttgcttttaatgccagttaattttacattaaaatgatgtttattaactggtcacagataaaaatcaccaatgatttctctaacagtttagagctgcccgttttagcaaataaaagtataattaaatatgaatttcagaaaaacagtaaataaaatttcagtttaagtatgggaaatcatagggtatactgatactaaaaaactaattcattatttacttaatcttcaaatttcactaaaaatcatttattttatctgacaatcccaccatgttttcatggatgttgtatgtgttccaagaatggtaagtgaaaactaagacaaattccatttcattattgcacttagacttgctccctgcacaggcaaagtacttcatcaaccggaatattaatttccagtttataaacagataaagtgataattcaacaaatcaagtgaatttgatacacaggttaagacctagttctagtcactaaagcctatttcaactaaggaaatttttctcatcacaaaaaaagtaaaaccaaaagtagcaactagcatcttcagttgaattagaagttaatgtctcaaaccactatgtttaaatgtgaatatcatctttcatttatgctgcaaagcaaacatctatgcaaggaagggctcgaacacctcaatgcatatcctaaggttgaagaaggctttgaaccaataaatgagtgatttctccacaggagactaaacatttgcttgtgacggtaaacaaaatgctgaattttatgtagcacaatcatttttacatatctgttgatataagtagttaaagaagaattattgaatttttttctgtcaaatgaaaaggtttgcacttgactcagatcttagcaaataatcgtatttaaagaattaaattattccttaaatgtgatgcttcctcttaccccaggaactggattataatattatttgcagtaagtcattcctaaaggaccctgacttaaactgtgatgataaactaataagcctaattgtgcataatttatagagttcattttaaaatcacatctaacattttgagaaatttttgtacatcttaaacttaattttctctttttatttatttatttttttagataggcaacttcccagaaaagaaaaaaagaggaaaggagacaaatgaaaagctcaaatttggtcaagatccctatttgccatttaaacacaacattagaaaactcttgctaggactacattttgaaataaacctcatgttggaggtcagttctgctaagaaataccactgaaagctgccacttgacccggaattcctctacaagaaaaactagccataactacatgagaggcctatatgagaaactgccagaatgtcaacttcatttgcagtggccccatatggcctgatcactctccctggcatgataaatcactggcagaattcttaccttcctacgtttgatctctgctcagcaagatgtggttttgatgtgaagaactccagatctcttaggtcagagacaaatagcagtggcactgacctgcaaagtgctaagtctctattagactcaagtgaaaagctgtaagcttctgacaagttcccttgccaccacgcttcctcaccctccatggttttcatgagcttagcttggcaggaaagctgctcaaatggtctggaggagaaatgacaacaaatattttctgcctactactattacaaagtattaaaatcaattttcaccaagactcaaaggaggaagtctcttgggagtcactgctctaatttctaatatggtaagtccttagcaaatatgaaacattttgatttccgctggatctttatgacactgctagccactcatttatataacgagaatcattaacagggatttctgtggactactctttggtaaccatgagtacattgttgagacagtattttcaacaaaactgtttgagtgcaaattttcggccctaaaaagaccacaactaaatatgcaagcagttcagtattgtctttcagatgcccataatcccaagttctgggcccaggaaagtagagttctaattagtcagggtggggtaaagaaatcttatagcttttctaatccaacacttttaaaaagtaggtggattaattaataagcatctcattctggtctctcattttgtaagtaacaaagctgttaccaggatttattttttattttttttattttttgagagggagtcttgctctgtcgcccaggctgcagtgcagtggcgcaatctcggctcagtgcaacctctgcttcctgttaccaggaaatttaagtggcgtacccagtatcacaaagcattttcatatttccaggtcccattatagaatagataataaatgatcaagttattttgttcattcgctaattcaataagtatttattcaatgcctgcatatccaagaaactgttaaatgaacatacataagtgacagagctggggtcagaacacgggtcttctaatgccctgtccagtgccttgttcactgctctgcaaggtacactgaaaggtttctatttcagaggaaggggtaaatgcgtggcaatgaagcagaagagttttccaaagtggatgtgtgtataccttctttaaaggaagcacatgaaagaaatttgtttcaaaacactttaccttggaattcactttctagtcctggcattttaactattaatgactctgcaaatgaaatcagacaatttattgtctaggatgtattcatttattcattcatcaaacacgaagatgtatggaccacactctgtgtcaaggcagccatgataccggctctcataaaaatttaagtccaagaaaaaaatgagtctacaaattaaacagtaattggatcccttggagtgacattataaaacacacagtacttaacagtaataataaagttcgaaataaacctaaaatgccacatttaaaatgcttcttctaagagatttttgtgttctgaagtcatgtgtgcctatcactgaaaatgacagcagaaatactccaaaaattgtaaaactaaaattggtgtggaattttagttcactgaaattataaagtgttccaaaaaagcaaaaagcatgctatcattttaacagctgcattatttcaacagttgtcccctttacaccactcacaattacagacactcacaaataaggccctcatctccgtagcaataagttagtgactttgcaagcattcagtgaaagcaaaatgtttggtttgttttttggctaagtgtactttatgtacccctatttatgcatacatgcctatactaaatgctgagcaatcatctttctccttaaatcagatcatcaggagttccaaaaatcactgttttgtgtacttcttttctacgccctctctttttctctgttggaattcctggtaatgataccagaatgtgggcaaacctcattagtctccctgctgtttacaagacaggatttatgctcaatgtgctgaacacaatgacacacatcactaaatagctacaactaccacccaggctttaatctcagaaatttttcactcagtacaaatacctatcagcatggagaaacatggaagagcaattacagccaacacgtgtagtcttttaagagtacaccaataaatacccatttgtgaaggttaatttaatgcaacccaggctgttatctggaatagtatatgtcgccaattcaatccattaagtaattactaaattctcaggagggctcccagaagtcaaatgtggttattccaggttcattgcttctggtctcccaaaggaccatttaggccaacagctgggagagccaactacaaaggttcccaggcataactaaccatttcatgcaaacaggtaaatgagtctaaacgagaaataagagttatcaagtgcctgtcctaagagaaacaccaagggaagcagaagagaagcacaaaaggggaggaataaaaaaggaaagaaaaggcataagtttggtaagtaaaaaagatctgttctctctaaaagtgaagtcagagaaatctggagattgcaagatctggcttaaaggacacaacctttcagcagtttctttagagaggatttttcaatcatttataatgaaacattaattgtgcaccccaaatgccacccctttgtgttgctgaaactcaaagtttgagtactgcatgaattcctctattctgcctccccactgagattacaggtaacagagggatctgatagtaattaagccttagtaagatgattgctcataagagacaagatggaacatacccacccaactctttctggcaagcatctctctcacagaaattatagcccagttacacaaaatgatggcccactggggcacagaaagcattagaaagaatgtaaaatatattatcctcaatagcctcacacatcctccctcccaagtcaatcttaacagccataaaaaaagaaaacactttttgaatgcaaacaaaacagatcaaataaacaggtgttattaagggcagtgtgtgactacacaaccaatgaggattgaaaaacatcgttctttatcataacctaaaaaatcacatattcccaggtgatgtatacctaaagtgtcaaattgtatcaattctctcctttttttaaattcatactcccatttttgtctggttggaattgttgcttatgatagctgcggacaatactgagtggaattagacttaggatctgaatgaaatatgggatttgtagttgaggaactgggcttggggtttcctatgaaacattcagcaaggctttaggttaatagtccaaattgtattgtctttgtagtggttattatgtttgtccttattgttacgagtagggaaggaggagtattgagtcctggaattgccacccactattgctgttgagcctgaaaaaactaactttaatatgcttgattttctcacttataaaatgaagatattaatacaatatccacatcgtagtgttgccccaagaatttaatgtaatcatatgtgaaaagtactctgaatattgtagtattaataataaaagccgtagctattaaaatataacaagtattcattaagaaaacattcttgaagtttctacattgttagacattgagctaggtacttcagaaacaccatgataaataagagtttataatctagtacagtttagaagtagggagttacacagaaaaatataataccatgcaaaaattgtaccactgagaagtgcaaataagtaatatgaatgctcagagaatatacattcattatcaaaaaataagtgtgtagccaaaattgtcaggtgttatatgtaagtatatacacagaaggggtagttttagttttaaggttggagaatttcacacttccacaatattttctttaaaattagagatacacatgtatgaaccaaatcactgatgaaattcaaacacaaaggtaaatatatacaccagctttgggtttagaacttaagttaaaatgttaacaaaataagaagtaatgttattttcagacctggtgcttaggaataatttaaattctcttcactaacaggatgaagtatattattcttgaataatgtagagttattcaaaaaaaaggtcttttagaaattctttttaaattatttgctacctatccatgttttctccaaatctatcagcagcacagagtgaataattcatcaatttatcttgacccttcaaaaatgagtgttgtatgtgtgtgagagacacagcgcgagcgcacatgagcaagagtacaaccacagctaatatttaagtacttattctgttccagataatgtaagaaaggtagggaaattaagtcttgacatgaataagttataataatcatgttaccctagagttttatacagtggccgcctagaggtaagtttgtggaacacagcactgttcttagtttagggaaactagtgtgtattaaaaccatcaatcaaagtagtttctcctattttcccattatagagaagaccacacattctagacttcctaatctgattccaagacttcaaggaatacaatttttaaaaattatttaaacatcaatattgtttgactttccaatgctacatcatttgtctttattattgtccccatgcataagcaatgaccaattctaggaggtaaagacagaaatgcaaaaagcaaaaataaactttctgaagactacaaaaagaatgccttgaaaaatctgcaataggaatgcatttctgaaacaggactctaaaggaaaaatccttcttcctttgcatttaaaactgtatgacagttacacaagaaaaagaagagggaaagttacaagaggaaagaaaatgtttgcatagtaaataactgataaaaattataatcctgaatacatttataaaaactgataacaaatcagtaaatacacaacatagaaaaatgagcaaatgataaattagccaaaggaggaaaaccaaacggccaacatgaaacgatgctcaatctcacaagaaatcaaggaaacacaaatcaaagtagcaatgagatgccatttcacacttaccaggttagcaaaatttaataagtatgagaatctgaagtataggtgaaaatgtagactaatgggaactctgacacactgctggtgggatatactggaggtgtacatactgggaatatactggtggtggaaactagtataactatgttggacagaaatttggcaatccctaattaagttgtagatacatatactccatgagccagcaatatcacttttaggtatacatcctagatgctctctcaccaggtatatgaggagacatgatcaggaatgtccaatgcagcattactgcaataacaaaatgctggatgcatcataaatgtcaagagcagaaactaaaaattaggatatattcaaagaatggaatactctgcaacaattacaatgaactaattataagtacatccaacaacatggatgaatactgaacatatgtttaacaagctaatcaaattacagaaggatatatatatatatatggtacatatatataaaacatttatataaaagatgttaccacgcaaaacaatagcatgtattatttatggatacatatacctatagtgaagataaatgcctctggcaaaggaagagaaagaaagaaatgggggcttcaatttattccttttaaaaaattagaagcaaatactgcaaaacattaagaactaacaaatctaggtacaggtacacacatttgttatattactgctttacttttctgtatgattaaagcaattcattttctgtcaaatatgtctggcaatagtgtgctgttcttctgctgagctggaaacatctctatcttctgaatcctcattcatctcaaacatttagcatcttctatcatgaacaatagctactgtgtgcatgaccccactccacacccaaatgggaatcctctaccgcctcttcagagcaggggccacacctatatatctttctctgccagagtgactcacaatgctttatacacaaaaggccttaataaatgttaaatacacaaatgaatacataaattcagggaggcacaagagtagctctggctacagccaaaaataaaaatgaccctgagataataaaaattaaaattaaattttataataaaattaaataatacaattatattatcaaactgtaaaacatagatgaggcagaattcaccagtttcagttttattggggattttaaccaaacagtctcacactgattcttcatcttctcccaaaaaggattctgccagcaagtccaattttcacacctagagaaataagactttcagttgttctccataaattcatacaggcatttcataatttcaccttcccaggcaaagccttcccctcctccttcccacctgaaatcgtgccactatcacacacatctcagtctggaaatctggtatatgagtgttaggagtgacaggtggggaaaaggggaagtaggttatttttgcatatctcgtgggcttgctaaataattagtgggtttcctaaactcacaatatttcgccagattcatttactgggaggtaattccattcttcttgtgggaaagagtcacacaacctataccactttctgactgtttaatctttaaggaatcactagaaatgatattcaaaaaaaaaaaaaaaaaacctaagagtcactggacttgaaattcaaagtccaatgaatagatggatgaaaataatgtaaaataaaatatattaaaatataactttttaatattttgaaaaatgtataatcaagattggaaagagttttcagattcatgatatgctaaattcttctagataagaaacaggtgtttccagtttgacctaaacaaaagcttttctctttccacagttgtagtgataaagaaatactactttggctctccaaaggtcagacagtgatgaggaagggaaacagagcaggtaactacttctggaggtaacagagctgaactggagtaaaagaaaggcttccttctataataaaaattagaaagttcacacgcagacatactaatttttaaccacattctacagaggtcaattaatccccacgtttagccccagggaagtgttgtttagagcccagcagaagtctaggtggtgaaatcacccaattattattccaactggaattttcaaagcctggaagtgttttcatcatgtgatccaacagagacttgttgtaaataaacctgctgtaaataagctctaagattttgaaggaaaacaatttaaacataactcaatcttaaaggcagacagtagagaaataccagtgataagtaattcccaatgtgcataatctcatatatttaaaaggttaaatgaaatagatctcaaagatacaattaaaggcaattaaaaattaacccaggtgacattacagcaatcacctctacgtgaattagatttgctgtttggggggaaatgaatggctttgaaattacctgtcacagtcaataaagaaattaaagaaatgctaggagggctttcaaaatagccacggcctggtgcttttactttctggaaggtgactgctcctggaaaatgctctcaaaattccatatgttatcttggacagtcaggactagtaaaagtttcttcgtttttaaattatataaagtaagataccttcccactgtcaaaaggtatctaccttctgagaatgtccttgtatgctgcatacttcccacatttatgtatcaatatcttgtatttttatcctaactacttaaaataccagaaacgtctatttgcaacctggagtttaggctcagctaatcgggcatattgaagcatattcatgctatattttggcacaaatgtcaagatatctaattttattattaaaatactgtcagagaaaatgctttagtaacttttttagtaaagacaagaccttggtggaaaaccctcccaggaatcccatttggtaaaaacgcagtgtaaatatataaggaggattccatagctacccagaatattgaactcttatgagtaatgcacataataaatgtaataaaaataattaaaagaatacataaaacagaccggttttataaaactttgttgatcatataatttttttgagatgaagtttcactcttgtcgcccaggctggagtgcaatggtatgatctgagcttattgcaacctctgcctcctgggttcaagtgattctcctgcctcagccttccaagaagctgggattacaggcgtgtaccaccacacagctaatttcatatttttagtagagatggggtttcaccatgattggccaggttggtgtcaaactcctggcttcaggtgatccacccgcctcagcctcccaaagtgctgggattacaggtgtgagccactgcgcctggccagttgatcacataattctgatcttccttaaaattggtttccattaatttagatctctaaatatatatatagtcatcactttgcaaaaatgcaatagaattttggctatcattatatgccacttactttaacacacttttcatttagtccttttaaccccataaagtagatactattatctcaatgatgacaaatgtagaaattgaaagtcagtgaagaaactctttaagatgccacacatatctttttttttttttttttttttttgtgctgttgcatccctaggacctggcatcatatcaggcactatgtgtcaaataaatgtaactgtccatgtagctgataagtacctttctgaccaggatttgatcaaaggcttattttaactcagagtctctctttttccaaatgaaggaagggcatgcaagttttttctaaaatgtgggctatatggtttctgtggctctgccattatagtcagaaagctgccgcagacagtatataattgaatgagtgcagttgtgttacaataaaactttatttataaaaccaggcagacagtccacagtttgctgacccctgatactgtcactaagataactcaagagacaaaaactcctatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgaggaagtcagacctcacaaaacagtctcctcagagaatcctctactctgaaatacaaaaactatcattcatcattttatagaaataaagaacgaggagtccctcagcaaatgataattccacatggtaacataggcccatgtagtggaagggatcagggcaggaccccaggagaattatctaattcaagtcctgtgatgaaattgtccagcttccctgtgttaaatggagatgatacaaacaccaaaaagctgcatagttatgaaaaagtatttaaaaaaaaaacctgaagtcctctattaacatgtagtttgactgacaatttatgaccaaaacagacaatcttaagtaaaggtttggaaggatctagatccacacctatcttttaagaaattattcctggcacaggcaagaatcttgccccagattaaaaaaaaaaatctcatagaaaaatcaaaaatagccatttaaagtattagaatcaaaagtcacaaaagatagctccttcttaagaggggtagactagttcatattttctccatggttgcgagagaagcaacacaaaatataaagatttaaactccttccctcaaaaaaaaaaaaaacaaaaaaaaaaaaaaaacggaacaaaacgatgaaaaaacaacgtgccacagaccgttagaaaaagtgtatggtgatgaaaactatcaatttctttaaagtcaaggccaatgtctttcttatgaattattctatttatttctactctctctccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatttttggcacacaaactttttaataagaccctaatctcccagaaggcagatgtttccagtctaacacagtgaaaagcacccctgttaggaacatggccactcaaatgccttttgaatttaattgaaatagaccccagaaaacagaagtttaaatgaataaataaaaagacaaatctagactcacgatgcacattagctctgagttttaagttgattgcctttttgcctcttctattttagcaggtcattatgttataaataccctcttcctccctgtgtttcagccccatataatatcagatgcagaaaaaaaaaacataactctttgttactgttagttatgggcataaactctcactgaaaaagtgaccaagagaaagacagcacaacgatctgggggagggaggaaggaaaggagagaccggtacagccagaagagaagatagagccaagaaagaaggtcgaagtggaatacagaggacaagtttccaaagacctgggaatctgttaagagatatcccctgcagtcaggggcggtcagtaaagtgctgagccttgactttgtaatgtgtgtattcctataatatcagttatacaaaattataaaagtcagactaataaaatagacaactcagaaaattttaaattcataaacacatcgctcaaggcaatcagaatgcagtcttcttaggatacaagcaaaggagagcgcattctcttggtaccaaattggtcccctcaatacttcatgttagttttcactcctccttgactaacaccatctagttttaaaaagcacattccttcataagggatcacttttaaaacttgggatccagcttgctgtattagggaaatacaaatagacatgttccaaaaatggtattgccattgatcattggtataatatggatactagaatttcagagtggtaagcgtattttaaaaaatggaatgtaactgcctaaaagtccatacacaaccatgagtttagccctttcaacatccttagggaatgaactttaattctggagcatttccactggacctctagcaggcaaaggcagtaacttttaattctggtcatctcccccattccctttattaaaaatgtgaaatacttctaggaggaggaggaagttggagcaaaaatacagaaaaatacaagatcacaagtacaaagttttctaagtgcacattacttgaaattctcatagtctggtcatttattttaagtagtgactctatgtgggtcccaatatcacactgaaaaatcatacagaaagtcatatccttcactaaagatgtatgtttagcaagacaaaaaacaataacatattgtcttacagtatcattttctgatgcaaatattgtgtttctttcaaatgtgatatttaacacgccctaacgcgtaatacttttgtagccattacccttttaaaatcccctatcgaatatggtatcactatgctaaaggactgtccattctatcttgttcactcttctgtttgaaattgctaatataatttccctcacttctggtcatgtttgtttttaaaaaactcactattaatcttatttttcctttaagtaaaaaaatcattaccctgggataccaaaagagcagcttctgctcttcacgtttaaaaaaaaaatactgcttgtccactatgcttgtcttagaaaatttagaagtctcactaaagagctgaggaggaaaactgctgggaatgctcacagatacctgattttacaagtttttgtggaaagagctcgcctttagattagtgttactcagtgtttatgagggttgtttgtcaaggcaaaaataaggtacctcctccccacaaattaaagaatcaagttacaatccattatttcatttctgattgtttttctttgtattaagtgggaaagtggatactggataaaagttccccgagctaaaagactccacattaaaggctccaattagctataaatcagttgtctttcctactgggggagaacaagagagaaaagagagagggggtagttagggagtaagagaactggaagagcttccaaattaaattctgaaaaacgtacctattgcatacctaaaatttctttcagaggctgttagaaaaatcccatcaaaaataagactaaaatcaaaccttcccaaatctgagggttaggtcttttctcctgtgtagatcttccattttaagacctttaaaaagagcctgaagaggttagagaccctcataaaataaaacttctaagctgcatgctttccctgctcgttcctaaacccagacaagtgccacacattggcactattgttatgcaaacaatgcctaaaaggttataaccattaacgacctctcattaaaacggctttgaaaaatttgtcacaccatctaaaaaagctagcaggtacattaaatccatctaaatcgacattcaaaacacaaatcgccctgatttgtaacctaaaactcaatgcaagtaaaatctcaatattctgatgttgtttcttgtatatctcattcaaccactaagccagatgcaaacaatttacttctctacaaaatttatcttgtaaaaaagcacgatggaatacatctttaatcaacctttaaccatatgcatgtgcgtctatgcgtttgcgttaattgggagaagttgagtgtagaaatgtaccgaaaggactagaaaatcaaaccagagaactacaaaatgaactccaagaaacgtggttttcaatcccatctctctctcaccacctccctcaaaatgttgtaacattacaatacccctacgtttgtaatcgatcattttttttctatgtcgaatttgtggaaagtaaattcattttatattaggtagcagacgcatattcttttttaggcgatgcaacaacaaaaatcctgcttagcaaacccaagatgtcaacgttcgttataaaaaaaaaaaagtaagttcttcagttcaaaaccgaacatgctaacaaatattaaaactttttaagtttcccagggaaactgccgctgcctacaaaattcacatgaaacgctgacgttggagttactgtacttatcagtcaggtttccgtgaaatttgtcaaaccggccagagcgctggtgtcttgacaattccttacgggaaagcccctcagcaccctccgggctgtggaggacctgattgggaccaacagccgaggggcccggaaggcggaggaccgagaggcgacggccaggctgcgtggccaagctgacggggaaccccggcctccatctgaggatactaagcggttccgacgccttcccccgcggcagtcgggaccgggagaatcggacagaaaccagcctcagagtccggggcaggagccgttgacggctgcccctcaacgctgcgcttcgggttgggttaagtccccaaggcgtcctcagaccacggcggggcttcaaacgccccagtcccgaagacaggcagggggtccctctgctgcgccgggatgacaggctggccccgacgaccccggccccgtcccgcagccctcacccgctgaagagatcggggaaaccgaagaaggttctagaaagtctccgtggacgacgggcgctgggcggccgcttaccttggtgtacttaatttcgagattgggcgtgggcgacggcaggaggtgcagcgacgccatgagggcggcggggtcggccttcacctcgccgggcatctctatcttgctggaagtcatggtggcgggccgggtgtccctagcccgcggcgtggggcagtgcgggctgtgcgcgcggtccgcggcccgggggcgcgctcgcctgtatataggcaggtgtcaagctggggctcttcttattggacgtgagggccgaggcgcggggggctggtccatcctacctaggacgcccggcgcagcctccatttacataaagcccgcgccgcgcggccgggacgcttggcgcccacggtcaagtccgcccggcgctcccgccccccggccgcggagacc
